United States Patent 7,745,391 (HUMAN THROMBOSPONDIN POLYPEPTIDE) - sequence listing, part 218

SEQ ID NO: 552468 - DNA, 140 bp, Homo sapiens
ctagaggatcccctaggcagtcgtgctggtgctatgggatcgtgctggtgctctggtgctgaaacaattcacaggctccagaaaagctttacagcctatacatcttaggtgagagaacagatagcaccagcacaattcct

SEQ ID NO: 552469 - DNA, 463 bp, Homo sapiens
  misc_feature (4)..(4): n is a, c, g, or t
  misc_feature (27)..(27): n is a, c, g, or t
ttangaaggggggggcggcgagccacngggtgtggtcctcctcccccctcgcggggggtgtatcacacacccgggtgcccttctcctttgtgtgggggtttttttttcccccccccccctgtgggtgtgggggggggtggggggccgggggaaaaatattaaaaccccccccccccggggggggagggggggggctttttttttttttttaaaccccccccgtggcaaaaaggggggggggggggggggggttttttttttttcccggggggggggggggttgggccccccccccccccaagagggccttttctttttcccgggggtttttttgggggggggggggcccccccccccccccggttttttttgttggggggggggggttgtggggggcccccctttttttttttttcccccccccccggggggttttttgcccccccccccccccgggggggga

SEQ ID NO: 552470 - DNA, 1570 bp, Homo sapiens
  misc_feature (578)..(578): n is a, c, g, or t
  misc_feature (1181)..(1181): n is a, c, g, or t
  misc_feature (1188)..(1188): n is a, c, g, or t
gcgcaaccgttatccgaacgcgagaggtgtgttgctgctgaacacctatccttagggttaacacatgactgtctcaatctggtgtgcacagcatgagcgcggctcaatccccctatcaacaggccacactctgaatactgagtgcactgagtggtcctctctggaccgtccagccatcgagcatctgcccacgggagcccaccgggccgagcccctgccagcgcctcgccaagcctggcgagccgccgccgctggcatcgtagcttctagtctgtcggacctttggctccgggggatgctatctttgccactgttcgtcgcgctattgtgtgcgaggctcgtgtaactcttgatggggctcgtgcaactccaacgaccgtggcatgattgcgattccctcgcgtggggcattttataccgctgattacactaggccggttatatgcaatggctgagatgcctcctctaaaataacgtatctagaaggccggcagatattacttagatcggggattttcgtcaggaatctatcaacggttcaaaacgtagaggttatcggtttggttaccgatagtctntcttagttgccattgacacacgcagcgattagagacgcattccccgttgaccagtctataccccttgtgaatggttaaaccgtctcggcaaatgcccaaagcgggaaacggtcaagtggcctgagaggcctgtatagaagtctttttcccctctattcgcaagagggatcttattcctcaaagggagagttccccttctgggagtaattttaggctcggcaaatttcgatcggtctgtctgcgaggcaacgacggggaggcatatgaaacctttcaatacttgcggtagggttcggtccgccaattttcaaccattaatctcagttggaagagggggacattaagagcttcgttgacgttaagaactccaagggattggcactgtgcgagaactgttgcggtaatagcgtgacgtcaggcacacgaattattgggcggcgccttgagaggtgagttacccctaacataggggtaagaagctctctcgccgataaaaaatgggggtttgcatagggacactttttccaaaattatacgcccaccgaaaagccaccccaaaggtggtatttaccacttttggcacacgattatgcaacggtctantttgggntaagaaagaagcaacttgcgcaaatggataatcgccccagaaaataagaggtgggcttagtatccacgaggggcatattggacaacacgaggaaccctttatggacaaagcgccagtttaacttgaaccgaaagacggggacgggggtaaggaccttactaccgtcccttcgtgtgtggagttgaacagtaactcacgtcaattagttgcgaagtaagacggacccccacattgcaccttggaaagggatcttacaggaccgcttgagctttatatgtgaacacgcgggttactcataggggtcaggataagggccgaccgttgggattacaaaagagcttcattgatagggcacttttcccgataagaagagtacacgccg

SEQ ID NO: 552471 - DNA, 297 bp, Homo sapiens
tgcaatcgcattcctaacgggagcatctttgtcgtgtgtaatattctgctttaggtttagggcaagattagtggcattgactgtaagatttacctacaaaatatttgcatagtttatctaaatttatctaaagaacaaatctacattttataggtcatctttcaaatatcagtcctcggtttgaattatccatttactagtgcggattctagctcgcccccttgtcattgtcatacaccttcatcaaactttaaagttacactgctctagttacgaatagcttctacttttctagga

SEQ ID NO: 552472 - DNA, 653 bp, Homo sapiens
gcaaggtgcataatacgtgttcctcaatagggaccgctatgatggctccacgagggttcactgtctcttacttttaacccgtggaattgacctgcccgtgaagaggcgggcattaccccgccagacgagaagaccctatggagctttaatttagtaaatgccaaccgtgtcctaccaacccaccaggtcctatagacttcccaacctgcattaaaatttcggttggggcgacctcggagcagaaccccacctccgagcccagtacatgctaagacttcaccccgtccaagcggactactatactccatgtgatcccataacttgacccacgggaccagttaccctaggggtaacagcgccatcctattttagagtccattgatcagccatagggtttacgacctcgatgttggatcaggacatccccatggtgcagaccgctattaaaggttcgctttgttcaacgattaaagtcctacgtgattctgagttcagaccggagtaatcccggtcggtttttatttacttcaaattcctccctgtcgaaaggacacagagaaataaggcctactttccaaagcgccttcccccgttaatgatatcatttccacttagtattatacccacacccacccaagaacagggttttttta

SEQ ID NO: 552473 - DNA, 2258 bp, Homo sapiens
gttgtgtttgcgtctgcctacattcttgtggtggtttttggttgttggttgcgtatgtttgttgtcttcgtcgacgtgggtggtcgtggtggggtctgggttgttttttttcttgtgcgcttctggttggtcgtgtcccgccctcgactctggctgcgcgtcctggcgcgtgtgggtgttgtcgtccccccctccgcgtggtggttgtctggcgctcgctggtttggttgtctgtcgttgtgtggtgtgtgtgtggttgtgtgcccgtcaggcgtttgtgtgttgttcttctctcgtctggtttgttgtgtgtttctgttggtttgtttttctgccgtctgtgtgtgttgattccgcttcgcttgttctgtttatcttttgtgttttgggttggttagtggtgtgtggtttgtcgacctctccgttcgcgtggtgggtggtgtgcttctctctccgctggttggtggcgggcctcgctgtggttctgtgttgggttggttgctgcctcggtacgtttggttctgtgtggtgtggggtgggcggagtgcggagccccctccgtcgtggtcctgggttttcatcctggtgtgggtcgtgttgggttagtctcggcgccgctgcgccgcgtggtgggttgtggttgtttgtggtttatgttggtgtgtggtgggtgagtggtgggctcgtcgtcgcttgttgttcgttatttgttttgtgtttgtgtctgctcctcagtgtctgttgggtggtttttgtgtttgctgtttgtttgtttgtaggatgtgtgtgatgttgatagttgagttgtcttggttggttgtgatttgtcgttgctggtgttgtcggcgcctgggcggtgtttggtggtgtgttgtattggttgttgatcttcctcgttcctggtgttctgtgttttcttgttgtcgtggttggtgttgtgttttgtctcgttcctctcctcctcctctgcggttgttgtttcttgtttgtgggtcctcccgcgccgctcctcctcgcgcgtgcttgcgttggcttccgtctcggcgcgcgtgtggtgctgtttgtggcgtcgcccctcggttcgtggtcctctcccacttcgctcctctctttctgcactcactctctccgtcttcacgtcgtcaccctctcgacgcgcttccgcgcgcgcgcgctggcgctgctctcttcgctcgctcgtctgctgtgtggcgacctccaccactactctctcttctctttcgcgtggcgtgtgtcgcgccgacacccaccgccgccagcggtggtggctcgccgactgctgcttgtgtggtgttgttctctctctgctgctgctgtggtgtgtgttgtgtggagtggtgtgtgtttgtcgaccgccccaccgcgctggtgttgtgctgctgcttgcggtgtggcgggattagatgtggtggggttgttgtgtggtgggccgctcacctgcaccgcgtgtgttttgtggtggtgtggtgtgtggtgatgtggttgggtgtggtgttggtgtgtgtgtgggagttagatggtgttgtggtgtggtgtggtgtgatgatgagaatatcgtcagatagtagtagtaatgagatgtagtttgaatatatattgttgtagtgttgtagtgaatagattattatttcgacaactcttgtgattttgtgtgtggtgtagtggagatgaaggataataatgagaagtataatatctcatacttgttcgttctactcacataatgtggcagtgtggtgcgtgttctcccagcatagtgtcggcgcaccaccagcgagagttagatggtttgatctagtcttcgacttctctgttgtgttgtgtgtgctgctgtgcgcgagtgtggttgtgtccgccgccagccgttgcctcttgtgtcgtcgacacacaacagtagggtgttgtttgtgtgtgtatgtagttagtacgcctctctgttgctgttgtgtgcggggtgggtagtcgtagggtctgtgtgtgtgtgtgtgtgtgatatgttgtgtgtgtgtgtgctgcgtgtcctcgctccccgctctgtgtgctctctcgtgtgtgtgtgtgtgtgttcttcgcgcgatcatataatatatatatatatattatatatatataaatatatatatataatctaatatatattgacaatagtaaagtgtatgagatatgttatagcattcgaaggcaaggttaatcgtcaggggccggatgttagagggtatgtgtttgctccccctcca

SEQ ID NO: 552474 - DNA, 467 bp, Homo sapiens
agggcattactgaaacaatagcaaactgttggcaaaatgtcaattgcctaaggctgtgatttcagttgaggcaaaggaagaatctggccaggaatttaaaaggaaagtctggagaactagccaactatagggaactttggaaagctctggcatattcctgggtatttaaaaggctgtacaatgtgcaagtctgtacacatgcccggaaatgacctgggaaaggagaatgtcacctctgactgatcttgaggcactgtgtaagcaggaagtgaaaatcagtgctatttgtaagcttcctgaagtttgaaggtatgacttctcatgaagatttctttggcaaaaggtagaagacatataggcaaagcatttaaggaaatcttttaaatgatcattggttgactactacattttactggtccaggtatgacttcttggaagccaggcttacaaataaaaacaagatccta

SEQ ID NO: 552475 - DNA, 381 bp, Homo sapiens
gtccgtgtgcccttagcccacgacttcagggctcagcagctggggccttcatggcaccaaacctgggcgtaaggggtgcaaagacgcgctcataagaatcgtgaatttgtccggaggcaaaatttggggggctggctacaaaaccggaacagggagatcgtatccctaagtgaaagggactgtgtattaattgtgagttataacaatatgtaaaatgcataaaagagatagagcactgcaggccatcaaggtggggcatttgaaacaggattaaactaaattagaaggaggattaaatggcttttgtctttgtgaagaaaagaatatgcatgcagttgattgccggtgtagagaggagtaataaatcttttggcgtggtgg

SEQ ID NO: 552476 - DNA, 866 bp, Homo sapiens
  misc_feature (97)..(97): n is a, c, g, or t
  misc_feature (178)..(178): n is a, c, g, or t
  misc_feature (200)..(201): n is a, c, g, or t
tcgagatgcctcttctctgtctccttatcagatagaaatggagtcatgtgctgctgcttcatctagcagaggttggcctctggctctgacacttttngtcagttgtctttaggtggtcctgaatcttgggcccttttgattgtgaatactgtgtagcaggatcttgagagtccttgtncttacataggcattgtctagtnngtctttggcaaaaacagaaaaaaaaaagggtaaattattccaggaaacccttgcccagacttaattacttgctggggtggcattaagagaatctcaagccatttctcaagagatactttcataaccagaatttgtctgtgggctagcagcttgttcacagattaggcagggcacttgggatattgaccttttctgctccaggtgatctcacagacctaagaccttttcttatcctcctcctagaagttttggactggggacctctagttgttaacgatgatgagcccgtgcatcaggtccttctgcacttgggtggaagtctccccagggttaggttccctattggaaacagtggaatcttgttcccagctgcataaacgttaattgacctcatccttttttttttctctacatctgccattggtgtgctctacagaggggttcaaactggccttgaattgtggcctcatggtgggttctcagaaatttgggtccagttttggcccaaatatagctttctggctctgtcataactggaccccaatacccttgtaggatctggtttccagcgtttgggttaccctacttgttaagcgcggttgtccccattaacttattggcgcagattatgaaccgccactcatgggatgcctgttcaatggggc

SEQ ID NO: 552477 - DNA, 653 bp, Homo sapiens
ggacccttttcacaagatggcgccgaaagcgaagaaggaagctcctgcccctcctaaagctgaagccaaagcgaaggtttaaaggccaagaaggcagtgttgaaccgtggtgtccacagccacaaaaagaagaagatccgcatgtaaccaccttcctgggcgcggaagacactgcggatccggaggaaagccaaatatcctcgggaagagcgctcccaggagaaacaaagtttgaacaacatatgctatcatcaaagtttccgctgacccactgagtctgcccatgaagaacgataagaaggacaaaaaacacacttgtgtgtccattgtgtggggactgttcaacgaggcccaacgaaagcacccaggatttaacacccagggctggtgacagcacagcttgtattgacccattgattgttgggccccaaggtacaaaacccgttgattcggggccgtgattggcgagagaaaagaagcggcataagttgttccggaagttggactccctggatataacggagtgccttgtaggattgttgtgcccaccaaaccaattgggggacatacaatcttaaacagttgaagtacccagttggccctaaattctggaattaatataataattataataattatcatttacaaccaat

SEQ ID NO: 552478 - DNA, 604 bp, Homo sapiens
  misc_feature (25)..(25): n is a, c, g, or t
  misc_feature (79)..(79): n is a, c, g, or t
  misc_feature (82)..(82): n is a, c, g, or t
  misc_feature (91)..(91): n is a, c, g, or t
  misc_feature (95)..(95): n is a, c, g, or t
  misc_feature (97)..(98): n is a, c, g, or t
  misc_feature (109)..(109): n is a, c, g, or t
  misc_feature (242)..(242): n is a, c, g, or t
  misc_feature (294)..(294): n is a, c, g, or t
  misc_feature (303)..(303): n is a, c, g, or t
  misc_feature (319)..(320): n is a, c, g, or t
  misc_feature (331)..(331): n is a, c, g, or t
  misc_feature (360)..(360): n is a, c, g, or t
  misc_feature (392)..(392): n is a, c, g, or t
  misc_feature (405)..(405): n is a, c, g, or t
  misc_feature (417)..(417): n is a, c, g, or t
  misc_feature (437)..(437): n is a, c, g, or t
  misc_feature (478)..(479): n is a, c, g, or t
  misc_feature (591)..(591): n is a, c, g, or t
ttccttcttgatcctggatgtattncctatgtattttacagggttacaaaacgtctctcattttaatattaccccaaangtnatctcaganaaananngttttttgaanttatacttgacttttaaataatcatacgggctaacaactttcaaacaaaactggattagtaggatttcttgcctgcttaactaacatgacagacttcttgtcccaggcccttctcagaaaaacctcatgtggnaaccaagctagagataagaattcttccctgatgcagttaggggaccgggcanaggctaganacttctttggcaagcnnttccacacacngccatttatgtgtgagtgctctgcttcangcacagtacgctctttgcaggggcggggagangttcagggtgggngtggtacttttnatccagctaaatgtgcagangtcatctagtcgtctgcctcttcccactgccagtgcctgcnnccttgcagcaacttttaaccacccctatggactggaatattgagttaaaagccaaggctgagctggctgacgctgtagtctccattgaaaaggaaatggatgagatggaacnaaaaaacaccagt

SEQ ID NO: 552479 - DNA, 894 bp, Homo sapiens
  misc_feature (133)..(133): n is a, c, g, or t
  misc_feature (144)..(144): n is a, c, g, or t
  misc_feature (576)..(576): n is a, c, g, or t
ttttttttaggttttaccattcgggattattcttagcagatgctgcagataacgtggagagcatatgaaagacacatgtttgaaccaatagtgacatacaggtgctaagttctgcagtaggggaagggcaganagcatggaganggcctggcaatcctggagcctcagaaaaaagttccccgttgaattgctgttttagctgagacttctgggatgggtagtagttggagatcccagacaggaggtgaccgagttagcaagggaaaaattgggtcctggcacccatggcagagttgagtgatccagtctttctgtctccactggctggaagtccaccagatctgggaatgtccagttgggggagggggctgacaatgatcatgaccttcacctgtcctcacatgtcctctgtgtatctgcaaagcctctgcctcagtctcctcttctggaaagtgggattggaaaccacatctgcttctctcccaggactgctaggaagacaagattagatggcaggtgagagctctttgaaaatgaaaacattctgctatttgaatgcaaagtgttcttctttgnctgtgatgtttcctaatctgtgaaatcatactggacctcgaagctgtctattaaaaaaatagcaaagtggctgggcatggtgctcatgcctatagtagttctagcactttgagaggctgaggagggtggatcatttgaggccaggagttcgataccagcctggccaatatgcaaaaccacatctctactaaaaatacaaaaattagccaggtgtggtggcatctgcctgtagtcccagctactcgggaggctgaggcacaagaatcatttgagctcaggaggcagaggttgcagtgagccaaaattgcaccactgcac

SEQ ID NO: 552480 - DNA, 181 bp, Homo sapiens
taaatttcccaaaaatttttttgatgtttgcttgaatacattttattttaaaaaattgggattgtttgccttggattcccctggcaaattttgtgaggcttttaacttaaaaggggtgccaatttggaaactttaaaaatggaaattacaagcccaattttaaaactttttttaaaaattt

SEQ ID NO: 552481 - DNA, 763 bp, Homo sapiens
  misc_feature (463)..(463): n is a, c, g, or t
gtacacgtatcctgaaaactggagggccttcaaggctctcatcgctgcgtcagtacagcggggctcaggtccgcgtgctctccgcaccaccgccacttccattgttggccaaaccaaccggacccctgaatatctccgcaaatttcctgccggcaaggtccctagcattcgagggtgatgatggattctgtgctgttatgagagcaacgcctagttgtcctactatgtgagcaatgaggagctgcggggaagtactccagaggcagcacgcccaggatggttagcgagtgcgtgtgtaggtgtttgcttgattcctgatagtaggtgcccccatgaccatgataccttgggatgttccgccacccttgggctatctaagtgcactcactagacaaatcagggccagctgaagaatgtgcagagaggtaggaccgctgaggcgaagattctggggcgtggtggnatgcattacgttgaacgacagaaggacttctttctggtggagcgaagcagagtgacagttggttgacatcgacagtagtctgcaccctgttgtggctctatcaagcaggttctacgagccttcctttcccgccaggcctattcccatatacctaaccgtctggttcctcacgctgcaatgaacctagcccctagttccgggctgctgggcgggaagtgcaactgggtgaggagatgggcccgtttgctgctacaagtttgcgagacccgagctgtaagggcccccggggatgggaggtcc

SEQ ID NO: 552482 - DNA, 184 bp, Homo sapiens
accaggcggtcaggtgctgattggtgtccaggaaagatggccaagggtctactggtcctatgggtcctcctggcccagctggccagcctggagatacgggtgaaggtggtgccccctggacttccagtgtatagcttggaccttccttgtgtgccgtcgtgggggtaccggaggcttcgaagtt

SEQ ID NO: 552483 - DNA, 513 bp, Homo sapiens
tgatggtcttctagagagaatgctgattatgccactgctagaaccttcgtaccttggtctgtaccaatctcttaagagatccaggtttctggcatgctcctcgctgctttgagaccatttgtcatgtctttaccgggacaaggctttgattagattgttcacagcagaatgaaggtgaaaactatcaccagagtaactgcaatccatacagaagtcttttacctgtaaatgcctttcccaatggagaatcaacagattgggtgatggtggagtcggtcaggaagactcaggtcttctagaggaaaggatgcctcatcaccccttgggcccaggcagctgctgtcagagaatgacacagcacctgcacagtcgctgtccacttcctgccactgctgtcggtggggtgacgggagcaaagtaggcgtggactttgacatgagggagctgagcccggcatccgcttgatgcctgcacgggtaacctgctgacagtcgtacagctctaggcgctcca

SEQ ID NO: 552484 - DNA, 121 bp, Homo sapiens
gggatgggtgatgatagtcctttgtttctgaccgagtggaggttatttgtggttgtctcttctctctgaatatcgttcagatgtctgcaactttattagccttttaaagtaactgattttg

SEQ ID NO: 552485 - DNA, 160 bp, Homo sapiens
  misc_feature (44)..(44): n is a, c, g, or t
  misc_feature (49)..(49): n is a, c, g, or t
  misc_feature (55)..(55): n is a, c, g, or t
  misc_feature (150)..(150): n is a, c, g, or t
ggcgggctccggcgacaggccagatgggaagctgctgtccaagnacaangcgctnctgagggaaagggagcctctgcatcaccaaatggcaggattttcataatatatgtagtatgagttccacatcttggcctcttaccccagcttcanaagtctcagc

SEQ ID NO: 552486 - DNA, 111 bp, Homo sapiens
ggtctcattcctggacagaaacccatgctgtcgatgctccaacttacaaattatggcatttatgatccagataccgcaatatgagatccgagttctacttacaatgacctg

SEQ ID NO: 552487 - DNA, 848 bp, Homo sapiens
gtatcggaactgtataaaagaataacttctaatagatggttcatagcaaatctggacgaagtaatgggattaaaatatgactgaaaatggtgattatcctctgacatatgtttgagtttcaatgtacttattaaattagttcattagaaagatacgttcaacgtatctattttctgtcggtagctatcaattggttttcggaaattgggaggtcttcagtctgatgattggcccgaggcttggtatgttgcgatgtgtgatgcgatcttgagtgctcgcctgtaaccttccggcctccgctagtcccaagcaaattcgtctcttgctgtgcagcctcaccggagtagctgggactgacaggcgtgtgccacacaggcccggcctgatttttatacttttggttaggggatacgggtttaacaccatgatatgcgccaggttgggtcttgaactcctgacatcaagtgatctgctcggtctggagcctcctcaaagatgctgggatgtacaggcgatgagttagctgaacctggattatcaaacttttattacatattagttctctgttaaaccaaggtttactggaaattgtggaatgagtggagccgaaagaaatttttcattctgatgaaaggagtttacgctctatacatgttattttacactccaggtaatggagtggtgtgttgcttagaattcttgggggagagatatggtatgcaatttcatgaaatttcggttaggggaatatactttattaaatttcaccgacttactgtgagatagtgccctgatgtgttggaatgggataaatcaggaagaattgtcggaacaggtataaaaaggta

SEQ ID NO: 552488 - DNA, 456 bp, Homo sapiens
  misc_feature (2)..(2): n is a, c, g, or t
  misc_feature (190)..(190): n is a, c, g, or t
  misc_feature (382)..(382): n is a, c, g, or t
  misc_feature (411)..(411): n is a, c, g, or t
tncatctggcaattcagagatttcttcttggtttggatccattgctagcaagctagtgtggtctgtgggggtgttacagaacctagtttggtcatattatcagaattacttttctgattccttctcatttgggtagactatggtagtggaaaaatgtggaactagagtgctgctgtggagattctttggnaccatggggaaatcccttgatatggtgcactccctttggtcctaggaatggggcttcctgagagccagactacagtgattgttatcactcttccgggtctagccactgaatggggctaccagactctgggctggtgctggggaatgtcttgcaaagagtcctgtgatgcaatccatactccggtctcccagnccatggataccagcacttagaataatggntacttcactttagaataacgggccccactccatccagggttggtt

SEQ ID NO: 552489 - DNA, 119 bp, Homo sapiens
ctgacggactgcccagctgccagctgtgctgctgagcgcgccggcgtagttgatgacccggtagacgccggtggtcgaatcgatgccggcgcatccgaatgtctgcatcgttgagcgtg

SEQ ID NO: 552490 - DNA, 265 bp, Homo sapiens
tgtctcgacatggtcgaagacattctatacagtattgctctaatgcgtgagaggaaactatgaaacgctttctctccacggcagcgaacgaccaaacgcagcaagcccattccacgcgacaatacgatcaaaaccgctcatcaaacgattcaatacccattgattgttcggcaagagcaataactccatgccatgtgctgacgccatccacagcaactcaaaggaagaaaggaatctctcatagcgtaagccatgtgtgcgcagt

SEQ ID NO: 552491 - DNA, 497 bp, Homo sapiens
  misc_feature (18)..(18): n is a, c, g, or t
aaaaagacaggggagatncttaaagaagatgaatctgggatcacttaaagctacaatagaagacatgcgattcaaggcaaagagaaaaagagtattggagcaccagggacaagttcgactgggaatgatgcgccacctttatgtggtagtagatggatcaagaacaagggaggaccaagatttaaagcctaatagacggacgtgtactttaaagtggtgggaatacttggtagaggaatatttggatcaaaatccggttagtcagatgggaataatggtaactaagagtaaaagagctgaaaaatggacggaactttcaggaaacccaagaaaacatatagcgtcttggaaggaagcggtggatatgaccggccagggagagccatctctttataattccctaagcagggctatgcagactctaaaacacatgccgggacatacaagtcgagaagtactaatcatctttagcagccttacaactggcgatccatcaa

SEQ ID NO: 552492 - DNA, 423 bp, Homo sapiens
cgggcagtctcagcgctgcacaaagaggcagcgatcgagtgcacacgcacaacaaagaaatctgcggtaaacatcacaaagactctctaagcaaatgtatccaataaaaacagaaacaagacagaggcgatgggactaaataactaatgcttcaatgccaagacgcagatgtacatccacaagaaacaacagcaaacaaggaatgaagacctccctaaacagacaaagcaaagaaccagtcagtgaatgacctcagtgggatggcaatatatgaactctctgaccaacaatgcaaaatagcagttctaaggaaactcagtgatctccaggataacacagaaaaaaaattcagaaatttaacaaagagattagaacaattttttttctttggagatggggtctcactctgttgcccaagctgca

SEQ ID NO: 552493 - DNA, 105 bp, Homo sapiens
tgatctctgacctcatgatcaccctacccgtggctccaaacgtgctgacgacttacaggcgtgacgcacgcacccagcatatgtgacgtacatcttaaaaatatt

SEQ ID NO: 552494 - DNA, 238 bp, Homo sapiens
tgtatgagggcgagcgctgtgccggcacggaccccgatggctgtgagttcgccacgcctttgcctgcttcgccgaggcagcctcaggttacatccctgcggaccacctccgggcgctgctcaccaccctgggtgcacgcttcaccgatgaggaagtggccgagatgtaccgggaggcaccccattgataagaaaggccacttcacactacgtggagattcaaccgcaatctcaaacat

SEQ ID NO: 552495 - DNA, 335 bp, Homo sapiens
ccacccaggcgcacttctggcctgggcctgtccccaacaaacgcctaagagagtcctccttaccacacagggtgtgtacattatcagtaaaatgctgtcgatgcagatattgtgacggatgatgacgacctggtcctacgcagagatctgagataccaagacgaggaccgactccacgttcgacgggcgccctgcctggatgcggacactgcacatccaccgcgtccatctcgttgcccctcatcctcccatacgctgagtccacctcaagcgcaccgtcgccaatatcgaggatcctttgttccggttctttgagagagaagtgcgcctgggtg

SEQ ID NO: 552496 - DNA, 126 bp, Homo sapiens
cttaagcactacaggacaagttctagtctttgccactgaataaaactcataggctgtgcctcaaataaaatacaatcaacaaatatagattaatatagtctagtgtagcgctaatgtacagtagct

SEQ ID NO: 552497 - DNA, 682 bp, Homo sapiens
ctagacaaataagcttagtgtttacgtgactgaacagtcatcctgctatggtttcaggtgtgggatttggaccatgaggggctcccgtaggaggatggcggttgtgtttgattctgatttgggatttcagtacatattctccagttcccatagaaggccacttattctttgagaaactggtggttcgatggtgttgcgcgttcgaagtgaagtccgcttgtgcaaagacgaaggacggtgcaattcacagtgtcactttcagctaggcaggaagttgtctccagataccttctggctacttgaaagttactacaatgaattccaccagctgaagtactccaggttttgcaacagggaatgtgttcattatggatcagtaccaaccgagaatggatttatcatttccagaacaaacgactggcaccgaacatgtgtacgttgggaagacttggcagagtgttagtcatgatctgttacttacgtgttcagtctgttgttctcacccccttcgttagttaccatctctttttcaagaagaaaaacgaaaagccacagtattatcaaggtctctacacttggactggggggaaacatttgagattaagcacataactttggaattagttctttgttcaatgttgaatgtggcgccgttatgccgatgattatcaggcgccctggg

SEQ ID NO: 552498 - DNA, 105 bp, Homo sapiens
atgcgcgggatgagctattgacgcttgagtgaggtaaggagtgattagttatcaatgagatggtaagggggtgcatgactcggtcgccacaggagggagtagggt

SEQ ID NO: 552499 - DNA, 596 bp, Homo sapiens
  misc_feature (2)..(2): n is a, c, g, or t
tnagttatattcccttcctgaagaaacgtacagggctgcagtcctcagtggtgggtagagccctttgttaaaaaacaaacttctctagtgggtataatttgggaaattttaaaaaataataacttagtctcatattttacagaactggaactagaaattgtctttgtccagccctttatttcagggataagggaatgaaggtacagaaaggtttagtgatctggtcaaggtcagaagcaaatctaggcctaaagaccaggtttccaagtgcattatccaacctactttactggttaatattccttgtgttttcctgacattgagactgtcatttcttgtttattttggggttttgaacataattttgagagggggggaaaaaggtgtggtttttaggtttctgggttgtattttaaaattttttgtagagacaggtctggctatgtttcccagcctgatctcaaactcctgggctcaagtgatcctcccaccttggcctccaaagtgctgggattacaggcatgagccaccacactaagctggaaacagggtttaaactttttttcccctaagttattttggaccttcagcctcaa

SEQ ID NO: 552500 - DNA, 989 bp, Homo sapiens
gtgtgccactgaagatcgtggtgtcgccatgggccgccgtccctgtccgttgttaccggtattgtaatgaacaagccgtacccaaagtctcgcttctgccgaggtgtgcctggtaagtagtggaagatgcccctgctctggttggctctgcggactccgcagtcgtctgtgacagcccccgtgcatcacttacccaatccttttagatgccaagattcgcatttttgacctggggcggaacaaaggcgaaaagtggatgagtttccgctttgtggccacatggtgtcagatgaatatgatgcagctgtcctctgaaggtaaggcaggattctttgttcgttcaccccccagttcttccttcgcgtgtctgcccgtcaacaccgcgacccatatagcaactgctctggaattgggagttgatgaaagcatgatgccttacaaaattcagtcaacactagtttcccctgagctggagatagtcagtggtgaatgtttctctattatcttctctcacatttgctgcttcgctatctcggcctacctagccctggaggctgtccgaattctgtgcccactaagtacattggtaaacacacgttgtggcaaagagtggcttccatatccgggtgtcggctctcaccccttccacgtcatccgcatcaagcaagatgttgtcctgtgctggggctgacaggctccaaacatggcatgcgaggtgccttttggaaagccccagggcactgtggccaggtttcacattgggcaagttatcatgtccatccgcaccaagcttgcagaacaaggaggcatgttgattgagggcctgacgcatggccaagttcaagtttcctgggcgcagaagggtatgtagtgttgcagcccccttctcccacctttgccccaggctcctgactcaggtcatccattgctcttagatcacatctcaaagacttgggttcaccagttcaatggtgattattgcagactgg

SEQ ID NO: 552501 - DNA, 313 bp, Homo sapiens
gaccaggcagttgccagcgctgatgcagtgcctaggggtctccatttagcagaaatggtcatgacagcgatatcatgcctggaaccaggtagggcattcggggagggcaggtagaaagaaacagtgtgcagcatctctcacatttgcagtttttcatcctattgtggcatatcatgcatttctcaaactattatctgaataaattttcccactcttggcaagggtagatttcagcctccaagttgttctcagtctcccaggaggctgccagccccatcctcgttatttaattcttgagtttttgggggccaac

SEQ ID NO: 552502 - DNA, 310 bp, Homo sapiens
tcacctgtctctccatatcgcatgaggaatgggttcggacccaccatggatacttgaagcaacaacggctcgagtctgttatatacagaggtagtattgcatgtaacttttacatcatctcagattacttataataactaatgcaacgtaaatgccatgtcaaaacttgttatattatgttgtgtacaaaataatgacgaaaaaaactcaatacatgttcagtatagatgcaaccatcctttctctggtcttatccttagatcttgtttaataagattaaagactaaggataagacaaggtagagccgag

SEQ ID NO: 552503 - DNA, 457 bp, Homo sapiens
gcgactctagacgatccctacctaaatggctgtagatcaaagcagcatatctccaggaaacaggaaagccctggatgaaacactgaagaaagcccttacagttcaccttgaggaggtagttttagctcttgtaaaactccagcgcaattgtgtgctgatgaacttcgtgctgccatgaaggggcttggaacctgatgaagatactctaattgggattttggcatccagaactaacaaagaaatcagagacattaacagggtctacagagaggaactgaagagagatctggccaaagacataacctcagacacatctggagattttcggaacgcttggctttctcttgctaagggtgaccgatctgaggactttggtgtgaatgaagacttggctgattcagatgccagggccttgtatgaagcaggagaaaggagaaaggggacagccatttaggta

SEQ ID NO: 552504 - DNA, 584 bp, Homo sapiens
agagcgcccagaatcatacttttaagcataattcattgagcactcaagatgaaaaaatccaccgccatatatgaggtgtttctataggaaatatctatatacttttatagttctaatttcattttacataaactgttttaatcagtttctaataatctatgaagataattcactgtttcttgaggggatgctatccagagggtacatccagctagccttgccttaaaatcatttgctgatcccaccggtgcaaactgatcgcctacgtgtaaggtttcagagggttggataggagattcagggttataaaattgttgcaatgctcgaacaccaagatctttccccccaatatcacaccagacatcactaccaccatcaaaacaactaaattgaattcttctagatggggcaaaagactctaaagtgttttgaagggttaaaactatttcctccagttgttccctatcaagcttaacaggaacttgtcttttagaagcttcatcgtaccgttcgcctgggacgatacccactgccctgactttacggataatagaaatctctgaaggtagttttagtctttttct

SEQ ID NO: 552505 - DNA, 925 bp, Homo sapiens
gtttgagaccagcctggccaacatggtgaaaccccgtctctacaaaaaatacaaaaatagccaggtgtggtggtgtgcacctgtaatcccagctactcggaagtctgaggcaggagaatcacttgaacctgggaggcggaggttgcagtgagtctagactgcaccattgcactccaacctgggagacagagcaagactccatctcaaaaaaaaaaaaacacaaaagaatgcccccttttatgattctgtttctataaaacaggcgggagctaattggtggtattgagaagtacacgacaactatttacctttggacgaacagggaacggagaagctgttcacgaaaagactcatgaactaggggacttctgtggtgctgatctactgttaccatttttttatccctggtccttgtgtttacccacggttgtgttcgatttcggtgacttaccttgtgcgaactatctaccttataatttggtgcttccctgtatgtctttggtacttcaaaacaaacgtttacaattttcacttataactggcagctctatggagtctagcctcccagagtgtttcattacgaacccggaaacgtagttaagctgttggaagagcctcagtgatggatgactggcgcctaaaaccaagagagttgcagaaacatcggaccagcgattgaacttgacctgtttgtactatatctaacactgagtatccattatttaatttaaatgtcacctacttctggtgcactagccacatttcagatgctcatgagccatgaaggctcatggccgccataattgaacaagcaaaactctagtgataagccataatggtgattaactacattttatcatttaatgccttcttcccaatcctgtccaattatttggcgtaccctttaaaattaacccatgtgttg

SEQ ID NO: 552506 - DNA, 625 bp, Homo sapiens
  misc_feature (614)..(614): n is a, c, g, or t
ggggttaaaaaaaaaaaaatttttaaaaaaaaaaaatttaaaaaaaaaaaaaaaagaaaaaaaaaaaaaaaaaaaaaaaaaaaaaaaaaaaaaaaaaaaaaaaaaaaaaaaaaaaaaaaaaaattttaaaaaaaaaaaaaaaaaaaacttggggccccattttgggcccttttggccctttcccccttttggggggggttttcccattccggggcccggtttttaccccgttgggcctgggaaacccctggggttcccccattttaaccccttggggaaaatcccctttttccccgggggggtttttccgaaagggccccccccgttggcctttcccaaaagttggccccccttttggggcaatggaattttgagggcttaatttttttgaaaaattcccgggaaatttttgttaaaaccgctttttttttaccccattgggccaattggggaaaatccttttttatccaaaaaatttccccctattagggttgggggttgtccccctttggcccaagggccccttttataagaacgtggccctccccttaaaggggggaaaaccccttttttgggggcgggcccccttttgggccttccccctttttttgggnctcggggcccc

SEQ ID NO: 552507 - DNA, 119 bp, Homo sapiens
ctaagagtgcatggctactcttgcaagcagtgttccttgtgctagcagtaaatgttgcctaatttggggcatgctggtgtgtctagcagactgttcttgtatagtggaaaggtaactgg

SEQ ID NO: 552508 - DNA, 232 bp, Homo sapiens
tgaagaactattgaatactattttgacagtgagaaatcacaggacttgtcagtgttgagactttttgttcatcattttcaagctgaatggaaagactcagttggtaagggagatactgaagacaaaaaaggacaagagggttctatacaaggtctcaggcattacatggaagacttgagatcctatagccacactgatcatctttttgaaatatactgccctttctggttgt

SEQ ID NO: 552509 - DNA, 263 bp, Homo sapiens
ctcatataacagttcccaccctcacacgattcctttacctattcacttcatcttgcccttcattattgcagccctagacagtcactccacctcctattcttgtcactgaaacgggatctaaacagcccctctggcaatcgcctcccattccgtctaaaatcaccttccaccctctactacactaatcaaagtacgccctcggacttacttctcttccttcatctccttaagtgacattatacacttattctcatccatgacct

SEQ ID NO: 552510 - DNA, 332 bp, Homo sapiens
atgtgcatttctagaattaaaaaaagaaaaaagaaaaaagaaaagaaacttctgagggaaggtgacttacctagtattctatacccagtctggaatgcagtcaggtatgaggatttaatgaagatacattcaaacatggaatatctgaaaaagaatttattttacccttttgaggaatctgctagaagatgaagttcaacagaacaagggactaaatcaagaaacaaaacaaaaactaatctaaaatggaaaagacaagtcctaataggaccaggcctaggcagcaactagaacaaattagaggaggctatgggagaaagatctccaggttt

SEQ ID NO: 552511 - DNA, 156 bp, Homo sapiens
tcacatcatctgtgtagtatagtattatctatcattagatacttatttgtcacaaggcggagaatatattacatgaagatatatttatctcctcactctcaatcacttattgttactcatggctacatttgtcacctgcattgagcaatatttagg

SEQ ID NO: 552512 - DNA, 308 bp, Homo sapiens
ctattaagacgacagaagggtctttacagacgtgattatagattggctgggtgcagtggctcacatctataatcccagcactttgggaggccaaggcgggcggatcacctgaggtcaggagttcgagaccaacctgaccaacatgaagaaaccccgtctctactaaaaatacaaaattagccaggcatggtggtgtgtgcctgtggtcctagctacttgtgagtctgaggcaagaggattgcttgaacccaggagtttggggttgcagtgagctatgatcgcgccactgcactccagcgtgggtgaca

SEQ ID NO: 552513 - DNA, 429 bp, Homo sapiens
atcgcaaggtgttcagttgtgtatctagacgtaatgacctgttcgaataaaggacaggactgattcagatagaatcggtcagtgtctgtgatcgtaagcagatggcaagctcaaagggtccatttaaaggatggttaatctaggctctagtgacagatgtgtgggcaggcatagggaactagcgatggtcagtcactgtgggcatgttggacctaggtagacaacagcgctgagctgagttcagttcctaacgcattgcagtacctgaagctttgggaatggggtctgctccagtgacacatgtatgtagcagcaacacaggcgccctcaatgctgcaagtgggcacagagtgggagtgcgtgaggaacaaatacctcatgatctctctactctacgttcatgtcggcagttggaacagctacgttggc

SEQ ID NO: 552514 - DNA, 124 bp, Homo sapiens
ccacgcgtccgaccttcagcgcctcggctccagcgccatggcgccctccaggaagttcttcgttgggggaaactgcccctgtcccccgccccgcccccctgtcccccctccgccgacccctccc

SEQ ID NO: 552515 - DNA, 471 bp, Homo sapiens
  misc_feature (6)..(6): n is a, c, g, or t
  misc_feature (25)..(25): n is a, c, g, or t
  misc_feature (61)..(61): n is a, c, g, or t
  misc_feature (207)..(207): n is a, c, g, or t
caaaancaagcaatccctgtccccnaccagcttttgcctctgccaaccccagggtgcccantcttaaatttcagagcatcactggtactcacccctggtccctgcagctccctgggccccagagacaggatttcgtgttagcctccctcgtactgtgctggggtgatgataaaactaacaaccccaggctggaacgcagtggctcanacccgaaatcccaacattttgggaggccgaggtgggtggatcaactgaggtcaggagttcgagaccagcctggccaacatggcgaaaccctgtctctactaaaaatacaaaaattagccaggcatggtggtgcatgcctgtagccccagctactcaggaagctgaggcagaaaaatcgcttgaacttcgggaggcagaggttgcagtgagctgagatcgcaccactgcactccagcctgggcgacagagcgagactttgtctca

SEQ ID NO: 552516 - DNA, 465 bp, Homo sapiens
tcgttagatatccaaacccagaagcagtctcatacccggaaaattggcgccacttcatccgtcatctccagaggcagcagattctagctgcttccccagaaggcttggggaccatctccagctgcaatctccagaatctcggaagtcagcccggactacctcccctgagccaaggaagccatccccttcagagtctcctgaaccttggaaagccgttccctgctgtgtacccagagcctaggcccacagcccccgatgtgtaaccaggctcttggaaaccagggacaactgggtcccataggccttgggaaatccaaatccttcagcatcatcaggaccttggaagccagctaaacctgatccatctgtgtctcctggcccttggaaaccaattccttctgtatctcctggaccttggacaacacgatcaatctgtgtcttctgcatactggaaatcatcatcag

SEQ ID NO: 552517 - DNA, 590 bp, Homo sapiens
cacattccagtagcctaggtacaattgccagattcggcagtgtatagttcaattccagttgcagcgatagatcaatcgggggcctcgagggggaagttctgagacgtctctcattttgcataataagtaatattctaccatcccaaagtctgcttttctccttaattgatctttggggagttagacaatacaatcatcattcctgagagctatttggtgctttagacagtttacaaagtgcttccatttacacaattttattcaaataacataatcaccttacaagctagaagggttggaatcatccgtctttcatactgataacaacttcaggttctaggaagttaagccacttgcctaaggccatacaactctaaagggtgaaggagggccttgatttgtcttctgacttcatatccccatgtttgctcgtgccaagttctttggtctgatgttacctctccgccaagttttacggacaaatcgctaacaatataaaggtctcatcgttttaaagtacgcatcagaggagagacatagagaccttcacagaaaaggtatcattagatcagagtggataggtggacata

SEQ ID NO: 552518 - DNA, 202 bp, Homo sapiens
atacgcgttatgagcatttccggtacatgttgtccgtgagggcgtagattgcggggtgattctcatactggtgccgcgccctgatagaggtcgcatctcatcggtcggtgcaattaaggcatctgctttaaggggtttacacgagattatgcacagagcctcatgtacgctgaacgcatgtattacgatctactcacggcgc

SEQ ID NO: 552519 - DNA, 223 bp, Homo sapiens
aggatttaggatgagcccgataggtgttggcagaccaaatggacatttctcttaaaaaaccagtatatatagtctgttcatatgtaaaattcagtggaagagaggtggacagtgctgttattttaaacagaaggttgtattattatgttgtcttgtctttctactattgcttgattaaatttggcatttaaatagtggtggaactattttatataatcgcgat

SEQ ID NO: 552520 - DNA, 290 bp, Homo sapiens
tatcgaccgctaccgtgtgacagtattaggatcatgggcctccccagaagtagctgctcgtcattccctaggcgcaacttggcattctgacatgttctctgggtgtgcttatccaaggtggcaaacatggagcttacgaggctcttaaggctaaccttaaaaatagcacattatttctgacacattctattggttcaagccaatcacaaaggcagccgagctttagggtggggaaatcgactccatgtcttaatggagtgtgtcatgtatttcattctaccaatgccctt

SEQ ID NO: 552521 - DNA, 342 bp, Homo sapiens
  misc_feature (177)..(177): n is a, c, g, or t
  misc_feature (227)..(227): n is a, c, g, or t
  misc_feature (229)..(230): n is a, c, g, or t
  misc_feature (239)..(239): n is a, c, g, or t
ggacttttaaagagcccttcttaacccagcagtaattggaacacatttgggagcagtcctatgttttagtgccctttaaatttttgccttgagccttccaggtcagtgccattggtttagaaccattaaccctgcattgttgttgattgtcacgctggcatttatagataacggctntccagacctgagctttccgggtcagcaagtaggaatcgtttttgctgcanannataaaaggnccacgtgcaatacttaatgccgcatgatttctatcccttttcccaataggggctggctcttttgacaccctttggggtctgtaaaataaatgctgtggctcct

SEQ ID NO: 552522 - DNA, 827 bp, Homo sapiens
  misc_feature (11)..(11): n is a, c, g, or t
ggggtccttcnggcgtcgccggagtgaatgatccgggagttgaagagggctgcaaggtgggaagtgaagtcagtgcctcagttgctgatcagtgtgttttttgtgtccaattcttttatcaccaaaaaagagaacgaaatattgcagtgaatgaagattcctctgcattttagcactgctttttcaactgtagttggcttttgaatgaggatgaccaatggaagagaatgaagaatgaagctgagaccacatccatgggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtgtatgattgaacgaacagagccaggaatgccgagacctatgcgaacaaggcacgagcacttaaaccaaattctcagtaagatcccagattgagatcaatgacagagtgagggtttctgcagaacaatccaggatatagctagtgcaataaagaccttcttgatacagtgaataattgtcttcagagaagagtattgataccagaaccgcaggcacttgaacaccaaaagaaaggatctgttaagtaatccaagaagttcagtgataactctgaaacgggattttaaagatgggaaggcataaatgtgttgggaagtgcgacgattattgattaaccgagtatagtcgaa

SEQ ID NO: 552523 - DNA, 919 bp, Homo sapiens
  misc_feature (11)..(11): n is a, c, g, or t
ggggtccttcnggcgtcgccggagtgaatgatccgggagttgaagagggctgcaaggtgggaagtgaagtcagtgcctcagttgctgctttctcctcgtaagatcttgtgtctactgtgatcttggaacgttgactacaccacgtcattttcgcgcatgacgaatagtccctaggaaagatcagtgtgttttttgtgtccaattcttttatcaccaaaaaagagaacgaaatattgcagtgaatgaagattcctctgcattttagcactgctttttcaactgtagttggcttttgaatgaggatgaccaatggaagagaatgaagaatgaagctgagaccacatccatgggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtgtatgattgaacgaacagagccaggaatgccgagacctatgcgaacaaggcacgagcacttaaaccaaattctcagtaagatcccagattgagatcaatgacagagtgagggtttctgcagaacaatccaggatatagctagtgcaataaagaccttcttgatacagtgaataattgtcttcagagaagagtattgataccagaaccgcaggcacttgaacaccaaaagaaaggatctgttaagtaatccaagaagttcagtgataactctgaaacgggattttaaagatgggaaggcataaatgtgttgggaagtgcgacgattattgattaaccgagtatagtcgaa

SEQ ID NO: 552524 - DNA, 361 bp, Homo sapiens
tcagtgcctaggacgtctatggcacggtgaatctcgagagtactattcgtgcatgtgtcagaaacagaaattcttttggtcttttcctggctctggtgttgccggcagttgtgcagaaatgagtgaccagtcacggttacattcatggcgcaccagagagtcttcagtgagatagtctctccggtatagcccgttaatgtatctctcgagcatgtctctggtacaagcgactatgccggtaacatcctgcttgatactctagatctagatagtccaagtgaggtcaggtctacgcttgcggagcagaccatggtatgcgaatcatgggtcccggtcctcttgggggatcctgctagagtcg

SEQ ID NO: 552525 - DNA, 225 bp, Homo sapiens
acagaaaaataaggtcataattttccctttgcaactataaaatcacaagtctaaatacttttagatattttttacattttagattcagggagtacatgtactcgtgtgttacatgggtattatatgtgtaatagtggagactgggtttctagtgtacccatcatccaaatattgaacattatatgcaataggagattcttcaaccctttttcctgcttccggtcg

SEQ ID NO: 552526 - DNA, 102 bp, Homo sapiens
  misc_feature (97)..(97): n is a, c, g, or t
ttcccatttttgggcactaaggggtaggttccatcttgtccctttcccaacctttatatttggggtccttttttatacaggaaaaccaaacctttgnattta

SEQ ID NO: 552527 - DNA, 899 bp, Homo sapiens
  misc_feature (11)..(11): n is a, c, g, or t
  misc_feature (155)..(155): n is a, c, g, or t
ggggtccttcnggcgtcgccggagtgaatgatccgggagttgaagagggctgcaaggtgggaagtgaagtcagtgcctcagttgctgctttctcctctaaatcttggtctcttgtttggaagtgactaacagcatttggcatgagaaagccctanaaagatcagtgtgttttttgtgtccaattcttttatcaccaaaaaagagaacgaaatattgcagtgaatgaagattcctctgcattttagcactgctttttcaactgtagttggcttttgaatgaggatgaccaatggaagagaatgaagaatgaagctgagaccacatccatgggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtgtatgattgaacgaacagagccaggaatgccgagacctatgcgaacaaggcacgagcacttaaaccaaattctcagtaagatcccagattgagatcaatgacagagtgagggtttctgcagaacaatccaggatatagctagtgcaataaagaccttcttgatacagtgaataattgtcttcagagaagagtattgataccagaaccgcaggcacttgaacaccaaaagaaaggatctgttaagtaatccaagaagttcagtgataactctgaaacgggattttaaagatgggaaggcataaatgtgttgggaagtgcgacgattattgattaaccgagtatagtcgaa

SEQ ID NO: 552528 - DNA, 804 bp, Homo sapiens
tcaagctgtcgtccctatggggctgtgttttccttgtcccggggagtccgcgcctcccacgccggacctggaagagaaaagagcaaagcttgcagaggctgcagagagaagacagaaaagaggctgcatctcggggaatttgagatgttcaagtctgtgcaagaaaagagaaagagaaacaggaaaaagatagaaaaacaaattgctacgatccgggcccccaccgagaaggtggagttaggtggacagtttcataaagcataacatgagtagaagaatctactgtccaataacgtgtttattatcgtgcaagtcaagtgggctgtcatcaatttagattatcgttctcgtttgagtaaatgaagattcagacgttggtaagtagttagttgcccttagagtgcaatgctaaaaaaacgtcgattttcaagcttagagaatggctagacttttcattaaatactgagttttcgctacatttggctcttctgcagttagtgggtgattggcgtatgtttcttagtagttaaagaaatggaactaaatagtgaatatacgatacactgcatgtaaacattctgcatatacctctaagattagaattcgcagtagtcttttgcatcctttataaaagtgatcgtaactacttatatttgtgctgcatcgcgttacatctgttgaattgcactatgaagatgttggatgaaacttatggacttagtgcctttaaactgatcagtcaggcagaatcttgaaaaaatcatgtgaaggggtgatgtgaaggagcactgtagattctcatag

SEQ ID NO: 552529 - DNA, 767 bp, Homo sapiens
  misc_feature (194)..(194): n is a, c, g, or t
ctctcggtgaatgtgacgcccggatgggcgtcccgcgagatgctcctttggtggtttcggaggtagccccgggtccgcccgtaaattcgtgttcctgcttggttcgcaggcacccccgtgtatatcgcggcaagggtgatctcccgtctggccgcgggtgtctcccggggcaaaatattttcttcccccggtgnatttctcgcgcccaccctttcttcggcgctcgcgggtgctaatctctcctcgcactcgcgacgctttcccgctaagatcttctttggtaactagataataagcggttcctcgaccgcgctggaggcgtgtattgtcgtcgccaaacatatcttcggctctcgtgatacatagctgtatctttgaggcaaaacatattatgtggactcatcgcttcgcccgcccgctcgatttttacaagagctcgctctcggtggagatttggtgctctccccctcctgtgagatatatctttcgtggggagacgagcggacgcccccctctcggtgttttatatgctcgcgggaaagaactaaggacgtgtctctggcagacaccttcccgcgcggtgcgtcgtgggacacaacacccagcaagctgtttgtgcaaatgtgcgcccaccacgacgtgtccgccgatctttctgtatatatcgtgtttgtaattatacttttggcgcacatctctcttctcgggcctcgtgggcgccattccacccgcagttattctccaacaaagaaacaaataacaaaaaa

SEQ ID NO: 552530 - DNA, 940 bp, Homo sapiens
tggaaacacagaaggaaattggtgggacccgggggggggggggttacggggaacggaaatttcgccatggtgtctcaaaaaaaaaaacaagggggtacttggaatttctataattattaaaaatggggctcataaaaccttactttttattattagataattgggcataattaattgtggacattcagtttggcccttttaatagagtggataattagcctttaaggttggggtgaattattttacaaattcaattttcctttttttaattctcctttaaaaattaataggaaatttcagtaataggtggtagtagtgggataatccttaaggccatttggattactggaacaggttttgtggtgcattagtgccattggggaacccttggtttccctatattgggcaggggcattctcccaaccgggggtctccattttgggttccagggagtcttctatagaaggtctcctttggtaaccctcatattgggtgtggcccacttatatacagtggtccatccgttggctggtttaccacaggcgaaccctttcaccgttgttaatttaatcctggcacacggtctcaccacaggggcctcgggttgttgggtccacaatacaaaagggatctctggaagatggtctctcttacacagttccaagagggtatcgggtccacatcattaggtggatgtgaccctcatcggtgaatattgtcttctaacataaccattttactaacttatggggtattcccactcccacttcccatggttttgtgcatggctatttttcatgaccggatattcttcaatatggtctattcttacagttggggtggggtacatggcctggggaacactcatcttagcgggggggacactccgcgtggttgaacctgtggcttcacaagcttatggatacaccggcacaaacac

SEQ ID NO: 552531 - DNA, 944 bp, Homo sapiens
ggtggttgctgtccgcggagtgaaagcgcgtggtttgtttgtgtccctggccatgggctgcagtctcctgggagcagtgaatcaccctggcgggaggcgaaatatcgggggcgagttctctctcagtcgggaatcaacgagcatgtttatatcggggggtggaatacatccaattttgaaacttttaccttccgaagtgcaggaaatagggactccacttgtgtttgtaaattaaggtggttctgtgaggcttcattaaaaatacctaaaataagtgtgggtgggacaacccacgttggaaagcatgtggtttattaccaaggtgtcgcagttcaagaaaacgtggtttgtaggttatcctcaaaacttctgtgacaggtgggtggagcgtcctggaaaaggatgggcaggttggatattggaggtgtgacaaagagtggcaaaatgatgaaggttgaaccccagagaaaatgtctcagaaaagctatcacaggaatgaaatcggtcgaaggtgatcagacagatcagcggtaagggtggacatttctgccaagtgtgggaaaagtttctggtccatgagggatcgggttgatttataacaggaaaaggattggggttggtaccctggaacaaaattagggaaagaactgcgaggaacaagaagtttgaatcaacccaaattcgttgacgaagaaggtcacgacattacggttaattttaatttattaagaatcccacagaaaatgtaaatgaggcgttgtgtggcttacaaaaatttccgtgtacatgactgtgtgttgcacttgagcaccatcattggtatttggaatttggaaaagtgggttttcgaaaacagcgggatcacatggtggaactgataagagaggtggattttaagcgggaaccaacataagagcttagtagggtggcaatgacattaggga

SEQ ID NO: 552532 - DNA, 812 bp, Homo sapiens
gcttgttcgcgcaacgggtttgtcggcagtaacgacaggtgtcgtgaaagatagccctaaaatgcgaaaatgggtataggagaagactcatatcaaccatttgtctgtctattggggactaatgttagattccggggcaaagtctctaatcttactacttgtgcccatctggatctaattaaacattgcgcgtggcactcgggaataagagaaccaagtctgcatatccatttgtccgagaccgagagcgctttgcattgcacgcatttgggtaacaggcggctcacttactagctatcggccacgtggtccttgggagtcaagactgaaaggggctggatgcgtgaacggtcgccttagtcagcgcatttgattatctctcttcgtcgcatacatgtgtggatgaccatgcaaagggtacccgtagtaggtgatctgtagtcatttggattgcccccctattgggagcaaccatgatgatctctctattccaaatatagaccacttgaatttaacaaggggggacaatcttccaatgagctagacctttgttgccctttgtccccttagactcctgagtataggcctagcctgtgtggtggttggcgctggacatttcttcgatcatcgctaggggtaatatctccccaaaggaaacttgggtgtctaggaaccaccggaggaagcgattgccccatatctttgggggttttagcacaatctgggcgtttgttggcaataggaaaccttagatttggtccaggttgttttaaaccaccaagattcgggcatttcccaaggttgatgtccaa

SEQ ID NO: 552533 - DNA, 361 bp, Homo sapiens
  misc_feature (38)..(38): n is a, c, g, or t
  misc_feature (280)..(280): n is a, c, g, or t
  misc_feature (282)..(282): n is a, c, g, or t
  misc_feature (350)..(350): n is a, c, g, or t
tttttttttgagaaggaattttactcttgttgcccagnctggagtacagtggcaagacctcggcttactgcaacctccgcctcctaggttcaagcaattctcctgcctcagcctcccaagtagctgggattacaggcatgtgccaccacgcctggctaatctttgtatttttagtagagatagggtttttctatgttgatcaggctggtcttgaactcccagcctcaggtgatccacccaccttggcctcccaaagtgctaggattacaggcgtgacacntngcgcccagacaaagcagataattctttaaaccactccccctgggtaggaatatgtatttaataaaatnaggccgatttt

SEQ ID NO: 552534 - DNA, 406 bp, Homo sapiens
aagccccggggggccaaaattagaacccggttttttgccccaattttgggtcccgggggccggggccggtttaattatttacgcctttgtagcgccttaaaaaatttaccccggggggaattcccctttcccagggggcaaatttgggccccttaggggggggggttcccccccggggttttttaaaaccctttaaaaaggtggccccccccccgaaaaggccccccccgggggttttccccgaaaaaaaggtatgggcttttttggagatgggggttttttgacccccgggggcccccggcttggacttttcgggcccagttttgggccgagggttaggtttggtttttttctttgttttttggttttttgcccttttaaaaaattaccttgttttgccaaatta

SEQ ID NO: 552535 - DNA, 299 bp, Homo sapiens
ctgttctcgtacctgaatgttgtaccatctttgggtaggcagacttccctgacgacatcagtgatacccaaagctgagcagagcgtggtttacaaagactttatttattttactgtctttgaaggaaacgttcgcaacgtttcctggaagtctcggtatgagttatttaatgctctacagccctttgtgtttgtccaactttggaagccagttagtttcatcctagagtttcagacagtaggcattccccgtggtaccaaacacaaagggtgggaacgaattgagaaaacattctttca

SEQ ID NO: 552536 - DNA, 591 bp, Homo sapiens
ggcagctacggcggcggcagcggcggcgcggttgcgattcccgagccgttgagacgctctctgcggcagctggtggcgcaggtggcttgcgtggacgcgggtagaggcgaccggccagcaatttgcagcgtcggcgcccgcggcccggcagcaggcgcgtcgggacgccccgaggcatcctcccccgtccgcgggcccggtagctgggcccgcgtcagctgaccagattcccagcgccgacgtatctcctcgccgcctccgggcttcggaacccggtctcgccccgaaacatgactcgcgatttcaaacctggagacctcatcttcgccaagatgaaaggttatcacccattggccagctcgagtagacggaagttcctgatggagctgttaaagcccacccagaaaagaaactaccgcatttgacttatgatgggaacctcatgagactgctttcttaggaccaaaggatatattgtcctttactcagaaaaataacggacaagtatggcaaacccgaaatcacgagagacaggtttttcacttgaacggtttatggggcacaatcgaataacaactccaagaagtggaa

SEQ ID NO: 552537 - DNA, 148 bp, Homo sapiens
tacgaagggcactctgggggtgtgacttgccgtctgcaaacctggtgccgttgtaaaaggggtccccctgtatcgccacaactctcactttgttgacaactctgaagtcatcctgccagtccccgcgttcaatgtcaccaacggtggt

SEQ ID NO: 552538 - DNA, 216 bp, Homo sapiens
caggtggatcacctgaagtcaggcgttcaagaccagcctggccaacatggtgaaaccctgtctctactaaaaatacaacgtggtggcacatgcctgtaatcccagctacttgggaggctgaggcaggagaattgcttgaaccagggaggtggaggttgcagtgagcccagatcgcatcctaggcggcagagcatgactccatctcaaaatagtttc

SEQ ID NO: 552539 - DNA, 169 bp, Homo sapiens
ctaaccaaagcttgtatttggaaatttcctttttggccaaattgaattatataatgcttaaaatactttgtccctttataagcaaaatgcataggacttaatttgtttatcctgtaaagtatatgttaaatgcttttatccctttgagaataaaaagttactaatgcta

SEQ ID NO: 552540 - DNA, 518 bp, Homo sapiens
  misc_feature (246)..(246): n is a, c, g, or t
  misc_feature (403)..(403): n is a, c, g, or t
gccttgattctctgcgacgggctcttgtggccaccgttcccttttttcgggggtgggagggtgctatttcccggggccgtgaacccccacgggtgaagacgcacctcttttttcccctgccggggggggcatttaaagggtttcgggggggttttcggccctttttccctgccccattcctcgggtggggattaaaggggggggcccagggggggttaaaccgggaaacccccggggggccctcangggggggtcccccccggggtttttttttttttgggaaggccttttaacaccgggcccccaggtttgccccttttccctgggggggtgggttttaaaaaattttgggggggtttcccttggggtcccccggggtttttccccccccctcccctttttntagggtgggaggccccgggggccccttggggttgtttggggttccccccccgcccctgggtggtttggccctttttttgggtttggggtttttaaatttcctttggggtttttta

SEQ ID NO: 552541 - DNA, 115 bp, Homo sapiens
  misc_feature (64)..(64): n is a, c, g, or t
  misc_feature (69)..(69): n is a, c, g, or t
aggaacaacatatgacgcactcctcccctgaactctacacaacaaattttgtcaccaggaaccntactnttggactccttgttcttaatgaattcgaacgggatacccccgattc

SEQ ID NO: 552542 - DNA, 181 bp, Homo sapiens
cttcattcatggcccccacaattcttaggcctaccggcggcagtacggatcatcctatttccccctctatggatccccacctccaattatctcatcaccaacggattatttcccacccaacaaggactaattcaaactaccctcaaaacaattgtatagccatacacaacattaatggtgc

SEQ ID NO: 552543 - DNA, 383 bp, Homo sapiens
tatgaataatacatagaagaaatgaaggcacaaggagggactgtactgcctacagaacctcagtcagaggagcaactatccaaggtatggtagactgggtgtagtgtatatatcgctaagttgaaaaaacctacgaataacagcagatcttcaccaatcacaaacatataggatagctaaaatagatacagcactaaataattgtaaatgaaaaaataaataaaaaaaaagctatgattgaatctggactgaatgccacacacagggcaaatgaaacatttacacaaaacatggatatgaaatgccaattgagaccgtggacttccagtggttaaaaaaaggctaccaggaagaaataggtaccgaagtagatggcatttaga

SEQ ID NO: 552544 - DNA, 708 bp, Homo sapiens
ggacccgccaacatgggccgtgttcgcaccaaaatccgtgaatgaaggctggccgggtcatcatagataaagtatctacacgcgcctgggcaacgacttccacacgaatcaatgcgcgtgtgcgaggagatcgccattatccccatgacaaataagtctccgcaacagagatagcaggttatgtcacgcatctgatgaagtcgaattcagagaggcccagtaatgaggtatctccatcaaggctgcaggaggaggagagagaaaggagagacaataatgttccctgaggtctcagtccttggatcaggagattattgacacgtagttcctgatcactaatggataatgcgtgaagcttcaggatcattcggtcacgtctgtccagacccttcaggggtcacgtcagacactcagcagatatcggggatcgtagactttgcacaaactgcccttcgggggaacccttgatttgggaacttcggcctactcggttagtcgcatggtactatactcattgtcaaagtcaataactccctgcgtgaacaaaatctaatcgaatacgtatcaaaaaacactcctaaagcttactaagcagtgacacatagtacataagcaagcagtcggagatgatccgaacctgttagagggcgcgcaaggggcataaccgatagtgccagcaagcaaatgcgtggggcacccgggggtcta

SEQ ID NO: 552545 - DNA, 310 bp, Homo sapiens
taggtgaaccacgaggacattacaccaagtgaaataagacagtcacaaaaatattgtatgattccacttacataaggtacataggatagtcaaattcatcgagacagaaagtagaacagtggttgccagaggctggagggagaggagaatgtggagttgtttaatgggtatagagtttcagttttgtaagatgaaaagaattctggagatgggttgcacaacaatgtaaatgcacttaatgctactaaactgtatactaaaatgttcaagatgagccaggcaaggtgggtgcctcacgcctgtaatccca

SEQ ID NO: 552546 - DNA, 366 bp, Homo sapiens
gcatccctcggtttctaaaaacgcaccacaacgtcaactgatgagtcatgggtcacactccaagttcttatgtaccaaagaaatcagggcactaaagtcttacacaccaattttaaagcattgctcaataagctctggttccaaacccaagcagttcttctcatcacggtcacaccagcatgcaccagtttttcaaacaaggctgtgcacaacaacttccaaaatcaaaacttgcaaattcccagacacagcagtgcatacaattcatttcactcatattttccagcactccatacatacactggtcagtggtttttgttctttcattcaatttgagcaccatcaccaaaccatcaaagccactgt

SEQ ID NO: 552547 - DNA, 570 bp, Homo sapiens
  misc_feature (24)..(24): n is a, c, g, or t
  misc_feature (136)..(136): n is a, c, g, or t
  misc_feature (175)..(175): n is a, c, g, or t
acagtctctagtgcgcgctcgttntattggttttaaccctagccccgccccccttgcgcccccgaacccaaggggttgtgggggtctcttgtatggtttattttgcgggcgcccagggccccaaggggtttctctntcttctcccccgggggggccggccccccccttttttccnataaaggcccctttgggggcgggcgggggcatggggaacacccccccccctttcccccccttgttttttgggggcccccgggtcccgttggttttagccccccccccccgggggggtaaagtttccccccggggccccggcactttaaatttggtccccttttaggtttttggggcccccggggttttcccttttttgtccggggggggggcccccccgggggtgccaacccccccccccgggggttttggggtgggttgggccccctttcccgggggggcctcccccggggggcccctttaaaagttaataattgggggggttttgggggggcccgggtttccctttttgggtttttttggggtttttttaaagcctttttttttggcccccca

SEQ ID NO: 552548 - DNA, 225 bp, Homo sapiens
  misc_feature (68)..(68): n is a, c, g, or t
  misc_feature (214)..(214): n is a, c, g, or t
attgctaagtctagtatttagctaacatattatcccaacttactttcaagtgccctttagtcacttantactgatttcctaggttgacatacgtttctatcagatgatatatatccttagtatgaaagctgatactcatgaattctagttgcttagtgcctttatgtttcgtttattcactaaagtagctgacaccaaacacaccataccctanagcggtgaaag

SEQ ID NO: 552549 - DNA, 818 bp, Homo sapiens
ggtgagttggctgccggtgagttgggtgccggtggagtcgtgtaggtcctcagaatccccgcgtagccgctgctcctcctaccctcgccatgtttcttacccggtctgaggtagcgatcaggggtcgtgaatactttttctcccgaaagcgaagattatttcaagtggacatatgccatatgaggctatcaagcttggttctacagtccagttgggatccagacatcaggagggtgtgtgcctatgctgtggatgaagagaattatcttccccagctgagtgtgagcccagctagcattgagaaaaaattgtagagattgatgcatcacataggttgtgccatgagtgggctaattgcgtgactgctaagagctttaattgataaagccagagtggatgacacagaagccactggttcacctacaatgaggacaatgacagtggagagtgtgacccaagctgtgtccaatctggctttgcagttcggagaagaagatgccgatccaggtgccgtgtctcgtcccttgggagtagcattattcatttggaggagttgatgagaaaggaccccaggctgtttcatatggggccctgtctggggaccttcgtacaagtgtgatgctcgaagcactgggtctgcttcagagggtgcccagagctccttgcatgaggtctttccacaagtctagtggctttgaaagaagccatcacgtttcactcatcattctcaaccagtatggaggcaaattgttgcccctttggctgccccggcagcggcaggttccctttccagccgattcgaggtcaggattggacgc

SEQ ID NO: 552550 - DNA, 591 bp, Homo sapiens
ttctatatgaattggcataaatctaagaagaaggcctttaccatgtactgcgaagaatagtggcaggatgagcgatggcaagaagcagctggagaaggacttcagcagacatgacgaagtactgccaatgtcattccgtgtctattgctccatcacccatggatgcgcctgacttcctctgcgccacgaagataggcccacctgatggagtatccaggtgaactggaggtcactgtggccgtagaagctggactgggcccgcgagaggcttgcagcacgtcgagtgtacctgtggaaccaatggtgttctgggcagcgatgagatgagtctgactgtctatcggtggtgaccaatgggctacacatggctacaaaggggtcaccagtcgttggctcaccaatgaagctgccccgcgtagaccctagccggatggcctgcgctaaggtggcctgtattggggcatgtgctatcctgctcgtgtagccttctctgtggcacgcgcttgggcagaaaggctaccatcaccgcaactgagcatcaacaatgaagatttataagtattggcctaggtcgtaccttatcatcggtaa

SEQ ID NO: 552551 - DNA, 300 bp, Homo sapiens
aagaagcccttgggccaagatgctaaatgggaatgcaaagcttgagctgctttgcaagagaaaataagcaggccagaggatttgctttggccaaagatggaagagccgggaacaaaaaagtgtggggaaaagataggaaccaccaggatggcaggggcaaagggctcaagggttaggaggccagtgggcccccccagagttggggagataaaggacccttggttgctttggtggcccgtaagctccttgtctgtttccagcccccagattttcattaaagctttttttttgtccccccca

SEQ ID NO: 552552 - DNA, 358 bp, Homo sapiens
cgggcggattgcctgaggtcaagagtttgagaccagcctgactaacatggtgaaacgctgtctctactgaaaatacggcaattagtcgggcgtggtggtacgcgtagtcccagctacttgggaggctgaggcagaagaattgcttgaacctgggagacggaggttgcagtgagccaagatctcaccactgcactatagcctgggcgacagagcaagactccctccccaaaaaaaaggaaataaaaaaaaaagaaaaagacttgagatgtttaccatgcataatctccagtgtacctctagatcaagctcgtctaccacttgtggcccaggatggttttgattgcgtccgtggggatcc

SEQ ID NO: 552553 - DNA, 830 bp, Homo sapiens
gggaagtttatttgctgtgaattgtcagatctagcaggcacagtagatacccattacatgagacatttgggaattatctccagcagatttgaaaagcacaagtaagttacacagcaagagccctcatctccacgtcacctaattcagttgaccaaatgcttctctctcaggccacactgatgatactgactatggtatacctatggtacatcactcacggtagagacgttccctacgaacttgggccttgctcatgaatgagttggctcaagctaaaactgcattgatgccttactacagctccacttaggtatagccctaaagaacagtgctaagggaaaatcctagtgggccaagctttgagcactatacttggtcattcacttcttattgagagagaagtagccttaagtagagatacacatggattcttgggccgtggcacatatgactcattggtcaggtacttaacttggaaagggcccaattcgatcagcgacaaggaaatctgggaaatgtcatccaccattgacttataaggtgtggctcttcacatatcacttcttatgcttaccagagagcatccactaccgaagagaaatcagccaccagatgtatagggtgatattggcctgaggtgcagccaccttgtcttgtgaccctaatgctgggccataggtatctacaaaaaatttgatgggatggtggacgcaatgcccacatatgggctttccggtatctgaaccaggcgaacacttgctgtactagccctcatgaaccacacagaatatggaacacatacaactttgtggcataactctaccgaccgc

SEQ ID NO: 552554 - DNA, 105 bp, Homo sapiens
acatggcgaagcggcccctgcccgggcacctcctctggaccgcccctgcacgccttgggacctacttcgcagccgggccccctcctcccaacaacccccagaggt

SEQ ID NO: 552555 - DNA, 1366 bp, Homo sapiens
ggggcagactctgcatatcatggggagatagacgctgctgcctttgaattggccttggtcctcacagctccaaaagagaaacaggatctcaattaaccgtctatgatctgagagtccaaagctcggcagattatgaaccagtttggcccctcagaaccgtaagtcaacctactccgatattctcatctgataaaaattcggaaccagtcacagcatgctccttcctactaaggtctccatggaccagagtagctactgcagctggtaaagatatcaggcactcctgtgggcagtgaggtcgtctaagccctgaaaacaaatcaggtatagagcaatgaacgaacattacacggacttaggtaacggatgaacgtggactcctacgtgaggtcagtacggactgcacaggaatgtgtgcagggacgagtgtctggactcgtcagaatttgtcgtgactgactttttactcggatgagtgtcggttgcacgagcaggcacttgttcagtcattgacggcggggacattcagcacaaggtgcttaatcacctcatggtagggttgaatacgtagtgtccagcatagctttgtaagaagctgcctaaggttgtgaacgtggtgggatcgccaggaatttcggctctgtaagaaaatccgaacccttactaaataagcttagcagctctagagtgcttctacaagaaacacgaagacatgggcttttggatcccgtgtatgaaatggacgcaatgaagataaaggatcacgggaacaagggtcccgggacaatgtggaccagcaacttgtccttttggagattaacttttgaacgcttggagggaactccaaggccctttcttgccgatcccttggggattctttttattaattagagacttcgctttataccagagtaacgccggtagttattggggtaatacaaatcaagggtgggcaaggcacattagtcataattgactggacgggaagaagcgaatcatggcgcccaaaagaatatacgaaggcgctccacttaacccccaaagatttacggggtaccccgttttacccggtgcccgagactcccaaagagagggaggcaacagggaagctctccccaaaacagaaaaggaaacttgacaagtgcgaaggaccaaacacacattgaggctgacagctcaccacactggggacaaaacgccaataatcgagcacaatatgagggggaaagcacagcgacatcaacacggacttgggaaaacggggatctactgacacgacaccaccatacccatttccgcggagccatagaacaggtccagtggaccattagaagtaacacagcaacgagggcgtggcgcacagaag

SEQ ID NO: 552556 - DNA, 222 bp, Homo sapiens
gactggtcctcagcattgctcttctgggtttaaccacccggtggagctactggtctctgggctgatactgggtgagtgtctgccaagagctcctgtgatgtgatctgtcttcaggtttctcagccatggattctaccacctgctctggtagaagcagcaggggagtaaagtggacttagtgagggtcgtaggttgcagtactgtttagtgcactgggtgttt

SEQ ID NO: 552557 - DNA, 221 bp, Homo sapiens
tctagacggatcccccctgtcagtcgctctgggacatctggtctcttcgggtcaatatttctttttaagttccaggtatacatgcaggaggtgcagctttataacatagataaaggtgtgtcaggggggttggctgcacctatcaacccattacctaagtattacactcggtgtgcattagctatttgtcctgatactctccccaagagcgcacggacggg

SEQ ID NO: 552558 - DNA, 104 bp, Homo sapiens
tatcttatgactgcagatacatcactgacacagtctgcatatatggtattgaacataactgatcatatgactatctgctatatacacagatactgcgccgtaga

SEQ ID NO: 552559 - DNA, 130 bp, Homo sapiens
aatgagctggtccctatttgctgattgaagaatatgcaatgcgcgattttaggcctgtcgtcgtaggcagatggcagcttgcttataattatgccctcatagggatagtacaaggcaaggggtagcgcta

SEQ ID NO: 552560 - DNA, 239 bp, Homo sapiens
cggcgctgaccactacttagacgacgcgctcgtcgctgcgctggctgggatcgtccgaggccagcttgcgggcgccgaagacggcggcgcggcgcaggaccttgccgacataggtcttgtccggatcgccctcgggctggatctcaacttcctgaccgatggagacattcgggatgtcggcctcgacgatttcggcgcgggcgatgcgctgggtgttgggctcgaggtcgaacatggcg

SEQ ID NO: 552561 - DNA, 924 bp, Homo sapiens
  misc_feature (415)..(415): n is a, c, g, or t
ggagcttgcaggtctggaagttgctctgggtgaggcagtgattgtttagtgaatgtgagggccgaggacattattgcactcttctgtaaactttgtaaacactgtggtaccttaagctgcccatgtattttaaaatttccttttttttttttttttttttgggagacaattgagggctcctctgttggctcccccagaggctggggaagtgcgcgggggctttgtctccccgggctctcaaatgtgaagaccctttgaaccctccggggggtctcagaggtggtatccttcccgatttcagcctttttggagagttgctgtggggccttcccaggtgtgtcttttcccccacaacccaagattaatttttaaatttcttctaaaaaagggtggtttcccatttcatacccggcgntataattttcagaaaatcttatattttttttttggggtaaacacaagcgtgcgcctccctatatgttttcgcccagggggtggggggtagagacacctccgggggggccctcacgagagagtgctcaaacaccacctttaggcctttggagaaatataggggggagaatacaacggcgccaatatttttatacatagtgtttctaaaaagtctgcacataatttttttatcccccccaggtggtgtttggcgccttattcaaacaggtcggtaattctcttccaatatgtgaaagtaccccttaggggtttaaacatattatacactttatccctttaatgagaccctgttaacattgaaccctttttgggaaacccttgggtggataacacatttcggtttaaatattacacaatttctttgggtcaagggtgtgcgacaataattgttgggataaatttcccattttaaaaaaacggtcttccatttttaaaacttatttttttctc

SEQ ID NO: 552562 - DNA, 1329 bp, Homo sapiens
  misc_feature (346)..(346): n is a, c, g, or t
  misc_feature (361)..(361): n is a, c, g, or t
  misc_feature (383)..(383): n is a, c, g, or t
  misc_feature (618)..(618): n is a, c, g, or t
ggggaggatcatctgcttgtgctccctgacagttgggctagcaacactggaggtactactcaactggcccgcgcgccgaggacattgcgtgtactccgaggaagttttcgtgacaaactcatggactagtggagtccaccgacgtaatagggagacgatgcatcactgtccctagccatcgcgtgcatgcacttgcgtcgtggatcacctctcagctgtgctcactcattttgcagtgtggagggccaatgtatgtgggacatgcgcatttccgtctgatgtggacacctttgcagctctcaaatgccgtcgttatgcgagccgtgacggtgttaacttcaaatgncctgagatgacattnatacgctgtgcgttgggccgtntcaggtagcttcactgcacaggttgacttctacttgtgtgtcctatccctacaggagaaatcgtggagcgtcgacagggtcctcttgtgtggaacgtagttgtcgtgggagtacgccttgggagacctgcctggtcgcagtcgattccggaggtggttgttcacattggcggaggcaccttgggacacctaccaagggccccttcctggtggcgcccgagtgcttaatggtttgngcgggttggaaccccgggtgggttccacaactctaataccacgttgctcccctattctccgaggttggggttgatgagcccccccgtgggagggccgaaaccacgccgtggtgctaaactgccaatgcgcccttgttggaggcccaaaatttccggcgatttcccggggttcccgtgaggggctggaaacttcctccatttccaaaagtttgcccggaacctcaccaaaaggagggtttggagtgctctccaggagggccgcccttggagggaaatccgtttccgcaacagttcccacatttggcgcctggcaacaaatccaaaactgggaaaagccacattgggaattagtaagggctccccccgttggaacctcttgggcctttggtaagggcccaatttacggagttcgcccttttttccccagtttccaccaaccgggaggacgccaaccttttgggccctttggacactcacaagtataggcccccgatttatccaggattttggccagtttagtgcctccgggcggttatttcacatgttggccgcccaccccccggttggaactggcaaaggagttccaccgccaacaaagaaccatttatttcccctcatttggagtgccctccccaaattgtccagaaaagaagctcccctgggggccaatataatccccggaaaagggagggcggatatgggcgcaacaaa

SEQ ID NO: 552563 - DNA, 105 bp, Homo sapiens
tatcatcattcatcattttataactttcctatcaaacaagtcctttaattatccattctctcaaaagctttaaaagctagtctgctgctgcctcctactgatcta

SEQ ID NO: 552564 - DNA, 501 bp, Homo sapiens
tcactggttcccagggaagccatgcaagggatcgggttaccgttgtattcggatgaaccataaaatggatcctctgattgacagggcagcacagcggattggactgagcagtcaggagctgtgcaggcttctcccaagtgaactcgacactctgggttgacccctatgaagtgtcctacagaattggaggggatggggccatcggggtgctgtaggaggcctcaccagcgggggggtggcactcaaaacagcaccgacgtgcaaatggtagacagccgaaggagctgtggggaggaacttctcttgggcagaacgagccgttcctaagagtacaatatgatgactgtatcaggttaagagatagtctgtggatggatcatctgatgatggtggataaatttgattgttgctttgggtgggctcctcttggggatggattatggaatgtaaaccatgtcacagctgtgaagatctggcacaagatagaatggtaaaaaaaaa

SEQ ID NO: 552565 - DNA, 795 bp, Homo sapiens
  misc_feature (172)..(172): n is a, c, g, or t
gtaacagattgcatgtatgcagaaaaaagccaacgttgtggatagtcattcaaaaataaccaaatgaattaaaatgttttctgaaaactttaagatggacatttcaaagaaaccatatgttttttcacttattatactcaatagaagcctgcatatttcataagacttttgngctattacattaattgtaatattatctaagtagaaattaaaatattttagttaaataaaaaatctaaagacggtattagatcaggaaaaaaatggggaatgggccaacacatcttaagcacataaaacaatttaataattagctgctatttatgattacagtaatcgatcatctcaaatagtttaatactttaaattatctattttgaggtaaatcaaaataactgccaattccaaattgtttaacagccagaaatggcacagatagcaacttgtgaatctattaataatttttcatctaaatgggtttggccaactgtggcctgaaagctaagaatcatttttacatttttaaatgattaaccggacacaacaatcaaatgcgggaactgttgatcaagggggtacaaagttttagttcttcaggatgattaagctcccagagactttaatgcaaagcctgctaacttgttgttaatagggactgtctgaatacttaaatttactaagaggggggttcaaagtgttctccccaccaagagaaagaagttgaaaaacaatgggtactgcaaggaatggatgttacacagtggggtttttcacacctccggccgactttgtcta

SEQ ID NO: 552566 - DNA, 353 bp, Homo sapiens
ccaatttaaaaaggttttgtaccaaaagattccatgtgtataacgttcttgaagtgacataattatagagatggagaacagattagtggtggctgtgttaaggagggggtgaggatgggagagaattgggcgtggctgtgagaaacatgagggatcctggtgatgatgggaatggtctatatcgcagctatcgatgtcagtatcccagttgtgatattgtgctatagttttgcaagatgttgccactgggggaaattgggtgaagggcacatggaatctctgtattatttcgactgcatgtaagtctacaattatctgagaataaaaatgaaagttggaaaagcacagaaaaa

SEQ ID NO: 552567 - DNA, 169 bp, Homo sapiens
gaacctggcccggatctgacaccccgtatctgcggaggagagtactcagaggctccaatatatatgcatctgcgggttcacggaaaagccagaacctgctgttttcagtggtggtgtgatcgtaaatatagtgtgtacataataaagcacatatattttacttctctag

SEQ ID NO: 552568 - DNA, 236 bp, Homo sapiens
attcccgtttgtgtcaaattaatgccgcaggctccactccttggagctggacgctcttgtgccggccgctatgggacagagtcgttacctgctcggggccgtgaacgctcagccaaaaggccttctcggccacgcgtataagattggtggctcgacagaggtactcgcccccgtcccgctccgacacattggccaggccgaggcccagatcggccctcacactctcactgacaacg

SEQ ID NO: 552569 - DNA, 299 bp, Homo sapiens
gggccatttaacctggatgccccccttttatggggataatgatgcttcccatggttaatgttttggaaaagctttttatttatagccttgtttactcagtcaagttccccatggccgtaatccttttaagggaaaccctaaagttgttgtagtttccccttcagtcagaaactgatgtttcagctaggcccagtgggacatgcctgtaatcccagctacttgggagggtgaggtgggaggatccctttaactccggagttttagagcagtcagggccacccagcgaggccctgtttcca

SEQ ID NO: 552570 - DNA, 526 bp, Homo sapiens
cacgcgtcgaaggaaaaaaatagcttgctgtcctataatatgaacaaaacacaaattaacatctcaatcaactaacctgcctattcaggtttatttattatccaatttcccaactagattataagctccctaaggatggagatcctggggttattctagtgcctggcataatgccaggtacctattaggtatcagtaaatatgtgtcaactgatagtttatcctcctctctgccactcttggaatagaattaggaatctacagtctcttccagcagattttctccttctcacatttcctgctttaaaagcaaatagcggcccgtcgcagtggctcacgcctgtaatcccagcactttgggaggctgaggcaggcagatcacgaggtcaggagatagagaccatcctggctaacacggtgaaaccctgtccctactgaaaaacaaaaatacaaaaaaattagccgggcgtggtggcgcacgcctgtggtcacagctgttcgggaggctgaggcaggagaatggcgtg

SEQ ID NO: 552571 - DNA, 477 bp, Homo sapiens
  misc_feature (142)..(142): n is a, c, g, or t
gtcaaagtaagctgggaatacaaaaatgggcgtgcgtctaaaatcccagctactcaggaggcaggagaatcacttgagcctaggagacagaggttgcagtgagccaagatcgtgccactgcactcccgattacagtcctcanttgccctgggcaatagagcaagccccgtctcaaaaaaaaaaaaaatacaaagtaggccgggagcgcgtgtcacgcctgtaactccagcactttgggaggtcgaggcgggaggatcacgaggtcaggagatcaagaccatcctggctaacacggtgaaaccccgtctctactaaaaatacaaaaaattagctgggtgcggtggtgggcgcctgtagttccagctacttgggaggctgaggcgggagcatggcatgaacccaggagatggagcttgcagtgagccgagattgcgccactgcactccagcctgggtgacagtgcgagactccgtctca

SEQ ID NO: 552572 - DNA, 378 bp, Homo sapiens
agtgattttatctaatacagttccaaggtagaaaaagtggagcaggcagggccttgcacccctctccacccccccatggggggggtggtggtagcggcacatacacaatcatagtaaatggcagaagaaaacccaattaatttcctggttaattgggcccttcccaaaaagtttccccttttggccgggcccgggtgcctcacccttgttattccaacccttttggaaggggaggcggggtggatcacttgcggtcaggagttcgagaccagcctggccaacgtggtgaaatcccgtttctactgaaaatacaaaaattagctgggcatggtggcgtgcctgtattcacagctacttgggagtctgagacaggaaaat

SEQ ID NO: 552573 - DNA, 640 bp, Homo sapiens
  misc_feature (450)..(450): n is a, c, g, or t
  misc_feature (491)..(491): n is a, c, g, or t
gattagctttttgatgtgctgctggattcagtttgccagtattttattaaggattttcacatcaatgttcatcagggatgttggtctagaattctcttttttgttgtgtctctgccaggctttggtatcaggataatgcttgcctcatttgagttagggaggattccctctttttctattgattggaatagtttcagaaggaatggtaccagctcctctttgtacctctggtaggattcgcctgtgaatccatctggtcctggacttttttgtttggcaggctattaattattgcctcaatttcagagcctgttattggtctattcagatattcaacttcttcctggtttagtcttgggagagtgtatgtgtccaggaatgtatccatttcttctagattttctagtttatttgtgtagagatgtttatagtattctctgatggtagttngcatttctgtgggatcagtggtgatatcccccttatcattntttattgcatctatttgattctcccatcttttcttctttggtagtcttggtagaagtctgtcaatttttgtgatcttttcaactaagtctggttcaatgatttttgggtttttgggttctatctcctcactctgctctgacctagtttt

SEQ ID NO: 552574 - DNA, 358 bp, Homo sapiens
  misc_feature (358)..(358): n is a, c, g, or t
ggtgctatcacagacacctgttgcatcttagatgaaagagatcctagttattgtgcaactacctgtggcattgcagatttcctgtgtacttatcaaaccaaagtagacaaggatctacaggctttggaagacatattacattaaggtgaaaacacaacattagaagtcaaacagctgataaaagcaatccaactcacttataatcctgatgaatcattccaaatatgatagacgctgttactttgaagtccaggagtgttcgatatttgcaggaaatatataattcaaataatctgattgttaacctgagagagaaggtagcccagcttgaagcacagtgccaggaaccttgtggacn

SEQ ID NO: 552575 - DNA, 213 bp, Homo sapiens
ctcacagcatacaaccgccagcaacatctcatcctgaagtagcatataaagagcctacacctagaggctgcctcaagcttggccacctggccccagcagatcatgcagctcgccctaccagcgtgcgcttctcactagagagcagatgctcaagtgcggcctccttaggagttcaagcagagcctccagtgtccttcagaccgatgcctgagc

SEQ ID NO: 552576 - DNA, 132 bp, Homo sapiens
ttggtttaaagcacaatttggcctttttttaagtgaggtttaggacaatagccacatgttttttggggttaataattttcccctttgggagacaaaattttgggcgtgggccctatttggggggttctttga

SEQ ID NO: 552577 - DNA, 156 bp, Homo sapiens
tcggagaaggccaacatcaggaggttgaagacctagcccagtttgtagtctatcaggagcctgcccaacagctctgtcgccagttttttctaattggtcagtgcccatgccatgtcaatggccgcttaatattgtgattatgttggcccttatcga

SEQ ID NO: 552578 - DNA, 637 bp, Homo sapiens
agcagctgtactgtctgggatttaggatagccgaggaagcggccggccgtgagcgctggtgcagtgggaggcactagctgagaacaggcagtcaaatcgctggtgtgctccaaagttctacttccacgaggcgctgcgggcctttcggggtagccggtacggggacttcagacagatccgggacatcatgcaggcttatgcttgtactggcccttggggaaggagcacaccgtgtcccgattgctgcgggttatgcagtgtctgtcgcggattgcaagaaaggcggaaaatttagactgttcctttgatatggaggctgagctcacaccactggaatcagctatcaaatgtgctggagatgattacacacggaattttacactgacagaaggcagtggctcgaatccagtagaaaaacttggtcaagggaaagcttgctgttccattattttgtatcaagaaaacaagagaatttgaacaaggcttcacaaaattttgaacaagagacatatgtccaaaggacgcccacgaagctcatgaagctgagcaaatgagtctcctgaactattattgcgagacaaagaagctttgggacccatcctgtttatccagaaacttttcattatgagaccttcca

SEQ ID NO: 552579 - DNA, 1051 bp, Homo sapiens
  misc_feature (484)..(484): n is a, c, g, or t
  misc_feature (551)..(551): n is a, c, g, or t
aacccactccaccttactaccagtacaaccgttagccaagagccactttaccctaatagaagtatatgctgatagaaattgatagctggcgcacatagatatagataccgcaaggtgcacaagatgaaaaattagtaacctagggcagtaagtatagcgaggacgtaaccccataataccgttcatgctatcattggaattaggactatgaaataacgtttgctagatggagagccagaggctaagacccccgtaaaccagacgagctaccataaagatacgagcatagagaagagcacacccgttctatgtatgcaagaaaatgaggtgggcgcaagggattcttcttaagggtacgagtgcaggaccaaaaaccctacccgacgtcgctggtagagtagctggagtatgtcccaaaggataggaagtccttatgttctcagacctttctaagagtgtgtagccccagctggaatcccctctnacacatcacgacctttgtttagaaacttgtacaacgtgtttaggttcccaataagagggagagcgangcatgcttttcggatcacctagggaaaacatatacctttgctaaggagtagggacgtatagagaaaatttgatggcatcccagttaggtaagtggccgtaagaaatgctaaggccaacccaaatttaatgaaaagcgttcaaaggctcaagccacccactaacctaaataaaatccgcaaaacatataaactggaaacttctcgtcatcaaccgcgagatttggaaccgagagtcctaatcacccctactaggaaagtaacctaaatgtttcagttaattaaaggtaaacaattgaaaagaacccatttctttgcctccgtcattaacaggccgtgccgatccagaagtttgagaaacaatttggatactgtacctaattaaaccaggcccccagaataattcttaacgaaattcctaaactcaaaaccaattgggttcaacttttaggtttaaccccgtccatcttaacacagaaggacccatgattgcaagagcgcgg

SEQ ID NO: 552580 - DNA, 442 bp, Homo sapiens
atactggtaattaaaatgctattgtaatccctgtggcaacactaacaaaataactttaaaatatacacttaaaagaaaaagggatttaaatgctacactagaaaatacttaatacaaaagaaggtagtcaaagatgaacagaagaacacaaaggcataaaacatagaaaaccaatttgtgaactgatagatggaaatccaaccacagcaataataacattgaatgggaatagaatgaacatgccaatcaaaaggcagagatcgttagactggatttttttttttaagctttgactatatgctgcctgcgagagacatacatactttagaaacaaagatacaaataggtcaaagcaaaaggatagtagattggctatgcaaacaaccgtaagggagcttgaggagaaatgctaacgtcagactaaataatttttttgtgattt

SEQ ID NO: 552581 - DNA, 424 bp, Homo sapiens
gcccaaaaacgcttttttgggggggtccctttaagggggttttccaggggcttctggcaggttccctttgggggtttgggggccccccccccccgggggggggaaatttttgcccccccagggccaggtttcacccccccaaaccccccaaattgtgagttaggggggggaaattttcaaattcctttcaagggttggggggaaagttttttaaaagggggaggtcctgggggacctcaaggggattcccattagggttgggaaaggggtttccccccattcccaaaaggtttttttttgccccccaaaagggaagggcccttgtttttttttccccccccttttttaaaggggtgggttccaattaaaaaaggggcgggggtttccccccattcccccaaaaaaaaggggggttggtttttca

SEQ ID NO: 552582 - DNA, 90 bp, Homo sapiens
gttatttgtacagcaaaatggcgcttgtacatctatttcccccaatgcaggatgataaatatcacgggagaatagagaatcatcaatcag

SEQ ID NO: 552583 - DNA, 142 bp, Homo sapiens
cgactctaaggatcccactcgccaatcattcgaagtcaggagttggagaccagcctgaccaacgatgtgtgaaagtcccatctctactaaaaatacataaaacagcccattgtggtggcggcacctgtaatctcagctactc

SEQ ID NO: 552584 - DNA, 108 bp, Homo sapiens
agcggaaagtggatgcgctacataatcatcgctatccccagcggcgcgaagtatgtagctgaactctgcagactctgacggaaggcaatatgaaactgatctgcgtgc

SEQ ID NO: 552585 - DNA, 145 bp, Homo sapiens
gctgcctgcgtgacgtcgctctagaggactccccggtggctcggtctagttgtggctcatccacgctgacgctgccacttctcttgtcccttctgtagccgttcttctacttctctttctctagccgctgtgtcatcgggcttag

SEQ ID NO: 552586 - DNA, 758 bp, Homo sapiens
  misc_feature (1)..(1): n is a, c, g, or t
  misc_feature (100)..(100): n is a, c, g, or t
  misc_feature (129)..(129): n is a, c, g, or t
  misc_feature (139)..(139): n is a, c, g, or t
  misc_feature (199)..(199): n is a, c, g, or t
  misc_feature (203)..(203): n is a, c, g, or t
  misc_feature (229)..(229): n is a, c, g, or t
  misc_feature (240)..(240): n is a, c, g, or t
  misc_feature (253)..(254): n is a, c, g, or t
  misc_feature (264)..(264): n is a, c, g, or t
  misc_feature (271)..(271): n is a, c, g, or t
  misc_feature (280)..(280): n is a, c, g, or t
  misc_feature (303)..(303): n is a, c, g, or t
  misc_feature (318)..(318): n is a, c, g, or t
  misc_feature (325)..(325): n is a, c, g, or t
  misc_feature (386)..(388): n is a, c, g, or t
  misc_feature (397)..(397): n is a, c, g, or t
  misc_feature (413)..(413): n is a, c, g, or t
  misc_feature (444)..(444): n is a, c, g, or t
  misc_feature (470)..(470): n is a, c, g, or t
  misc_feature (473)..(473): n is a, c, g, or t
  misc_feature (485)..(485): n is a, c, g, or t
  misc_feature (526)..(526): n is a, c, g, or t
  misc_feature (531)..(531): n is a, c, g, or t
  misc_feature (545)..(546): n is a, c, g, or t
  misc_feature (563)..(563): n is a, c, g, or t
  misc_feature (671)..(671): n is a, c, g, or t
  misc_feature (730)..(730): n is a, c, g, or t
natgtcatcaacaagtaaatgggtaaatgaattgtggtatatccatacaagggaatattcaacatttaaaagaatgaattcatacgagcatcaagatggngacatatgaatctcaaaataattatgcanagtgaaagangccagacaagaaaaaaaagacatactatatgattccattcacataaaactacaaaatgcnaaangaaagccgattggcggttttccgggnaggcgtcatcnggcggcgcattgnnacactttganggatganggatatgtncactctcttaattgtagtatgcntgtcctccacaaggngtgaaancttatcaaatagtacactttaaatatgttcagtttattttatgttaattatatctcaatannncttttcccncccccccacatctctngcctacataagggtgacacagctcttaaaanaaaaaaagattcctgctagattgtgngcngcaaaataaaanggcttcctttaaagtagaatagcctgtgaagagtgggtggnaaggnaatagaagcctaannctagaagatatatttcnaattccatctgtttctattcagcgatatttgcatacctggcttagtttgttctagattgagtgtcttcattttttttgtcttgtatgtttcggaattatagcatagcnaaacagagttgagaagagttcatctacaaaaggtatgttctttagggaaagaaattctnttcttacctctgggccacacatcccatg

SEQ ID NO: 552587 - DNA, 117 bp, Homo sapiens
ccctagtactatctcgtcatcttaaacaagctaacatgactaacaccctttattccattcaccctcctactccctaagaggcctgtccccgttaaccggactttttgccccaatagg

SEQ ID NO: 552588 - DNA, 1032 bp, Homo sapiens
aaggcacaaccacagtttttctttcttaaatttcatcactgttgatgtggttctatttgtgttcaacaacacacaacaaagtgcacactcatcaaacactaaaacacattcatagagttccatatttgccgttctgctgattttaagatatacaataacatcatacatcactttcacaagccacagttcacacatggcagcataacagttgcacaatccatcagacagatgccaaatgacctttcaaagatcaaccaccaatgtgttctgacaactttcgtgactaataccatgcatctgtgatccaatgcacctatgtggttatagcaatcggatgtagaccattcagtcactcactacttgagctaaacttctgcatggttcatcacattttcaacagtagtagtagttcaagtatgcatgttactacgtcctattcttccattcttaacagtatgtgcccatttgcaaaacaaacatgctaatcaatcagtcatagtcctataacaaagattggtaacactcgtgttatagtcatatgactggaatcgttcggtgctaagcccttaacacatgtgtccgtggacgattcatggaccgtcatgaggcaattacagtgcgtagagcccccccagacaatgtaatcataagccggggagcggaatttcccagcacgtaaaccccagaggatgcgaaaatccagcgtgccaggacccggcgattatgggaggccagtggatggccgtgaggccaagggcaagacagtaatacaggggacatagtgacacagtgcaggggaaacacagaaaaccgcaatagtacatcacggaccaaacaaagaaagagtaagagcacacgcaccacgcatctagtggaaagcgaccaaccaaaaggaggagagtgaccgaggacaaaaccagtggtcgggaacaagaattgtacgaagaacaggaggagaacgtgacacgcgcagagaaagagaggagggaaaagagtcggccagcaacaaggcaacagagacgagccggaaac

SEQ ID NO: 552589 - DNA, 429 bp, Homo sapiens
aatgaagacaaaggttggcccgcttccatttcccaaactgtccattactggaacctatgatttaaaaagggttctgggtcaactgggcatcactaaggtttttaacaaagggggtgccctttccggggtctaaaagaaggcacccctcaagctttccaaggccgtgaataaggttgtgttgcccattcacaaaaaagggactgaagctgttggggccatgtttttaaaggccaaacccatgtttatcccccccgaggtgaagttcaacaaaccctttttttttttaaagattgaaaaaaaaaccaagtttcccctttttatgggaaaaggggggaatcccccccaaaaaaaaaggcctttgggtcctcaacccctcccctccatccctggccccccccctggatgacattaaaaaagggttgggctgga

SEQ ID NO: 552590 - DNA, 279 bp, Homo sapiens
gggggaaaaaacccccccggggggaaaaaattttttttttttcccccccccagaatttttttttaaccccccccccccacccccccctttaaaaaaccccagggttttttttttttccccccccttggggggggaaaaaaaaaaaaccccctttttccccctttttttttcccccccccccccccctttttttaaaggggggggtttttttttttttttaaaaaaaacccttttttcccaaaaaaaaaaaaaccccctttttttttcccttttttttta

SEQ ID NO: 552591 - DNA, 619 bp, Homo sapiens
gctcacgcctgttagtgcccccaaaacctggatggctatgtccttcccaaggccaatctgtccttccgtctcctgctgcttctggcctcactgagtctgaagagctgtgaactaccatggccagtcctccctgagtctgaccatcttccatcctgctgctgctgctgctgctgctgcgggtcttccgtggaagtcggaccattcgtgtgtctgctatgcgccgtccgtcaccgagagatgactgccatgcttgtttgcatacgtgcccgggcccatgagactgacttcccgacatgcgtctgccgtgcgctctcgcgccactgggcgtggcacagagcccgcccttgttcgctgtctgatccgattgccgggtgtgacgcgcgcgccgctctgtgctagtagcgtggtttcttacgatccaaacctcgggggcaggtctgccccagatctggctgccatggccctcgcctctggccattcagacgacttgcgtgctaggaagtcttccgagggcgtgggacgggacgtgggagcgccccgagttctgtgtcctgacgtgggtgcgcgcgtggagggggctgctccatatctgacagggttctctggctgcagaatctcc

SEQ ID NO: 552592 - DNA, 206 bp, Homo sapiens
  misc_feature (108)..(108): n is a, c, g, or t
gcacaaggtgggagcactgccccccctccagatcccttccagttaaaacccttcccccttccctccatgtgttttcagtttcccgtttcgtttgttggactgttccantgcccctcctcctccccctatcacccatggatcgtaatgtaaaatttttttcccatgtcaagaaattattaaaaatacaggtcctttgccctttttca

SEQ ID NO: 552593 - DNA, 752 bp, Homo sapiens
gacctcctgtaaagaataaaactgtgggccgggcgcggtggctcacgcctggaatcccagcactttgggaagccgaggtgggcagatcataaggtcaggagattgagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaacctctgtcccaacaaaaaaacaaaaaaaggaattacaacccttgtgcagggatggtcctcctccgggagacaagcaacgaggggaagaggaggggacgaggggcctcttctctatacgaaacacgagcgccttggggtgagcccagaagttggaaacccaggccggggcaacttcgcgcaagaatcccattctcttacaaaaacattagaaaaaaacacattacgtcgtgggtgccactgtgcctgtgtgtccccactgtgtctgggacaggctgacggtggggacaaattggctataagcctgagaagtaggaaggcctcagttaggcaatgatcattgccatgctatccagccggtgtggccactgaatctgcgggaatggcccagttggcttgtcgccacttcacgtgctgcctggctggcttgacgccagtcacccgagggggtcca

SEQ ID NO: 552594 - DNA, 168 bp, Homo sapiens
atgtatgctggaggtgactctagtaggatccctgctgatctggtcggcgtggactggaggcgacccctctcgcaggtgtctccagcgccatcttcttcgtgccgggcttcctattgttggtgcctggagtctatcacgtgatcttcatctactgcgcgtccgtagcgg

SEQ ID NO: 552595 - DNA, 705 bp, Homo sapiens
  misc_feature (211)..(211): n is a, c, g, or t
  misc_feature (317)..(317): n is a, c, g, or t
  misc_feature (332)..(332): n is a, c, g, or t
ggaatacatatctagaaggtatgtgtacacttacaaagttagtagagaagggaagtagaagcgaagaaactaatattcaatcgtagataaacatagaggtaagagaatctgaggaaagaaaacgtggataaagagtaagacaagtagcacatgaagtacatagtcaggcaataatgtgcagcatatattagtgtattacaggcgcatatgnagttgaaacaaatacctcacacttggaacagaaactggtttacttagatggtgataaagataactaagatatatactttactatgctgttatacaagtcaataccnttaaagaagcatatntctcgacttgcagagttaatgatggactttaacaatgagatgattcctgatcatctagctaaactcaattagaagatgattgctagtggctattatactagtcattgtacaagttgactgttgagggctagaaatagcctgttccgaagagacgtgatgggtgcacgtcaactaggttatataacaggaatggttattattgttgaactaagtgacttacctgtataattatactttcaaatatacatgaagctgacactaggactgcagaagacataggtaaactttatcgagttatggagtagcgttatgtagtataatctcgtgttaatgtggaggaacaagcagactataattgtgaaccttatagatg

SEQ ID NO: 552596 - DNA, 268 bp, Homo sapiens
gcccacacactttttcccaagacagcaatatgtagtttcgatgtctaaagttcaggagctggtggtcccgatgtcatctcaactcaatggtcttactcatggcccataagtatccatggtatcaatgatcgcaaggggtcaataagtcaaggtgtaaataaggtcggcgctaacggccagaccctccagcctgtagtgagcccacccaagcgtggttgaagtacccatttccagcaaccactccctacgcccagtgcctttgcccagt

SEQ ID NO: 552597 - DNA, 181 bp, Homo sapiens
agctcggtacccccagttgtgaggtgtgatctgcggacacaagatggtctcgtgagatcatacttgacactggctactggccaccaaggtgtacactgcagaagtttgtggactacctgttttaaaccatcttcagcaaagcacaccggggctcagccctgccgctggcctacagcacatg

SEQ ID NO: 552598 - DNA, 509 bp, Homo sapiens
  misc_feature (3)..(3): n is a, c, g, or t
  misc_feature (351)..(351): n is a, c, g, or t
  misc_feature (431)..(431): n is a, c, g, or t
ctntcataaggatacctaaactagtagagatcatcacagagctaaaaactacctccctaaaacctttatcttctagttcagggttttttggtggtggtggtttcatttggtttggttttggagacagagtctggctctgtcgcccaggcgggagtgcaggggcatgatctcggctcacggcgacctccacctccggggttcaagcaattctccgggctcagcctctggagtagctgggattacgggagtgcaccaccacccccagctaattttggtattttaagtaaagagggggtttcaccaggcgggccaggctagtctcgaactcctgacctcaggtgatccacccgnctcagcctcccaaagttcggggattataggcgtgagctaccaggccggaccggagttgggttttaagatattaggctggncaggtggatagggctggaagcctcagtggtagggttactaagaaaattttagtttttcaaaagcattataatttccta

SEQ ID NO: 552599 - DNA, 402 bp, Homo sapiens
gtcgacctcatgttcgtttgcagtagcatgaggaaggggcttctgccagttactaagctagggtccttgtctgtcctaggctcagctgcaaatgcctgatgcagccatcttcacatgctgtcaccctccttcacgcacccccccagctcttttaggtagcctccgggtgtagagggacaggctgacagtctctcgaggacttgggtccatcctgctcttgttctgtgagtgcagatctcaccctgctgccggggcagtccacatgtgactatcagtatctagagttgctgttccacagtctgtataatttggaagagagagctagcctaaccctaacaagactcaccctcttaagatggtgccactcttgaggaagtccagcagcttccagtccgtcgacgc

SEQ ID NO: 552600 - DNA, 104 bp, Homo sapiens
ctagtgaggatcacctaaggtcatcagttactgataccagcttgcgttacatggtgaaaccccgtctctactacaatatactaaaattacgctgggcgtggtga

SEQ ID NO: 552601 - DNA, 105 bp, Homo sapiens
taatgccactgcgggggtcgtagatcacattttgagtagcaaaattaaacgtgggatattaaatttaataccatcacacacagcccacattgcaacacggtctca

SEQ ID NO: 552602 - DNA, 786 bp, Homo sapiens
ggcctctctggcggcctgtggacgggaggatagccggcctcattcgtggcagtgggagtatggatctccgaaggaagaggggtccccgaggcgatcgacagacttcgagttctcctgatgttgttcacatagaatggctcaagatccatgggagaacacgtaagtggaaaatctctcaggccttttccaactgaacccgtgaacgaagatatagttgtgtgcgtgcgggagaagatatgggacgacgtgtcgtcagtggccgagtagtttgcagccgagacctttattgtacgcttatgatgatgtgggccatgctaaatacgtatatctgatcacagaacaaggccgatgtctgcattgacccggggcagctgcatggctgcaagggtccgactgatgtggcatagtccaagtcggatgctagcaggtgttctgggtggatcgcgcatatgcactcaaaatgctctttgtaaaggaaagccacaacatgtccaagggacctgaggcgacttggaggctgacgcaaacgtgcagttgtgtctacgactcctcggagaaaatcccacttcaaagacgcagtcagtggctgggaagcacaacagtcaactcgcaccacgctcgtctgccttggtcacccccgctgggaagtcctatgagtgtcgaagctcaacgaaccatttcactggcctctagtgatccgtagaagacggtcaccatgatcctgtctgcggtccacatccaactttttgacattatctcagatttgtcttcagtggaagagcataa

SEQ ID NO: 552603 - DNA, 388 bp, Homo sapiens
gaccgagggacaggagtacattttatagagggctgcaggctccacacaggaaaagagctccatgattgattcagtgatgtctgacacagagcggtgcagtgaggagtgcgggccatgatgctttgcagtgtatcatagagaaaggcctccaggcaggtgttggaatgaagaggccttggggaatagacattggagttcagaggactgagcagggctcagacaaggtatcacctgtagaagatagtgattgccagtggctctgtaaggtgacccaaaggggaatctggaccgcaacatggtggactacaggagtgttggaagtctcctgcttaccattctgtaaaaacagccatctttcaagtatcagcaacgctgcgacatgtcccca

SEQ ID NO: 552604 - DNA, 916 bp, Homo sapiens
ggcagtggctaacacctgtaatcccagaacttgggaggctgaggcaggcatattacctgaggtcaggagttggagaccagcctggccaacatggtgaaaccctgtctctactaaaatacagcaattagccgggtgtggaggtgcacgcctgcaatcccagctactcgggaggctgaggcaggagaatcacttgaacctgggagacagaggttgcagtgagccaagatccagtgctttggcaacagagaaagactcacacaaaaaaaaaaaaaaaaaaaaaaaaaaatttggggggggccgggcccggaaaagttttaaaacctcggtgggggcacccgcgcccccagtagggtatagtggtgaacacggtggcacagaggtgttgcccaaggaagaaccgggcccagcgaaacaagtggctgttgcttcctccccaatataaaaaacgcgcggggcgcaacacggaaggcgttctcggaacaactccaagaagggggctcggaaggtcataacggggtcctacaccaggaggttccaagcagaacgcgatatccaatagcgggcgcggaggggaaaaaaagagagcacaaagagaaaacaaaaaggagggaatcaaaagacaaaatagaccacgaagaaaaggaaacaacaacacaaacaacaaaaaaatcacaagacaccacaccacgacacgacgagacgcggagaaacacaacagaagaacaacaacgaaacagacaagacgagaaacagccagaaacaaaacgaagaaaagaacagcgcgacagcgcgcacgacagagagacggcaaaacagaagacaggaaggagcaaaccaacgcaaacaccacgcgcaacgaacaagagaagaaagaaaagaagaggaacaaaaaggacaaggaatgaagaacacaaac

SEQ ID NO: 552605 - DNA, 251 bp, Homo sapiens
gggaaacattaagcagaccctattttcactggcgcggtaatacctatttatctgatatcctagaggtggttggaatgaagctacgtgccaatttggtgaaattttttccaaattggggttgggacgaacccaatggaaccgcttgggttttctctctattggcacaacccttgttaacgggggaaacccctctaattttaaatttctttactccttttttccaaatttaccaaaacacagaggcctttaca

SEQ ID NO: 552606 - DNA, 1117 bp, Homo sapiens
ttttttttcatcgtccaaaaaagtttattaccatgacttaaaaccatttacttgaataataacaaaaaaaatttttaaccattgaaagaattttccggtggctattacctttaaaaccagatatttgtggaatttgaatgtggacgagcttttatgtgccagttctttcaaaagaacaactccatgtgcatgtggctctccatgttaagtctcggtgactataatgtgcttctgtgtctctgtgggaatgtgaagtctccctatactgtggcaattactaagttatataaacaaatatatctcttctccatctctatatatatgtgtggcacgtgtggtgcaccctgtgccagtgtggagagagagtgtggctctctgtgagagtataagagagagtatgtcgaaatagacaaaactccgcacaacagagagagtgtgtgcgcgttcttgtgtgtctctctgtcttataacacacacgattctccctgtttctcaacccaccaccccatctacgacacgacgaaacaacatattatatattatagatatcatcatctgctgactgggctctcttgtgtattacaaaattttctccctattatacagtgatgacatgatattttatgagaaaaatgatgtgggcagggtactcccccccccaagaggaggtactctctcatcgcgacattactacacaccggtgttaaaactagttgtgtgagaaacacccacagagaccacccgcccctctcttctccccaaagaggggtgccaaccaccatattcgcccccgaggcagtcgcgatgtgcgcggcgctcactctcctgatgaaaacaggacaactcttctccgacaacccctactcgtcacagcgctggttggcctaattaataattccatccgggagagacttaccagctgacaacgacaacctcccactatgcagacaacaccccgcgccggtccttcctgcacctcgccccagaataccagccgtcataagactctggaccgctccccagtgctcaaagtcaacctcgtgttcttcccgcccccccttatccccaccccaccccacgggggatactactgtggcaacgaagcctactgtggcaa

SEQ ID NO: 552607 - DNA, 215 bp, Homo sapiens
agcacaacatcatcaaatgtgtagtgtgtgcagaagacatcacattcactgacgctttctcagtatgtcataacaggggagtgccataaaggatcttctggctgggtgtgagtggctcagacctgtaatcccagaacttcggaacaccaatgctgcattgagctgtgattgcaccactgcactccagcctgaatgacagagcaggaccgtgtctc

SEQ ID NO: 552608 - DNA, 771 bp, Homo sapiens
ttcgttcgagaacaagctgtgagatcggctgctttgccaagctcaccaacacctactgtctggtagtcgatcggaggctcagagaacttctacagtgtgttctgagggcgagctctccgataccatccccgtggtgcacgcgtctatcgcctggctgcctgcatcatcgggcgcatgtgtgtggaggaacaggcacggatctcctggtacccaacaataccacctgaccatggagctgcaagcacattcgcaacagccatcccaccacacagttgcatgataagagcgtggtggacgcgagctgtgctctcagccttgggcaatgtcacccacctgcaatgactacgtggccttgtgtccacccagacttggacagggagacagaagacaattctggcagatgttgctcaaggtggaacgtcttcacacagacatgtgtgccgaccatggtgctacgtaggaagctactgtgtcttcagcaatcagtggagtggctggtgcatcccaagacttcaaattgaagaccaggatgagctgtcctctcttcttcaagtcccccttgtggcgcggactgtgaccctgaggccgtgaggtgattgctgctgggcatggtgcgtgaatgactggtgtgccttctgtggtcttggacacaccagcacagcagctgtcagtggtggatagtgtctcgagctgaatgagcccagctaacccattgccccagctcgggatcctcatgaggctcctggtccttcaggtgcctgggcctgcttg

SEQ ID NO: 552609 - DNA, 130 bp, Homo sapiens
ggtgcttggccaactcttcggcgctgatgtgaatccgcaccggcacacgctgcacgatcttgatccagttcccggtggcgttctccgccggccacagagcacacgcactcccggtgccggcgcctcgtct

SEQ ID NO: 552610 - DNA, 367 bp, Homo sapiens
gtacacttgtgcacacttatgccttgattttcctacctccagtctcctttttctattaatccctcttgtgcgtggctgcctgtagtccactttctcacatagcactatacctcactatgcaactttggaatctctgttggctcacctttgccatttcttaatattgcattctccaaattgcgtaatctctatccagtctcttgaactaggacttggcacatggtagattccgctcagaaagtgctcttcacacttctacctgcttgactaaccccagattatctttcaagactttaatctgatcttgtgtcttagagaagcccccatacctggtagagcatgtaccatcttacatgctttaattact

SEQ ID NO: 552611 - DNA, 518 bp, Homo sapiens
  misc_feature (34)..(34): n is a, c, g, or t
  misc_feature (400)..(400): n is a, c, g, or t
ggcatatacgggtgtttctggcttgaagtctctnatgaggttgtagtcaagatggcagttaggaatgtagtattatctgaagactcaactagggctggagaatccacttcccagattactcactcagagggtgttggcagaaggagtcagtacttccctgctgcttgcaggcctctctgtgggttctttagtatcctcacaacattggcagctggcttcttccagaaccagaggtccaaggaagagcaaggcagagccaaagtgcctttggccttgccttagaattcaggttctgttgtttctgcattgtcctagtgattgcagtcattcctattgaatgtgggaggggatgacacatagtgtgaataccatgccacaaggctcgttggggccatatttnaggctggctaccacagtgagctacactgataaggatctttgagcatcatattaaccatggattttcagatttcaacatctgtcaaacaaaaaagacttaacaaagattcaacaggctt

SEQ ID NO: 552612 - DNA, 587 bp, Homo sapiens
  misc_feature (236)..(236): n is a, c, g, or t
tttgaagacttcctcttggctccaaggagaggggtttcctggtttttacacacagggcccccttggcgcaaaagccttggggaaagaaaaaccaaattggtttttatgtcctcttctccccttcaatctttcagcaaaaaattaactcccttaagcccagacatttgttgagacctgacccctagtcattggttaccagtgtgtcaggcaatttggactttccagtaaagcccctnaaatggcccctgtcaaaagagcagtggttccatttttaaattgtggatcttcaaaaaaattccgcccttttcatttcccttcctgaaagtcaggggccgcttgtgaaaagttgttaaaccacatgctaaatgtgaaatgtcaaccccccctttaaactttccctgttcaaagcatcaaaagaaaacttcattgggttttaaaggggctttttgatttttggtagccccttgaaaaagggagtttgaaagttgttgtaaactgttaacgattgtctgcccctgtcccccccgaaaacccaagattgtttatggaaagaatctttaaaaaagctggaacccgtttggcttgga

SEQ ID NO: 552613 - DNA, 313 bp, Homo sapiens
ttttagagcatccatctacttctccagctctgtgcactcaccagacagagcctcctgctccgccctcttcttctggcgatacctagtgcctgctgactgtgttttgctccatttttgcagcttcttatgcagtgtctcaccctgtacttttgctgctaccatcttctctccaggaggatcgtaagtgttgggacgggcagacccacagagaacacctgcagatgggaggctcctatttggaggagcccctggtagagaggctgggctgaggagaccccagataggactctgggctcatacagatgccactatc

SEQ ID NO: 552614 - DNA, 269 bp, Homo sapiens
  misc_feature (2)..(2): n is a, c, g, or t
  misc_feature (11)..(11): n is a, c, g, or t
  misc_feature (105)..(105): n is a, c, g, or t
gngggcatccngaaggcatcccccacacacagccccctgatgaagctctgagcccacccagcatcctgtcctgagaccctcatctctaaaaagcgaataaaaacnaaaaaaacaccaaaacaaccaggatgtctcccatgcactccacttaagtgtggagacttaggctgatcacatcactgcactccagcctgagtaacagactgagaccctgtctcaaaaaaacaaaatgagacaaaaaacctgctcgtaataaagtgtgaaattgc

SEQ ID NO: 552615 - DNA, 211 bp, Homo sapiens
  misc_feature (98)..(98): n is a, c, g, or t
ctgtgtcgggtggttatatacaagagaattttccattccttaaggctggggaagactttctaaaaatatagtctgagcacagtaattgtctttctttnccttttgttgtttgtttttaagcagtaagatttttttttttttttttttttttttttttttttggaaaaaaatctcgctctgtgctccccgggctgtggatgttcaggggccc

SEQ ID NO: 552616 - DNA, 336 bp, Homo sapiens
tctcaatgtttctgcctgggtgcactggctcgcgcctgtgattccagcactttgggaggccaacctggatggatcatttgagccaacagtttgagaccagcctgaggaacatgacaaaaccctgtctttgcaaaaaaaaaaaagaaaaaagaaaaattagccaggcacggaagcgcattcctgtggtcccagctacttggggggctgaggtgggacaatcgcttgagcgaggttgcgggggtttggagggcgatggaggggtgatcgaggttgcagtgagctgagattgcactactgcactccagcctgggcaatagagccagaccctgtctcaca

SEQ ID NO: 552617 - DNA, 141 bp, Homo sapiens
gctaatctgtactcattgcgacaggaacttcggcagcttcgagcacattttgtataaaacgcgtcgagtattatctttctcagtctatgttgttgtcaactcatcttgagtcacctccattcaccatggaattcatacacc

SEQ ID NO: 552618 - DNA, 208 bp, Homo sapiens
aagacttcaaagttagattctggaaatcaaataccacgagtacttcagagcgattcctaacaatgagctatggcaaagcacctcattacgcatcactgatgaggttagtagaggacaaaatgagttataccatacgatgtactgtatatcacatatgaattgtcacatgtatatacagctgacacatctacgggtggaggagcagctg

SEQ ID NO: 552619 - DNA, 244 bp, Homo sapiens
attggcacacagtggggatggagtctgtcatgtgtccattctctcacgccttgctgtacatgtatcaatccttatcccagaagatcctatttcgactatttagactgctttagattacatacattagaggattaaggaatccatagatgttagtccttggaactgctacttcattttcttagatttgtcctgatcaggcttggggcctatttacagattagttttaaagatttgcattaactta

SEQ ID NO: 552620 - DNA, 134 bp, Homo sapiens
ggaaaacttattgttgtgacccgaaaaagttaattttaaaatgtggggcaggggcagtgacatttttgtagtcccaaaagcccaaaattatgggaaaaaaagttgatttttaaacaggggggggggctttttta

SEQ ID NO: 552621 - DNA, 512 bp, Homo sapiens
  misc_feature (115)..(115): n is a, c, g, or t
  misc_feature (123)..(123): n is a, c, g, or t
  misc_feature (278)..(278): n is a, c, g, or t
caacgcagctcccaatcaataaggaaccaactgcgcgaggaaggtgaccgagcgcccgcgctgcccaatcgctcgctcgcgcactcagacgcgcgccacaacagcgcgccccaanctgcgcanctctgcaaaagtttctgctcgggatctggctctcttccccttggactttagaacgatttagggttgacagaggaaaagcagaggcgcgcaggaggagcagataaacaccaccttctgcagttggagggcagggccagcccccgggccttgcaacnttccttaaggccccggtcccgggccggccccccgggaaggccccgggggggcccggaacccgccactatccagcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcg

SEQ ID NO: 552622 - DNA, 114 bp, Homo sapiens
  misc_feature (45)..(45): n is a, c, g, or t
  misc_feature (77)..(77): n is a, c, g, or t
caccaagcagacagatgacatgatcctgctggacgacaactttgnctccatcgtcacgggggtggaggagggccgcntgatcttcgacaacctaaagaagtcctttgccgaacc

SEQ ID NO: 552623 - DNA, 801 bp, Homo sapiens
caggcattttcggatccgtttttgaccggttccccttcggttgtaccgccgatactctgtatctactcctatggccttgttccccgctgatgtcgtggtgacgggccttgtgccgggactcgtcgcctaatcttggttgcggactcaatatctgatgtaccccgtcgccgtgccctgcatattctccggggttctcgctcttctcgccccggggggggtttttgagaatgatactctcttgccacaagaagcggtgggcccgtgtgtcctccccgagataattgttgttccgccccgccccctttgggtaacgaccatttcacgtcgggaccaatttacacgaggccccacccgagagggtgtgcggcaggttttcccgcgccgtgtattctggaaggtgcccgacgccacgttgcgccccaaactcacgacgtggcacacaactgtttgaaaattgggcccgggagtattaattcgcaagaaatgttttttggtaagaaaaagcgcactgttcgcacgagccccagggtgggttatctttttttgtgcatataacaaggggaaaatgtgcacttgggcagagaacccacatttaaaatatggggaggcacgcgggcacaacacattatatcggtttttccacatgtgaaacacgaaagctgctacaaggccccaaggagttttctaaatccaacattttatatgttggccccgaagcccacgagaatcatactctacttggaaaaaccccttgaaaatttttttgggcccccattaccccctaaaccagggcccaaaaaa

SEQ ID NO: 552624 - DNA, 790 bp, Homo sapiens
gaccgccgagaccgcgtccgcccggagcacagagcctcgcctttgccgatccgccgccgtccaacccgccgccagctcaccatggatgatgatatcgccgcgctcgtcgtctgaaacggctccggcattgttgcaaggccggcttcgcgggcgacgatgcccccggccggttttcccctccatcgtgggggcgccccaggccacccaggctgtgatggtgggcatgggtcagagaggattcctattgttgggcgacggaggtcccagagccacgagagggcttccttcaccctgaagtttaccccatcgagccacggtttcgtttcacccaaacctgcgaccgacctttgcgagaaaacatattctgggccaccacaaccttttctaacaattgagctgcgtgtgggctccccggaggatgccaccccggtggcttgcttgacccggagggcccctcctttgaaggccacaaagggtcaaacccgctggagaacgattgacccagattccatggtcggaagacacctgtcaaagcacctccacaagcccattgtaccgtttggtttatcccaggcgtctgtggcatattccccttgtacggccttctgggcgtggtacccactgggccttctgtggaattgagctcccgcgtggaccggggtatcacccacacatttgtgcccaatctaccaagggattatgccctacccccatttgcatgcctggcgttgggacctggctgggcggggacctgcttgcttaccgtgcatgaagatcctaccgagcgcga

SEQ ID NO: 552625 - DNA, 1950 bp, Homo sapiens
  misc_feature (1677)..(1677): n is a, c, g, or t
cgccaagtttcaaacagcggaacaaactgaaagctccgtgtgccagacccctactctcggcgcagccgaggtagatgcctcgtgttctgttatctgtgtgtagtcttttcttattcttctgtttttgttattcttgcacgagaccatctcctgagtctgtgatagagagagagacagaagagagtgtcagttcacagaggagcaggctgcgatgacacaaccacacacacctgtcaggacataagcgagggagcgcccagatgagggagagcctcttctgagaagacataacagtgagaggaagaacgagctcgctgatgacagaagagacaacccggcgagagggtgcttggtgctagtgtgggcgcccctctctcttgcggcgtgctctctttcttacagacttgcgctacacagcgtgcgatacatatctgtctgcgcgacttagcgatgttacagcgtgactgtctactctctacgtgcgacatactaggaaatgatgagcgcgcacccatgctattttctcctcgcacacagcacagaacaccgctactactctatcactatctcgcgaccgcattatcattttttgttgtctgcaaccacactatgaccaaacctcctctgtcgtttcctacttacctatctgctaccaatcttcgacatactcatctcctaccctaccaccacacactcaaattactctacgtagacctccccactcgctacgcccaaccatctataaacatacacaaacagccttttcttgctatactacagcggagaggggagtaatgtttgtgtttgcgtgggtgagagcaaaaagactccgtggggacgatagagtgtgataccaacacggtgcgtgacgcgggagacgtgtcgcctgcgcctgttgcgattgttgcgtgccaagcacagagaagaggcacttgacttgcgggacagaaccgcgccatatctcttccaatgtgtggttcgcgagtggcggggcccacacgcgtgctagagatgagatatacataaaacgcgacaagatcaatctgacatgtcgaattatttccaaacatgagagcgtggtgtgtgacacaaacaacaatcatgtacggcatgtgggacggctggccataatcgggcgtctctctcttaattcaaatgataatccaacagactcgcacagctggagcaactggaagagatgcttcatttgttgtaaaccccccacaggtggttccattcttctacttctacccgagagctattctagtgggccgcgcacacatctagcggtgattaatagcatatgtacccacttagggagaggaactaaaaccccgggtgttaaccctttggtcacattactctaggggggcaaccactactgtagcggccgagacaacggtttaattacgagatatattttttcaatacgtggtcgaacgtacgactctgttggtgcgaagagagtattaccgcagtgtatgccgcttgtcacagcaaaacggggtgtgacgtgaacaacagaaacatgtgataccagaccaaggtgacgagagagggggcacaccacaacagcaggtgttgttcacaacaactcacttgcatttgtggttgttgtcccacaacccatattagagctagctcagggtggaagaagcggtccacccaggagctgtnaacaatatctctagtggaggagcagcacacaagtagtgtcaccccgacgtcagtgtagtgaagagagacgcgagacctacctccggtcggctaacttcgaggcgtagcggacgcagttctgtagcgatcaaaacaatagtcatctaatgcgcagtctaccatactactagcggatgtgacgatgatccctagtgacgccgtccatggagtaagcgtcacacaccgggcgtcgatgggactgctacaaatataaacaccactacagttgttcgc

SEQ ID NO: 552626 - DNA, 263 bp, Homo sapiens
cctcggtaccttctctatcacatcaccaggctgcacactttccaaattttacactctgtcacctctgaatgcttgctgcttagaaatttcttctgccagataccctaaattatctctctcaaattcaaagttccccagatctccagggcagggggaatatgccaccagtctctttgcatagcaagagttacctttattccagttcccaacaagttcctcatctccatctgaggttacctcagcctggacttcattgttcatat

SEQ ID NO: 552627 - DNA, 1099 bp, Homo sapiens
  misc_feature (772)..(773): n is a, c, g, or t
  misc_feature (789)..(789): n is a, c, g, or t
  misc_feature (873)..(873): n is a, c, g, or t
  misc_feature (1019)..(1019): n is a, c, g, or t
  misc_feature (1030)..(1030): n is a, c, g, or t
  misc_feature (1073)..(1073): n is a, c, g, or t
  misc_feature (1086)..(1086): n is a, c, g, or t
cgcctgctcttccctctccttctgcgttcgctccccgccctcctcccgcgcatcacccctcatccttccccctgcgctctctcccctgtgctccctgtcggggcgtgtcgtgtccttcgttgtcacctcgccctgtccgtccgctcgccccactggcacttgctttatgtcaggcatctcagtcgtgctcgtcccggatcgtccctgaacgatgtccgctttgtgcaactgcatttcgagagagaaggttttgtggtatccttgtctataagctttgatgcatgtttcagtttaacctggcgtactgcaggagtttatgttgcttgtctacaccggttgctgtttattctcacccaaggtgggttcttcactgtattagtgtgtgcagggaggttaggataatgcttaactttctgctaatgttttctttgcaatttatgaatgggtgagcaatcctagtgcatcttgtatgtaggttaccacattgtgcagttattaactagttgctgtttcactatttctgccatggttatttccagtgttcttggtcattagcattaaaaagtagctctgtgcactgtgtggtgaagattcttgactgcttgcagcttgtattcaagaataggctcttgctactgtattccctgacaactcctttgcctcttactcagcattcttagcttgttacttcattaccgatcaatggtagcattgtaccatgtcttgtgacagcactgtttttaagtcacgtaatactatctggatcaacctnnccatcatgtctgtttncctggttattttttggttgttatttgaccagtaaaatttattttgtaataccaaataggatttaagaaaattaacgtatttctntactatggaaaacgcacattgtcatttgtgacatcatctatattaaatatggttttcacattagttatttgtcacttacttggaaaatgatgctgttaggtcctggtattaaaaatctagaaaagacttgttggtttatgtgctgnaatgtctttanttataataatttaactactatttacttcatttcggatcctgtntaacaaagatacntatacatccatct

SEQ ID NO: 552628 - DNA, 597 bp, Homo sapiens
  misc_feature (41)..(41): n is a, c, g, or t
  misc_feature (94)..(94): n is a, c, g, or t
  misc_feature (96)..(96): n is a, c, g, or t
  misc_feature (103)..(103): n is a, c, g, or t
  misc_feature (115)..(115): n is a, c, g, or t
  misc_feature (119)..(119): n is a, c, g, or t
  misc_feature (121)..(121): n is a, c, g, or t
  misc_feature (136)..(136): n is a, c, g, or t
  misc_feature (148)..(148): n is a, c, g, or t
  misc_feature (151)..(151): n is a, c, g, or t
  misc_feature (153)..(153): n is a, c, g, or t
  misc_feature (156)..(156): n is a, c, g, or t
  misc_feature (168)..(168): n is a, c, g, or t
  misc_feature (170)..(171): n is a, c, g, or t
  misc_feature (176)..(176): n is a, c, g, or t
  misc_feature (180)..(181): n is a, c, g, or t
  misc_feature (185)..(185): n is a, c, g, or t
  misc_feature (199)..(200): n is a, c, g, or t
  misc_feature (208)..(208): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (225)..(225): n is a, c, g, or t
  misc_feature (232)..(232): n is a, c, g, or t
  misc_feature (236)..(236): n is a, c, g, or t
  misc_feature (238)..(238): n is a, c, g, or t
  misc_feature (243)..(243): n is a, c, g, or t
  misc_feature (245)..(246): n is a, c, g, or t
  misc_feature (251)..(252): n is a, c, g, or t
  misc_feature (255)..(255): n is a, c, g, or t
  misc_feature (257)..(257): n is a, c, g, or t
  misc_feature (262)..(262): n is a, c, g, or t
  misc_feature (270)..(271): n is a, c, g, or t
  misc_feature (287)..(287): n is a, c, g, or t
  misc_feature (371)..(371): n is a, c, g, or t
  misc_feature (517)..(517): n is a, c, g, or t
  misc_feature (528)..(528): n is a, c, g, or t
  misc_feature (571)..(571): n is a, c, g, or t
  misc_feature (584)..(584): n is a, c, g, or t
ctcgcattatgaaggccacatctgtgctttgtaagcccacncccaaaaatagttctgttcactttctgcatggtattccagtgtctgccatacntnaaaaatncttgccactgtnttangntcttgactcttcatntgtttcagaatngcncntcnactgtattctgncnnccccncgcnntatngcattttgttgtanncaaatganaatggtngcntncccangcctgtnaccncnccccncnnccccnnatntnttttntcaacctnnccatcatgtctgtttncctggttattttttggttgttatttgaccagtaaaatttattttgtaataccaaataggatttaagaaaattaacgtatttctntactatggaaaacgcacattgtcatttgtgacatcatctatattaaatatggttttcacattagttatttgtcacttacttggaaaatgatgctgttaggtcctggtattaaaaatctagaaaagacttgttggtttatgtgctgnaatgtctttanttataataatttaactactatttacttcatttcggatcctgtntaacaaagatacntatacatccatct

SEQ ID NO: 552629 - DNA, 555 bp, Homo sapiens
  misc_feature (495)..(495): n is a, c, g, or t
cggagacgtggtctcaccaggtgggccagcgtgaactcgaacttctgacttcaaaagatccacccccctcagcctcgcaaagggctggggattacagatctaggaaagaaggacacagagacagggtacagggaagtccggaaagctgtcccggatgccggggaaagcagatactctagaagggaaggctccctggagggaacttagacagcaaggccagatgcacatcccgggaaggacatccagtgtccgagaagaacagatgatcccggtatttcaagacctcgtgtgcacttatttagtgaaccggcccggctcccacagaacacagcaattcctcaggctaagcggccggttcttaaatccatccggctaagtaaaggtggggtagaaagagatacagaggggcggtggaatttcccacataccctccttccaccaagtgggaacatcctgggaaatgggaagagcacaagaggagatccagggcaaggncatggggatattcggaaacttgaatattgggtggggtgcagagataaagaccttttccat

SEQ ID NO: 552630 - DNA, 732 bp, Homo sapiens
  misc_feature (461)..(461): n is a, c, g, or t
  misc_feature (465)..(465): n is a, c, g, or t
gtaatttcagatagtaacaaatccgtagattttgtcatgttgtgaaggagcaccttgttacaagaggtaatttgtggcccatgaggggcctcagagggccccaatcctaaatgttgtacgttcattaggatgaatgcctaggttgctctagggtgtaccgttggagagagagctgactgtgtgtgggccctgtcagagatggcttcgagggggtgagaattggttcctggaccggagacctcttggtggattcttccatcaagtgggcgggatgaattcctgaaggaacatttttccttctgaggaacaggttgggtccttctttgtaagaaaagttttttgtgtcccaggggcccagggtggattgaagacctcctgccgaccttgaagccccattaccttggtcaacatttttggggttccaaaaacccctcggggggagtagaggggagggcaaggangggncttccttctctttcttcttccctttcttgggaggggtccccaaccctgggatgggatggggtggggtttttttttttgaatccccccctgggtaccccccccctgggttccccaacgggattccaagggcaggtgggccctcaacttagggaagggtcgaggttccttttggaggcttgggcccctgggccaggcccggcagcccggagggtggggggggcctcagtggggggttttgccttgccccccgccccattaaaatttaac

SEQ ID NO: 552631 - DNA, 1225 bp, Homo sapiens
ctttgcagataaatatggcacactagccccacgttttctgagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatcatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtataaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtagaagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaaataaaaatgaggtactctcctggaaatattaagaaagactatctaaatgttgaaagaccaaaaggttaataaagtaattataactaaaaaaaaaaaaaa

SEQ ID NO: 552632 - DNA, 913 bp, Homo sapiens
  misc_feature (890)..(890): n is a, c, g, or t
  misc_feature (892)..(892): n is a, c, g, or t
ctttgcagataaatatggcacactagccccacgttttctgagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatcatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtataaggagcctctggttgggggtatccaatctcagactcaatactacaggtgaacaatcgctttaagaagccgtatcatggtcaggcactccaggcaattcatgtacacaacaccacgaggaatgagttgctcttacaggaacgtcttctgggacttgaaaattagatntncgcacacaaaccaccagagag

SEQ ID NO: 552633 - DNA, 268 bp, Homo sapiens
gcctcgttcccctcaaggaaggtctgcgacacctcaagctcgaagtcacgccgcagatcacgccggagggcaacatcatcctcgacgtggacatcaacaaggacacccggggcgagaccacgcctgccggcatcgcgatcaacaccaagcacgtgaagacccaggtactggtcgagaacggcggcacggtggtgatcggcggcatcttcgagcaggtcgaccgggatgaggtgtcgcagacaatcttgagggatcctctaagtcacct

SEQ ID NO: 552634 - DNA, 831 bp, Homo sapiens
ctttgcagataaatatggcacactagccccacgttttctgagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaaaatcgatgcagtgcttccaaggatggaccacacagaggctgcctctcccatcacttccctacatggagtatatgtcaagccataattgttcttagtttgcagttacactttaatgttcatcatcctaagctattcagtaataactctaccctggcactataatgtaagctctactgaggtgctatgttcttagtggatgttctgaccctgcttcaaatatttccctcacctttcccatcttccaagggtataaggattttctgtgtgggttatctctcgaattcaatatacaggttgcgtcatcgtgtaagatggctattatgatcatgcatccaaggcaatttctgacttactcactagggggttgcgtgtgttctagagcggacttccttgcgcaatttggaatttagagt

SEQ ID NO: 552635 - DNA, 542 bp, Homo sapiens
ctttgcagataaatatggcacactagccccacgttttctgagacattcctcaattgcttagacatattctgagcctacagcagaggaacctccagtctcagcaccatgaatcaaactgccattctgatttgctgccttatctttctgactctaagtggcattcaaggtaaggaacatcaaaggatacttaatttgtaagatgagaaataggaataggtataaattctaaaaatacagaaataatgtatttgtaaaagtttcactgcatgcttataaataagagggaaataaatagagattccctcagatcataaaacttatatgaattgaagtgagagaaacaaatagaataagagaaagagaaggaaaaagggaaggaggacagaagagatggggaagagggaggatagagagagaaaatgtgagggaatgcggacagagatgagatacagatacttccttacctaactaagctcaatgaaccacatgaactgtgcttaagggtttgactttataatcaacaagctgcaattcttttcttc

SEQ ID NO: 552636 - DNA, 1153 bp, Homo sapiens
  misc_feature (36)..(36): n is a, c, g, or t
  misc_feature (808)..(808): n is a, c, g, or t
agcgggcgctctgcattgtggggtggcgcgcggcgngcgggctaccgaggcggggccgggcgggtgagcgttcgcggggacgagggccatgggttactgggaggcggggctatcggccagaggtagtcggacgtactgttcccctaggcgacgtgactgtctaccgtctggggtcgtactgcgggtaactgcagctcgtgctgccgcatcgcatctgggacagtgtgggcgctctataacccttgtacagatacaggtgaatgactcaggggactcgtcactaggagccgacggcaatgcgtggaaggaaggctcgcaaacatatgatgtcgtagcgaagacctggtcatgagttcgaagagcgatgttcgtccctctcagtacgcacatattagacggctcgcacgactcctctgacaaaattgactagaccgtttccaaatccatctcaagccaagggaaggtttgctcgaccatcattactgttggacaattatcgtaaggccctcatggagcgtgggcacggatgtctcgcacaagggtgcaacatgatcgatcgaggtgcagtgggaaggctccacaactcgggtactttcgcgaacctacactggggtacttgcaatcggcatgctatggactgagagggtgtagcgatttgttggctgttttgggagtcaaatattaacatatcatgggttattgattcaccacggtgggcgtgaaattcattttcaagaaaaccagctttcacgcctggaggttgcacccaattgcaaggacacaacagatgctttttcatggaacggancgtagaaatggtgagacacaggagacgtttccaaatacggatagagaggagacgcacatcaccttccactgggaaacgtttgacgttctcctaggctcaacccaaaggaattatgtcccgatgaggaggaaggaacgaaactgtttgtgggaagcctcctgtgaggtcggaaagcgccgggtcgagccactattcaggggttaaaacaggggtttcgggcaacaagggtattcagtcttaaacggcccacgcggcgcaaatgcggtgggccgttggcactctaatcgaatggttaaacgcgcgcttccacaattgttcgttgaaagcaacgcataggagggatag

SEQ ID NO: 552637 - DNA, 253 bp, Homo sapiens
tcaagcgattctcccgcctcagtctcccaagtagctgggattacaggcacctgccaccatgcccatctaatttttagtatttttagtagaaaaggggtttcaccatattggccaggctggtcgggaactcccgacctcagatgattcgcccgcctcggcctcccagagtgctgggattacaggcgtgagccaccgcatccggcctgcagtgttacgatcgcgccactgcactccaggcgcgatccctctactg

SEQ ID NO: 552638 - DNA, 219 bp, Homo sapiens
ccacgcgtccgttttaaaaatacagatagatatatgctcagcacatttatcttatgtaacatgcagagcatatatctatctgcatgttacataagataaatgtgctgaatggttttcaaaataaaaatgaggtactctcctggaaatattaagaaagactatctaaatgttgaaagaccaaaaggttaataaagtaattataactaaaaaaaaaaaaaa

SEQ ID NO: 552639 - DNA, 176 bp, Homo sapiens
gagtagtgatgtgtgctcctttaaaggggtatttcgacttaagtagactgagctaaagaagattgccctcatcagtgtgagtgggcatcatcctacccattgagggcctgaatagaccataaatgcagaggaagggcaaatttgctctctctttctttgagttgggagctgagcca

SEQ ID NO: 552640 - DNA, 996 bp, Homo sapiens
gtgctcatgcctgtaatcccagtgctcaagaggctgaggcaggaggatcacttgaggccaggagtttgagaccagcctgggcaacatagcaagactccatctcttaaaacaaaaaaagtgttaacctctgtggtataacatatcaaacatttattgagtgtccagttatgttataggacttggtatgggctctataacggtgcagtaataacccaagtgccttgtgagagctggatagtctaatataagagataaaatacatacctaagtaacattacaaggcagaaggggatatggtccttagaaagctatgaagtattacaaaggttagaagaggacgattgcgcacccgaggtcaccattagttgttacccaggggaccgaggggtgtgtacttcagacaaaggagctcagaacaaacacgacaaccctttcatttcacacgactgggtactacaggtcaatgtgacacttggccatgcgggaacgggcactctaaggtagaagacaatcagtcatgcggctaacggacattaaaagacttacatggcagagttgaactagcaagacgccatcacacggacattgtgctctgtcccacgtcacatgtgggcgaggacactgggactgtcagggtggcgaaggtgcaaagtcggagaatcatcttggccggtcatgcgcgagtccatggacggcgaccgccggcaggacatggggcccaaagcacaggtggactctacagcataacggaacgcgtctggaggtcggaaactacctacgaaaataacacaggtgcaggcgcacacgccgacgcggcacggcacagctggaggcatttcaagcgccaaacgcccgaccacagtgcgagacatcattaccgcggcactaacacacgtgatcgcgacacgccagcgacaacaagcacacgggccgcggcgaatattaaccaaccgaccgcgcgctatagacctcaccacctgacaggggtgaagaaca

SEQ ID NO: 552641 - DNA, 1188 bp, Homo sapiens
ctttgcagataaatatggcacactagccccacgttttctgagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaggctgcctctcccatcacttccctacatggagtatatgtcaagccataattgttcttagtttgcagttacactaaaaggtgaccaatcatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtataaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtagaagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaaataaaaatgaggtactctcctggaaatattaagaaagactatctaaatgttgaaagaccaaaaggttaataaagtaattataactaaaaaaaaaaaaaa

SEQ ID NO: 552642 - DNA, 745 bp, Homo sapiens
  misc_feature (94)..(94): n is a, c, g, or t
aagctttctacgacgattggtcatggcatcgccggtgcccagtagtgtagggtgataggtggtcatagctgtttccttgaggaggatctctggntgatgatcgtagatgcgttggagttcgtgaatccaattaataaaagggcccggagggtgaagccgtgagcgttctggaactaaattacgagagtggaagctccatgatggtcaattacttggggagtctaatcaaaaggagttagaatgcgaagtctcgattatctaagatttatagcctatgtcgtatgtatggttagatttggagtaagatggggtaagttccagcttgacatattcgggagaacctcgtgagttagtgagatgttattccaactggggatcaaagcaatgatcaatgagttagtagaaattcttagacaatgccttactgctttcctgaatccatgtggtcggaaattctttactttaagtagatgcgcagagtactgggaagcatggggatacgggggctgtgtaactatggcctttatatggcactattgctcctttggaacaaggggaatatttttgatcacacgaaaccaattggggaagccggtctcgtttcagaaaacctttgaaacacgagtcgatataatggcgcttgaagactctataggggggtgaattgagtgatatgccttggttaatcgttgaggaagagagactttaggtaatatggcattttgatgtacgaaggggagaattg

SEQ ID NO: 552643 - DNA, 897 bp, Homo sapiens
  misc_feature (2)..(2): n is a, c, g, or t
  misc_feature (38)..(38): n is a, c, g, or t
  misc_feature (333)..(333): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (360)..(360): n is a, c, g, or t
  misc_feature (365)..(365): n is a, c, g, or t
  misc_feature (370)..(372): n is a, c, g, or t
  misc_feature (375)..(375): n is a, c, g, or t
  misc_feature (379)..(380): n is a, c, g, or t
  misc_feature (384)..(385): n is a, c, g, or t
  misc_feature (388)..(388): n is a, c, g, or t
  misc_feature (394)..(394): n is a, c, g, or t
  misc_feature (405)..(407): n is a, c, g, or t
  misc_feature (410)..(411): n is a, c, g, or t
  misc_feature (413)..(413): n is a, c, g, or t
  misc_feature (426)..(427): n is a, c, g, or t
  misc_feature (435)..(435): n is a, c, g, or t
  misc_feature (441)..(441): n is a, c, g, or t
  misc_feature (446)..(446): n is a, c, g, or t
  misc_feature (452)..(452): n is a, c, g, or t
  misc_feature (456)..(456): n is a, c, g, or t
  misc_feature (461)..(461): n is a, c, g, or t
  misc_feature (466)..(466): n is a, c, g, or t
  misc_feature (471)..(471): n is a, c, g, or t
  misc_feature (479)..(480): n is a, c, g, or t
  misc_feature (484)..(485): n is a, c, g, or t
  misc_feature (492)..(493): n is a, c, g, or t
  misc_feature (496)..(496): n is a, c, g, or t
  misc_feature (501)..(501): n is a, c, g, or t
  misc_feature (505)..(505): n is a, c, g, or t
  misc_feature (509)..(509): n is a, c, g, or t
  misc_feature (518)..(518): n is a, c, g, or t
  misc_feature (640)..(640): n is a, c, g, or t
  misc_feature (670)..(670): n is a, c, g, or t
  misc_feature (856)..(856): n is a, c, g, or t
gnccaaggtgattttttggccccccccccccaaacccnatagggggagggtttccgatgggcccctccccccttaacagtttttcccccttcccgtgggaggccccctcttttaaaaaggcctctttttccccccgggggcaccccccccccccctccccgtttttttttttttttattaaagatttttccccttttgccccctttgttttcaaaattaattttttttccccaatttttcccccgtttttccccaaaattttaccgcttccttttccctttcccctttccggtttcccctttttttaaagggccttttggggggccccttttnctttttcccccncntnccaaaaggggnttttnttccnnnccntttnntttnnttncccccnggtttttcccnnnccnncntttttaaaccccnncccctttntttttnttccncccccntttnggccnatttncccanttaccccnntttnngcccccnnccntaacntttnccanttttaaatncattggccccatgcccccccccccgattttttttttttttttcttttttttttttttttttttttttttcccctctcccctttttttttttttttttttttttttttttttttttttttttntttttttttttttttttttttttttttttntttttttttttttttttttcttatgttaggctgatttataagtgctgctttgggcagttacacagtttgtttacaatgaggagttatttgactttgaacatactgtacatggcaattaaaagttgtcatggcaaaaaaaaaccacagttggcctgccacagccaacacaaaaaccaaaaaatggtngatgaaatgaaggaataaagggggggtttattccttattat

SEQ ID NO: 552644 - DNA, 280 bp, Homo sapiens
ccagcctggcaaacacggcaaacatgtactaaaaatacaaaaaattagccaagtgtggtggcaggcacctgtaatcccagcaactcaggaggccgaggcgggagaattgcttgaacctcgggaggcagagtgcttgcagtgagccgagaccgcaccactgctttgtagcctgggcaacagagtgagatgccatttcaataataataataaactatcacatgtaacccccaaatatgtacatcattgtgtatcaataaaaataaataaatgtgaataaaaa

SEQ ID NO: 552645 - DNA, 543 bp, Homo sapiens
  misc_feature (115)..(115): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (142)..(142): n is a, c, g, or t
  misc_feature (147)..(147): n is a, c, g, or t
  misc_feature (152)..(154): n is a, c, g, or t
  misc_feature (157)..(157): n is a, c, g, or t
  misc_feature (161)..(162): n is a, c, g, or t
  misc_feature (166)..(167): n is a, c, g, or t
  misc_feature (170)..(170): n is a, c, g, or t
  misc_feature (176)..(176): n is a, c, g, or t
  misc_feature (187)..(189): n is a, c, g, or t
  misc_feature (192)..(193): n is a, c, g, or t
  misc_feature (195)..(195): n is a, c, g, or t
  misc_feature (208)..(209): n is a, c, g, or t
  misc_feature (217)..(217): n is a, c, g, or t
  misc_feature (223)..(223): n is a, c, g, or t
  misc_feature (228)..(228): n is a, c, g, or t
  misc_feature (234)..(234): n is a, c, g, or t
  misc_feature (238)..(238): n is a, c, g, or t
  misc_feature (243)..(243): n is a, c, g, or t
  misc_feature (248)..(248): n is a, c, g, or t
  misc_feature (253)..(253): n is a, c, g, or t
  misc_feature (261)..(262): n is a, c, g, or t
  misc_feature (266)..(267): n is a, c, g, or t
  misc_feature (274)..(275): n is a, c, g, or t
  misc_feature (278)..(278): n is a, c, g, or t
  misc_feature (283)..(283): n is a, c, g, or t
  misc_feature (287)..(287): n is a, c, g, or t
  misc_feature (291)..(291): n is a, c, g, or t
  misc_feature (300)..(300): n is a, c, g, or t
  misc_feature (345)..(345): n is a, c, g, or t
  misc_feature (375)..(375): n is a, c, g, or t
aaaaaagctaaccaaaattttacccgaatttttacccaatttttaccctttccatttccctttgcccttccggcttccccactttttggaaaggccatccgttcgggcctttttnctttttcccccncntnccaaaaggggnttttnttccnnnccntttnntttnnttncccccnggtttttcccnnnccnncntttttaaaccccnncccctttntttttnttccncccccntttnggccnatttncccanttaccccnntttnngcccccnnccntaacntttnccanttttaaatncattggccctttttttttttttttttttttttttttttttttttntttttttttttttttttttttttttttttntttttttttttttttttttcttatgttaggctgatttataagtgctgctttgggcagttacacagtttgtttacaatgaggtactctcctggaaatattaagaaagactatctaaatgttgaaagaccaaaaggttaataaagtaattataactaaaaaaaaaaaaaa

SEQ ID NO: 552646 - DNA, 1148 bp, Homo sapiens
  misc_feature (1148)..(1148): n is a, c, g, or t
agcgggggggtggggtctgcgtggggcgtgcgtacaggaggccccgggattctctggactaggacggtctggggtacgacgccagtgtcccctcgagctagtcccattctgggattagacagaggacacgaaccggtgaggccggtcggccttacctggcgccagcgcacttcagggaggcgcaggcctggggacgaccatgctcgaggtaccgtaggaagatgctgtgcgagtgatgggcctacattcgcaggtaatcatactcaatcactcgagcccctctcgagaccagggccttagaattagacaccatctagtactccctaggaataggttcggcctgtctagtatgcgtccatggcatgtatgcaaaggcacactggatgggacgccgcgactggattggaggtcgtggtaatgcacaggagcttctagaggagaacgcgttgcagaaccccgtctcgtgcataccgggaagggaatccaccggggcacggggaagaggaaagggccacgccactacgtttgggtatgtgcctgacttgcgctttacaagttaactttgctcccccgaacccgaataccttcgccaggagtagcgcaccgcgtcccgcatacctactcgcaatgtcttttggaacgaaaactatattattcttatgcccagaagagaattacagtcagggtttttttcaccaaggttcccatttgtagcaggtgaacgccattcgagtacataactgaaatctcttggagttggagaaaatgtctttcaaaggaagtgattcactggcatttgtccggagaaacattatcatgacggcgctataagtgacccgaaagtaaaagacaataagttcgttctcccggctggaaaaagataaaccccagggatgtagacgcagaagaattccgcaaagattaagcgtggaaggtggacggcggaaggaacccccactttttccaaggatggcaaccggaacgaggaacgggttaacagggaaaaatggttccgttctaaaaaggtttagtgccccctgtcgattcggcagttgtgcctttctcacacggtgtgccgcgaacagaagggcctcctttggattagtgttacccgctttttggattactttccctgtatggcgaaccan

SEQ ID NO: 552647 - DNA, 152 bp, Homo sapiens
tggcgtgatttctgtctggttctgaatgctctgatcactctgggggcacaagaaaaaaagaagactattgtgactgatggtttcccagggttcaatagaggatcttcactaaaaaagttcccccatcctggatctgccagcagaaagaaaaa

SEQ ID NO: 552648 - DNA, 396 bp, Homo sapiens
agccattcctttggtcttttccaactccttgggcctccctgttccctaagacaaaaccgttttgaaatccagacaattaataaccctacaatggcttataagtgttcaagggaaaggaagagtcacacatctctcactttaaataaaaaaactacaagtgattgggggtggttccaagatggccaaataggaacagctccagtctacagctcccagcgtgagtgacgcagaagacgggtgatttctgcatttccaactgaggtaaccgggttcatttcactggggcttgtgggacagtgggtgcaggacagtgggtgcagcctactgagtgtgagccaaagcagggcgaggcatcgcctcatctgggaactgcaaggggttcaggaattccctttc

SEQ ID NO: 552649 - DNA, 865 bp, Homo sapiens
aattcgatgcagggcccgggttttagttgcataattactgggccgttgtcgacaattacaagctggaatctcagatctctagaactccaagaagagctgaagtactggagcgtagcttccaggaataaagctgaaagcaaaacgggacctgggaagagctagaggcgctgaaaacagagtggaggacacgctggataccacagagcttgcccagacagagagctcaggtcaaaacgtagagcaggaggtagaacatacctagaagaagaccctggaggaggaggccaagacccacgaggcccagatccaggagatagaggcagaagcactcacaggacgaggaggagcaggcggagcagctggaggcagacgaagacgggtgaaagcaaaccatcgagaaggcaaagcagactctaggagaacgagcggggggagctggccaacgaggctgaacggtgctgatgcagggcaaaggggactcggagcacaagcgcaagaaagtggaggcgcacgctgcaggagctgcaaggtcaagtacaacagagggagagcgcgatgcgcacagagctggacgacaaggtcaccaaagctgcaggtggagctggacacacgtgaccgggggtactacagcccagctccgaccagcaaagtcccagccaagctcaaccaagggacttcttcccgcgcgggagtcccagctgcaggacactcaggaagctgctgacagggaggagaaacaggaagacgctgggcatgatgaaccaagctcagcagtggaggcgaaaaatactacgaaacaaagagagaaggagagccagcacacgagtcaaaggcaagagcgcccgccctctacagagacgctcga

SEQ ID NO: 552650 - DNA, 310 bp, Homo sapiens
agcgagatgtacaatcagctggtgaaggatctgttcaaaaaatagtggatcttttgcaatgtttatatatacttcttcagcgtgattatgttgtatatttccagtatactgtgattgctggaactatagaagatatatggttgttgaaatatttaatgtgagaaaatattattccttggttcatttcccatctaaggtcgataattgtttcatagttgtagtagagttacccatagaattttttcaagaggcaggacctcagatttatggttgattgccccatactgttggtgctgttgtggggtatgtg

SEQ ID NO: 552651 - DNA, 153 bp, Homo sapiens
tgactgtccgctgctggcgccactgaggcggctcccagctgctgttggggactatggctgacacccccagagtatgcctgggtcaaagcaggcgcctgcatcacggaacgagaaggccctggtggacttcgggtacgtggggattgactccat

SEQ ID NO: 552652 - DNA, 429 bp, Homo sapiens
cggtggctcacacctataatctcaccactttgggaggccgaagtgggaagattgcttgagcccataattttgagaccagcctgggcaacacaataagacccatgtctctaccgaaaatgaaaaaaattacctgggcatggcagtgtgcacttgggagctactcaggaggctgaagcgggaggatcacttgagctcaggagttcaaggctgcatcgagctatgatggcaccactgcagtccaaactaggagacagacctagaccctgtttctaaaaataaataaataaataatcttggcatttctcatcctaaaaaaaaaaaaaaaaaaactctagggggggcccggcccccaattcgccctataagagagtcggataacaattaactggtccgtgaatttacaacggtcgtgattggagaaaaaccttg

SEQ ID NO: 552653 - DNA, 503 bp, Homo sapiens
taaggactcagattgtatctttgtacagaagaggattctcctgcctcagcctcccgagtagctggaattataggcgtgcaccaccacgcccggctagtttttgtgtttttggtggggacggggttttgccacattggccaggctggtctcaaactcctgacctcaggtgatccacccgccccggcctcccaaagtggtgagattacaggcgtgagccagtgagccagccttccttttcagtttttaaacataatttttgtttcatccacaacttttcaagtattgccagtagaataggaacatgggttcttagtctttagctatctgttacagcctatgaatgcgttcttaaaatcatgtttttaaatgcatccaatatataggattccaaggggctctaattatatcgaaatcccgttattaaaatgttgggccctcagtttgttatatattaatatgcatgcttctttataaatgcattaaataagagttaatagctaaaa

SEQ ID NO: 552654 - DNA, 511 bp, Homo sapiens
aggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataa

SEQ ID NO: 552655 - DNA, 548 bp, Homo sapiens
gtcgtcgatctagaggatcctgtttacttaacccgtgtggccaagagtagctcgtaggaggcctttaaagacggaacatgtaatatacagttctactgtggttctgcccacggtccaagtgggcgaggctaagaagagggccttcctaaggcaaaacataagttgcactgtgtgggtgcagccaaaacaaagaactgtgtgttgagtatcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactgggttaagtaagca

SEQ ID NO: 552656 - DNA, 730 bp, Homo sapiens
  misc_feature (259)..(259): n is a, c, g, or t
  misc_feature (503)..(503): n is a, c, g, or t
gggtcttgctgcccaggcagcacctctggtagctgttgtgccgtctgccgattgtcagtctctgtcccttatcattgtaggtgtcagataacaagtgacttcggctggctcatccccaaggtcatgaggatctatgatacccaggtacggaaatggactagagaggcctcgccgcatgctagtcgtctgcagaaaccattgttaaactggctgacttgaatgcttgtccctctcctacattatttgagttggaccctgncttggagtgggaggggtacgttacttattcgaggagaacgacactgtggtgactctcctcatgcatccactcacaatagctgcaaggtctccaaaggaagattgactggactgggtaggcgtctcaatggtaatgtgtagtcaccgtggctgcgtccagagataagcgagcaattattcaggtggtttcccgaggaccctctgatagtactctctagcgatggttctcaggcattcagacccangctggactcaaggaacatcagggccaccgcgactattgataggcacggaccatggctgatgagcattcctgtttgtctttcattgaacgctttgcgttatggggagcaactacattatagatgtcatctgaggtagagaggtagcagctacagacagggaatgatgactgaaaggtactgggtcccaacttctggcggatgaacatggcgtgagtacagtacaaccc

SEQ ID NO: 552657 - DNA, 212 bp, Homo sapiens
agagattgcagcaggaagcgggaccgggcaagtggcagcaccaagcagcccaacgtgttttcacgtctttcatgttgacagccagatacaggagttcaagaagctggggctctccacctaaggccccatccacaggcttagcttatcgacagattgtattgcatattcaagcagcctaggaacctatccacttgtcttcaccctccacctgg

SEQ ID NO: 552658 - DNA, 439 bp, Homo sapiens
  misc_feature (58)..(58): n is a, c, g, or t
  misc_feature (135)..(135): n is a, c, g, or t
  misc_feature (168)..(168): n is a, c, g, or t
  misc_feature (438)..(438): n is a, c, g, or t
acccaaccctgtgccctcccttgctcccgggatttgtggtttatcctcaaaagggaanacccttgaatacgactgctgtttaccaaaattaagaaaacccacccattgaaaaaacctaaggtaccccgggtttancttgtcatctgttcctagaaatggtggcctcanaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatatnc

SEQ ID NO: 552659 - DNA, 148 bp, Homo sapiens
agcatgtggtttgtgcaattccagaactctgtggtctgctctgaaggagctgtcactagatgcctggagtgcttgacgcctgcaatcacacaggcactccccctagtaccaaccctatctgcctacgccactgggccccatttcccct

SEQ ID NO: 552660 - DNA, 203 bp, Homo sapiens
  misc_feature (201)..(201): n is a, c, g, or t
cctgcctggggtctcacctgcctcccagctcttgcctgcaggacggacgtgctctgtggcctcgggcaggagccgaccctctcagggccaggccctcgaaggtgggccctttcatagcttcctggcacagatgggctggtgggagcctcagaggagacgtcggtacaggctggagactttgggtgctgggtcgccatgtanaa

SEQ ID NO: 552661 - DNA, 116 bp, Homo sapiens
ttatattgatcatacgttgatattaggacgctgcaatataaaccacggaagcgtgtctgaaaaacgcaaactatcataaatttcatacatagttgtaccgtatctgctcgagagag

SEQ ID NO: 552662 - DNA, 186 bp, Homo sapiens
cttttgggttttccctggggtttccggcctattttggtctttttccgaataaaaagaaatttcaaaccggggggtattactttgtttttgggccttcccaggggctggcccctccccccttcctttttggggcctgaggttccaaggggttttgaagggctgttttaataaatgttttttaaccca

SEQ ID NO: 552663 - DNA, 3578 bp, Homo sapiens
  misc_feature (9)..(9): n is a, c, g, or t
cacgaggcncacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaacatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaattaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactgtgggaggccaaggggggtgaaccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacctgggaggtggcagttgcagtgagctgagatcgagccactgcactccagcctggtgacagagcgaggctccatctcaaaaaaaagaaaagaa

SEQ ID NO: 552664 - DNA, 1383 bp, Homo sapiens
  misc_feature (9)..(9): n is a, c, g, or t
cacgaggcncacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaacatgctaagacatcggttctattgcttaataaagttgatttactctggga

SEQ ID NO: 552665 - DNA, 1194 bp, Homo sapiens
  misc_feature (9)..(9): n is a, c, g, or t
cacgaggcncacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaacatgctaagacatcggttctattgcttaataaagttgatttactctggga

SEQ ID NO: 552666 - DNA, 3029 bp, Homo sapiens
tgtcaactaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagtcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaacatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaattaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactgtgggaggccaaggggggtgaaccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacctgggaggtggcagttgcagtgagctgagatcgagccactgcactccagcctggtgacagagcgaggctccatctcaaaaaaaagaaaagaa

SEQ ID NO: 552667 - DNA, 168 bp, Homo sapiens
gacgcccgtttacacgcaccacccctgggcgggctgtgcggttcaggccctcccccgggaccggcccgtgtcccgccccgtgtcccgcctcgtatttgtgcggcgccagctgtttctgattcctgtgttttagagaggctgggcttgctggcgcagtagctccagagg

SEQ ID NO: 552668 - DNA, 359 bp, Homo sapiens
ctgaaactgagtaagaaaggttctccaagatgtatgattatacgtccttacaccataactcttcattaaacacatctcagttttgacctgactcactggggtgtcaagcggctactcaccctgcctcaactacgtcagctgcacctatggaaagaaagggctcacaggttacagatagagcttgatgagctcatcgctgactgctgagggtgtcagcacgcccaaggtctgtaacacagcacgagtgattaaggaaggggcagtgtagtcaaaccacggatgctcctctttgagagtcttgttcagtctgcgcgaaccttaagcgtgtctgcccttatacttaaacttaatctagggac

SEQ ID NO: 552669 - DNA, 123 bp, Homo sapiens
ttcgagtcccgcatcttccaagctcttcttgagcttgagatgaactccgaccctaaggcttaactcaaggagcttaatattacacgcagctaaggaaattgaaggttgggtgtgtgtcggaaa

SEQ ID NO: 552670 - DNA, 143 bp, Homo sapiens
  misc_feature (15)..(15): n is a, c, g, or t
  misc_feature (31)..(31): n is a, c, g, or t
  misc_feature (37)..(37): n is a, c, g, or t
agcggcgggggcggntgaggcagctgtaggncgagtntaggaggtcggctcagcagcagtttgaggagctgctgccctcaaagccaagtccctccttgtggtccatttctgggcaccatgggctccacagtgtgcacagatga

SEQ ID NO: 552671 - DNA, 311 bp, Homo sapiens
  misc_feature (279)..(279): n is a, c, g, or t
taatgaatctgtgttgtaacttaacaaaagtcaaacttgaatgtcttttcctactccccaaaatgttattgaataagaatgtgtgccataagatattgtgtgaagcataaaatatttctcacctttttcttctttgtaatactgactttaaaatagaaggtctgtagcaaaagtttttccgaccaaatgaaacagaagttattctgtggttatcccactagcatctataggagaatggtgtgaacccgggaggcagagcttgcagtggagccgagacgngcgcactgcacttctagcctgggcgacagagc

SEQ ID NO: 552672 - DNA, 330 bp, Homo sapiens
  misc_feature (287)..(287): n is a, c, g, or t
  misc_feature (310)..(310): n is a, c, g, or t
gtgagagtccgtaagagacagcttccaggatcctgagatccggagcagccggggtcggagcggctcctaagagttactgatctatgaaatggcagagaatggaaaaaattgtgaccagagacgtgtagcaatgaacaaggaacatcataatggaaatttcacagacccctcttcagtggatgaaaagaagaggagggagcgggaaagaaaggcagaatattgtcctgtggagacagccgttcattacctggcagtatttttctctggaaatccttgtaatcttgganggattgggcctcaaaatttttgngcatcgtcaaagcattgtgt

SEQ ID NO: 552673 - DNA, 817 bp, Homo sapiens
tatggaatgaggtcccctgccttcattcctagtgcccaccataggcgaccctctgcccactctgtaaaagaggggcttgccgtctgtggggagggatattaggaatgaggtctccctgactgtgagctagctggtgacccatgaaaagtagtgactttttctcctaggaccacgcatcgaggcaggggactcagttcctagtgtccccactcctatagtgcaagcactctgcccagctctgacaacagagtgcggctctgccgtcgtggcgtgagaggattatatgccgggtgtggatcccatgtccaatcctggattgtagtgtatagtttgtgcattctcaacgcatgttaacttagagtgtttgagtcacttaataacagatattgccttcaaatttaccttcactgcgagtgttaactttcgccatgtactaaaggccgaactcataaattgatgaaatatccctaatgatcgcccaaagttgcattaaatatcccatacagagccatctcgtaacagttggaaacatggtgtaaatttgaaccactgttagccgtgtggggacagtctgtactgtcgcatggtagcgcagatgcgggtaggggcccagcgagaggataccttattactctcatgctagtgtggccctgtgtcccacagttccccatgatttggctacatgactccgcatgccctctggtgctaccctgagcttgggcgctaactatcctaggaacgcgggggagttggccaatggcaccgggctcaactccttgtccgcctttcccatgtaattctttcacacaaccatcac

SEQ ID NO: 552674 - DNA, 434 bp, Homo sapiens
atggaatcctggagaagagttagatatattttcatagtttatgcaatattccttaagagggttaaaaaactagaaaataaacactgtggagtaagttaagtcaattttcttcagcctgagtgaaatagtttgcaagaacctcttgattctatttgccaagattccctactcaacaaatacatgctgcattttaaaaaattaccctggtctgggtgcagtggctcacacctgtaatccctgcactttgggagaagaggcaggaggatcacttgagcccaggagttcaagactagcctgggctgtagtgagaccgtgtctctactaaaaataaaaaaaattagcccgatgtggtgacacatgcctgtggtcccagctacttgggaggctgaggcgggaggatcccttgagccccagaggtcaaggctgcagtgagc

SEQ ID NO: 552675 - DNA, 308 bp, Homo sapiens
  misc_feature (1)..(1): n is a, c, g, or t
  misc_feature (94)..(94): n is a, c, g, or t
  misc_feature (105)..(105): n is a, c, g, or t
  misc_feature (108)..(108): n is a, c, g, or t
  misc_feature (118)..(118): n is a, c, g, or t
  misc_feature (122)..(122): n is a, c, g, or t
  misc_feature (289)..(289): n is a, c, g, or t
  misc_feature (294)..(294): n is a, c, g, or t
  misc_feature (296)..(297): n is a, c, g, or t
  misc_feature (299)..(299): n is a, c, g, or t
  misc_feature (301)..(301): n is a, c, g, or t
  misc_feature (304)..(304): n is a, c, g, or t
ngcttcgagttggcaccaagtttcttgttttgcttttttttttcttttgaacaaattaattacacaccaacaatcttcttttattacaacatgnccccaggtggnggnaaggagtctngggnggacagggagggaggactgaggtggttgtgaggacaagcaccaaaagctttcttcaggtcgcggggggccctgttcggctcccgcagcgcgaaattcctttaaaataaaaaactgtgagcacggctatgtgaagtttcctcctcctgggtggaacagtcaggggaanggagntnnananggnggta

SEQ ID NO: 552676 - DNA, 297 bp, Homo sapiens
cagctactcgggagggtgaggcaggagggttgcttgagcctgggaggcagaggttgcagacagccaagatcacactactgcactccagcctggcaacagggtgagaccttgtctcaagggaaacacaacacaactgcagctattctttctaagggttctggaaatgacagacctggattaacatccagattcagttccctgccattgagaggtccctttgcctgtttgggatatgttgtcagtcattccagctgtcttgagtacttacagagctattgcaccaagaagctcatactc

SEQ ID NO: 552677 - DNA, 201 bp, Homo sapiens
atcaggcgatgactgtgcggatggtgtgcccaaggtaatatggcggcaagttgcaagctggttgaggagcctggagcactccctttccaatagcccttggacttatccacacatgggagcggagagtgcccgtatttgctgggtaggtggagcctacccagggcgtggtgaagggtagcttggccacagtcttcgcctgat

SEQ ID NO: 552678 - DNA, 130 bp, Homo sapiens
  misc_feature (32)..(32): n is a, c, g, or t
tatgtcactgaaacaagtaactgatggttatnagtgattttcagccagcttttcttcatttcgccaactgactctctgaattatggtgaggaacactgcttgggttcctgtcacagttcattataaaggt

SEQ ID NO: 552679 - DNA, 100 bp, Homo sapiens
gccaggccctctgcaccattctctaccatagacctctgtagtctaatccattctacccaatataaaggtatagggcactggagttctgagaccctagggc

SEQ ID NO: 552680 - DNA, 497 bp, Homo sapiens
gaccgcggagacgaaagggggtgatcggtgagggcttcttgctggggggactctctacagagtctggaggcagcacagggcatcccatagtgaggaggctgagtgtgttagctcagttctctcttcctctttttataaaaccaccagtcccattcctgtgataaaccactaattcattaactcattaatccatgaatgggttaatccattcatgacggtggagcctttatgatccaatcaccaattaaagtctctttattttttctttcttctttttctttcttctttttctttccctccttcctttctttccttccttccttttcttttctttctttccttcctgtctttcttttcttctttttcttctttctcttttccttccttcctccctccctctctttctctctttctttcttcctctttctctgttctttctctcttttccttccttccttcccttccttcctctctttctttcttcctttcgtcccccg

SEQ ID NO: 552681 - DNA, 172 bp, Homo sapiens
cttccattcaagacgtaacaggacattcacacaatctgcttagcccgagtgacagcctcagcatacttctgctgctttcaggaccacagtcctaagcccatccagccagcaggtatgccagaagccacagtggctaggcaagtctaggcagggtaccgacgctcgacattcg

SEQ ID NO: 552682 - DNA, 116 bp, Homo sapiens
taataaatggcaagatcaagataaggaaggcatccctacctgatcagcagaggtgggatttattgctagggaaacagctggacaatggacgcaccctgtactagactacaacatcc

SEQ ID NO: 552683 - DNA, 400 bp, Homo sapiens
  misc_feature (1)..(1): n is a, c, g, or t
  misc_feature (11)..(11): n is a, c, g, or t
  misc_feature (34)..(34): n is a, c, g, or t
  misc_feature (80)..(80): n is a, c, g, or t
  misc_feature (85)..(85): n is a, c, g, or t
  misc_feature (88)..(88): n is a, c, g, or t
nacttttggtnaccggcgcccgcgctggccagtnggacagggtttttttttttccaagaaaatatttaccctggagaggngaggnatnacttatcatcccagaaatcccaaggacaaaacttcaagatacaagaaggatcaaattatatcatatatacgattcaatttaaattttcttagccctcttatatcatattatctagattataatagaaaaaaaacaagttggcttcctaggaagctttcataaaaagaaaccaaatccaggtttatgaaattttctagtacaattactttctaggggcgccttttcttaagtcacagtctttataattccatttgcctcttcgtaatttttaaaattggaaagcggggggatgggggtggaagtgtaagtttt

SEQ ID NO: 552684 - DNA, 143 bp, Homo sapiens
tttaaattatactttaagttatgagatacatgtgaaggggtgagatctactaagctagatcacttggctccactgctacagcccctttccaggagagtgaacggttctgtcccaatggtattacaggcaccacttggatatga

SEQ ID NO: 552685 - DNA, 1586 bp, Homo sapiens
ttcgctgattagtatccgtctggatgtttgcatttgatcttgttggctgtcttcgttgcggtgagtgggttcgcaccactgcgggatgttgtgttcctttcgtatcgtggctgctctcggtttgttccctctgtcgcgtgggtgttctctgttctgtgtgctctttttttgtggtacgccactttgttgatacatggttaccactttttccagcttgtgtgggggtggtgagcatccctccctctctgtagagtgcgattcttcattttcgcttagttggcgtccgtgatggctgttccgactcatttgctctgctagtgctgcatgactaatttggtttttccgcgggtagatttcgtttatagccgaggggttccctgctcggtggcccctccccgtctgtgtggtgtggttgcagcacgcccccccccccttaggaggtcgttggggtggttggtagagtcactaagtgtcgccccgcccgtcggtttggttttgtggtttggtgcttttggcagatttgtgggtgctccgctttgtgctgtggtgctgatctccgtttggagcgacctgtttctcccacacgggggtgtatttttagtcatatgtctcgggaaggtgtctctatttgctagagtgggagtggtgtccccctattccccggttagttggggagggggagtctccacctttttttgtttttctttgttgcttcttgtgtgtgtctctgctcgtcccatcatggtgcgggggagtgttggtcatcccacactgtgggtcgcgctcctctctctctgtgggagtgtcctgtcttgttctcgcccctgggtgtgtcccctcccgcccgcacgctggccccgctcatcgcgtggttttgtgtgcccacacgccctctttgtgtgttatcccccacactcgcccacctcccgttcctcgcccactagtgggggttgttgcgcacgccccacgagttttcttgaatagagggtgtgtgtctctctgggggggcacaccatactgcgcccccgccacacagggtgtgtctttctgtgggcgtctatgttaccccccaccaccgccctctggcacgtgggtgcagaccacccccccgcgttttttgtcacatcgcgctctgttcgctcacagaaaccacggggccttctcgggcacaggttgcgcccctcgtgttcgcgtgggcgcttttttttctgtgggtgttagttttggtctcgtgggtgcctcttgcacttttgtggaaaataatataggcgcgcccgagctttgtttggaggccacgagcttttctcccgtagcccccacttggccaccactcaggcgcgcccagtcgcctgggtggcggtgttatacccccgcacttttgttgcgtgttttgtgcccctctcggtggaggaattcgccccctctcctcccgtggggcccccgcgtgttggagggttcttcttcactttgagtgctggtggatttttcctctgggcggtgcccggaaccaccctctttttttccccccttttttcctcgggaggagctcttttttattgtgcattaatatccccgggccctgttta

SEQ ID NO: 552686 - DNA, 509 bp, Homo sapiens
gacagtatactggtacgagaaaactctctgacttacatatgagtgaaggcacatcattggctgtggtatccatcttggctatgaccgatattagggtctttgctgcgcttctcgcgacgtcctttatacttgggcatccaggttcttacagtgaccacaccaagtggcataaaattcaatcagaacatctttattttcattattcactatttcatcaaaattctctgctaccactaccttcacaggcccatcattgctctctgggataggtccagccttcaggtatctcttcagattgccatcaaagtaatcctgcaggcacctctccagagccttcccatcacgcgagaactcctcctgcttgacaaacttctctcctttagcagttctagatagcaacaacaggaatctctccagcagtgctctccaagccacactcagaaagttcatggctaaaggttttgcggctcgataacggacacgttgaagtattgtgcccggatcccgga

SEQ ID NO: 552687 - DNA, 173 bp, Homo sapiens
gagaaaccggaggccaccttggttcatccactgcctgttgccgggaccaggggcgagggcgttagtgcaagggagagtcgagggccgtccatgcacaatcattccgaccagcttaaggggccttagaatttgggggggttgaaagtgatgagggctagcattgcgtagcctag

SEQ ID NO: 552688 - DNA, 160 bp, Homo sapiens
gcttcaatgcaacaatgttttgtcgtatctgctccaggtggaagacacgctttgtttcaatgctaaaggactagaagcaagcactccagttaatgttacagctcaatggtcacaccacaggaaaaacagcattgatacatttagtagagagatataaaag

SEQ ID NO: 552689 - DNA, 116 bp, Homo sapiens
gcggccgcctactactactactactgctcgaattcaagcttctaacgatgtacggggacatggcataataggtgttaaaaaaaaaaataaaggacctctgggctacaaaaaaaaaa

SEQ ID NO: 552690 - DNA, 980 bp, Homo sapiens
gctgttgtcctgtaaggcgagagctgcgaaaggcgagagctgcgaagggccacggtgtcgggcgctgctttctcgtgtttcagtcattataggacaaaagcagccctgctgtaaacgatggtcaacgataccctaaaacccgaagaaccttctgtaagaacgtgtggcaagcattcatgcctcaccaacaggtgatcacagtcataagaagggcagaggatgtctttgtatgccctaagggataggtagggcgctatgatcggaagcagaggtggttgatggggggcagacaaagaccgattgttccggaagaagggctaagagcatcaaatgaagattgtgctaaggctggacattgtgtctgagcctaactgttagatccgaagcaggatgctggccattcatagagatgcaagcgatttcgaactgggagcgagataagtacgagcaaaggggcaagtgatccagttctaaactttggggatatggattctatcacattcctgactgcagagaatggtgaaagcccatagacgagagttacccgtaggtgaccacgtcacctagcagctgattatgtcctcgagtaaagacatggctgcgagacacacgaaagcaccctcggtgttcgcacagtcctgcagcctcactcccacgaatactttccatcaacacggcccacaatttccggaagcgcccacgcgcacccgcccgaggcgtcaccgagtggcgcctccgtcgtcaacaacgccgagtaggacaccaaccgcggagaacacactggcgtggcacacaaagcaaagacacggcgagtgagagaagcaacccaccccaagaaataaagcggcgggcggaggacttccgggacgcatgagtgtagcaccacacaccccggcagaagagcttgcagaaggaaacgctagtcggacacgcactacagggaggcgactaccaacgaacgcttcaaaccaagaaatcac

SEQ ID NO: 552691 - DNA, 358 bp, Homo sapiens
gggtacctatgcctcattgatgtttacctatgagccccccttgcagactcaagcatcccattgtttgcccttttaaatatctctactagccgggtgcgtgtgtcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaatttcttgaactagggcatcaaaagttgcagtgagccgagatagcaccattgcattccagcctggtgacagagagcgac

SEQ ID NO: 552692 - DNA, 203 bp, Homo sapiens
cttatatatagtggtatactgccccttgatagatgagacaccttgctatgtgtaattgatgaagatggttattgtctacgtgatgtgctccagtgctgggatgtatgttccctgctaagtggattggtacacttgttcaaccttgttccttgctcctgtgcctctaactataatgcatgattgctgagcatgtgagtatggat

SEQ ID NO: 552693 - DNA, 265 bp, Homo sapiens
  misc_feature (111)..(111): n is a, c, g, or t
  misc_feature (172)..(172): n is a, c, g, or t
  misc_feature (229)..(229): n is a, c, g, or t
tgataatttgctagaaggactcacagaactcagaagggcatcctactcacacttacagcttattacagcaaaaggacacagattaaaatcagctcagggaagaggcacgtncggcagagtccaggggggctccacacatggatctcccagttgtcccctcccagtggagttncgggcagcgctgacatctcccagcaatgaggtctgacaatgcacacagatacgtttntcacttgacatttggacaacaaggatgtgtggcgtt

SEQ ID NO: 552694 - DNA, 518 bp, Homo sapiens
cgtggcagagctccccacagcccgagggccaaccctgccctgaggtatctgcccacgaccctgcacatcccattcttctcacagagccacccagcagatattgaggggggacgctgcaaattacaccaacaacaccttgagtggtgtttcagttaaggataatgcagtaattttagagctgtctgatggggttgtggctatgctggcagcctccatgacgttgcctggtctggaggggcttctggaaggaccatgtttgcatgtggccattgaggggcctggcccagccacaggagggcaggggtccagcagtccttttccaggcctgggatggctggagctgccagccactgctgccatcccattaccagagtctagggggactgggtgcggtggctcacgcctgtaatcctaacactttgggaggccgaggcaggcagtcacttgaggtcaggagttcaagaccagcatgactaacatggagaaactccatctctactaaaaatacaaaaaccagc

SEQ ID NO: 552695 - DNA, 407 bp, Homo sapiens
gtgccatcaaccaatgagtagataagaatatgtggtcaaacacacaacacacacacacacacacacacacacacacaccatggaataatactcaaccataaaaaggaatgaaatgtcctttgtagcaacttgggtggaactggaggccattatcctaagtgaagtaactcaagaatggaaaactaaatacagcatgttctcacttataagtgggagctaagctatgggtatgcagaggcacagagtggtattggaggaccctagagactcagaagggtactgggtacaatgtatactatttgggtgacaggtacactaaaagcacaagcttccccactatacagttcatccatgtaaccaaaaaccatttctacccctctaaagctactgaaatagaacgaattaaa

SEQ ID NO: 552696 - DNA, 142 bp, Homo sapiens
atatacatcagctcgccccaccttcgttactgtaaacgattatggatcatgcccacaaggcatccaagctactggctgcatcgaggtgaggggtgaagggtctgtgctagatcaaaaggcacggggtgccgatgaatagcga

SEQ ID NO: 552697 - DNA, 238 bp, Homo sapiens
ctccaggacttaagcttggtcagcagaggcgattgttgaactcaggagtcaagagcagctgggtaatgtcaggtctctgagcccaagctaagccaccatatcctctgtgaccggcacgtacacatccagatggccttaactgatgacattccttcacaaaagaagtgaaaatggcctgttcctgccttaactgatgacattcccttgtgaaattccttctccttgctcatcctgacca

SEQ ID NO: 552698 - DNA, 299 bp, Homo sapiens
tgcccatgctgccaacttatcgcaacctcggaggggactccattgcgatctacacctacgtcaaccggcgcagacctacaggggtaggaggtaactatcaagatgagtgggtgtgtaactcggttggttgcatccttgaggcgataagatcaacaaatggatgaatacggctttagagctatcaatgattttgggtcagtaacgatatccagtacttacaaagttctagttttttctgaacgtgggacctatcaggtgacctcgcaatacacggatcgcggtggcgagggctcagtctc

SEQ ID NO: 552699 - DNA, 125 bp, Homo sapiens
acacaggcagacttgaccttgaccagatagtcttcaagatggccaaactggggcggaggcgcaaaaatgtggagcctgtgaaaagaccgtctaccatggcagaggaaaatccagtcaatggaagg

SEQ ID NO: 552700 - DNA, 1393 bp, Homo sapiens
taagaaatgtaaccccatgggggttttccaggggggagtgccaataggtggaacatctccaaaagggcaagcgtggtcctagcgtggcgtggcttatttaaggtgactattttttatcctcaattctcatctcaagcccacgttatttacgtagaaaaatctctctgtgaaagtagaaaacagggttaacacgctacattttcggtgcgcatattttattttctctgtggttgtgtggtctctctcaggagagtgtgttctttgtgcacacacatattgtgtggtgagaacacgccacacagagtggagctttaacacagctctgtaatagagagaggacgcctctgagaagcgcacacaccagtgtagggcggtgtgagacaaaaatattctctgtgtgtgtgtacccacacaaagagagcatctcttctcttatatatcttatctcacacacagagagaggcactatattctcacactctctgccgcgggacacatatatatatataccatatataagaagaagtgttataacacgcgtataaagtgtggcacacatagatgtgtgtgtatctacacagacgacgcgtgtggacaaaacacaacaaacaagagagaggcggcggcgcgcgcgcctacaagagagatatatcaccctcgcgcgagagggggggcccaccaagagctcctatagagccgcagcgactcacacacacgcacagacgatatatgtcgtagaggcgcaacaacaccagaggaggggaggcactctcatatatagagcgagaaaagcgcgcgatactatcaataataaaaagccctagaaggcaccacgacgagcgcgcaccgcgtgcagagtactttaaaaaacaaaactgcgctgcgcgagagacgcagggggggggaaaaaaacaacagcgagcacaacaaacatagaagagcaaaaacatcaggggggcgacagacacgagagaacacgccccctaaaaaaaccaccgcgagggggggggggaggaagacaccacaatataagtgggggcaacaaccaaaaaatcacaacacccccctcacacaagaagaacgaacaatatgagctaaaaaaaaaaacgcctccaagcaagagcggggggcaaccacacatcatcgatcagcacaaacaaatcatcacaatcacaaggcgggggaaacaaaaaaacaaagagcgggggggggtacaacaacacaccacagtcaagcgccgcgaccacaacaaaatatatgaggacggatgaagagtcgacgcataagaagaaacacgaaacgaagtatgaggggagcagacacaacaaccgagcgaggaaccaaacataaccaacaatatcaaaggaacaccagacacatatattataaacag

SEQ ID NO: 552701 - DNA, 220 bp, Homo sapiens
cgactctgcaggatccttatagagacagagactctggcatacacactcaattactctagtcctgtttcactcctgtgtgttctattcatgtcccaattccctttgagactgcttgggacatgggagggatgcttggaggttgggacatgggagggatgcatgggacatgggagggatgcatgggacatgggagtgatgcttggaggttgggacatgggag

SEQ ID NO: 552702 - DNA, 654 bp, Homo sapiens
gcgggttcgtgaacttcccggaggcgcattgagctgcattaacctgcccagctgtgctgcccggctcccccagacaagaccggtgggctagatccaggtgattctcggggccgatgttctcaggaaaaagcacagagttgatgatgaacgcgtccgtcgcttccagattgctcagtacaaggtgcctggtgatcaagtattgccaaatgacggcgtcgctacagcagcagctttcttgcacacatgagcccggatacaccaatggatggctgcatgccctgctgcccctgctccgaagatccgtggcccaggagggcctggtgctgtggcatgtcatcacggcgtcgacgacggtggcaagtttttccctgacatcgtggatgttctgcgagggcatggccaaacgctcgggaaagacctgtaattgtggatgaactggatgggaccttccagaggaagccatcatggggccatcctcgaagctgagttgcctgtgaggctgagatgcgtggtgaagctgactggcggtgtgcatggatgtgcttccgggaagccgcctataccaggaggctcggcacgagaaggaggtcgaggtgattgggggacgcagacaagtaccactccgtgtgtcggctcatgctactacaacaaagg

SEQ ID NO: 552703 - DNA, 525 bp, Homo sapiens
catgagctcaggatttgagaccagcctggccaacatgttgaaacccatctctactaaaaacacaaaaatttcccgggcgtggtgccagcgcctataatcccaggtactcaggaggctgaggcaggagaatcgcctgaaacctggaagaaggcggttgcagtgagccaagatagcaccactgcactccagcctgggtgaaagagcaaaactccatttcaaaaaaaaaagctgcaagagctcatcacaagcagaccaacaccacagaaaaggtaaagggagtgaggccagcggaagggaagcaacatcaggagcatgagcccaccaaggtggagaagcgtggcagggacagggatggggatggcaggagcaactgcagagctcttctgcagtctttcaaacagaccactcggctgggcgtggtggctcatttctgcaatcccagcactgtgggaggccaaagcgggcagatcacctgaggttgggagtttgaaaccagcctagccaacatggtgaaacccccatccc

SEQ ID NO: 552704 - DNA, 792 bp, Homo sapiens
  misc_feature (69)..(69): n is a, c, g, or t
  misc_feature (82)..(82): n is a, c, g, or t
  misc_feature (97)..(97): n is a, c, g, or t
  misc_feature (116)..(116): n is a, c, g, or t
  misc_feature (147)..(147): n is a, c, g, or t
  misc_feature (152)..(152): n is a, c, g, or t
  misc_feature (165)..(165): n is a, c, g, or t
  misc_feature (175)..(175): n is a, c, g, or t
  misc_feature (197)..(197): n is a, c, g, or t
  misc_feature (768)..(768): n is a, c, g, or t
  misc_feature (783)..(783): n is a, c, g, or t
cgcaagctcctacggacaagagtagggcaccataggggggtcccatgcccgggttgtccatagggatgncttagaatttgcntatttagtcatgacncagaaagtatgtcccaatnaggccctatttcaggcacggtgaactatatnaaagnagaaataaataanccgtgaagtncaatgttccaacacaaggcagntacattttaaatataaaacaaatatttaggagctcagaggaggcagatgtgacagctgcctgaaacatcaggggacacttcttgggtggcatgggaagtgtacaatgacagacatcatttcagggatttaagtcaggatttgcctcagctggtttgtgcaccctctttgcattcacaagcctttctttcgtctcgcctgagcttttagagcaaaatctgatccagagactgtggatgctggaggagcgtcaaggctgggaaagtaacatgcactgtgttcgcaatcaacagaaaagatatttttaaacaaaaacaattttccaagtttccaggaagagaaacaaaaggcttttctaaaatgaaagaaactgttcttctcattctgtgacttttatgtcacttggacaacaaaccagtgcttaggaacggttattttcctgtcgacatcgctgcatggatacttcttagaagaacataacagcattagcactcagtcccaggttctgctcaccctccaatggcagtcgtcttcaaaaacaataaagatatctgtgcttggtctctctgtctngattacactgcaggnacaacctag

SEQ ID NO: 552705 - DNA, 162 bp, Homo sapiens
tgtggtcgtagaggatccctgagacgtggggatagaatggcagaagtacgggttagaattgaagtgagattcttccattctaccctctctctctcttcctctctcgtggcctcacctccccagccagcccaggcgtgcgccagctatctatcttcctactcc

SEQ ID NO: 552706 - DNA, 435 bp, Homo sapiens
  misc_feature (411)..(411): n is a, c, g, or t
  misc_feature (426)..(426): n is a, c, g, or t
gctggaatttaaattcagatctattatactcttaaggactgtggaaggagcaaaatctgatccagagactgtggatgctggaggagcgtcaaggctgggaaagtaacatgcactgtgttcgcaatcaacagaaaagatatttttaaacaaaaacaattttccaagtttccaggaagagaaacaaaaggcttttctaaaatgaaagaaactgttcttctcattctgtgacttttatgtcacttggacaacaaaccagtgcttaggaacggttattttcctgtcgacatcgctgcatggatacttcttagaagaacataacagcattagcactcagtcccaggttctgctcaccctccaatggcagtcgtcttcaaaaacaataaagatatctgtgcttggtctctctgtctngattacactgcaggnacaacctag

SEQ ID NO: 552707 - DNA, 264 bp, Homo sapiens
caatgcctgtggtccagctctcaggaagcggaagtgggagactcgcttgaatctgggaaggcggaggtagcattgggctgagatgactgtctgtactccagcctggctgacagacttatacccccatctcaaaaaaaaaaacacaaaacaatgcaatgtccaggagacaagttgaaatgatgccaccaaaacaaacaaacaaaaacccacaacaaaaacacacaaacccccagcaacaccaaaacacactaaacaacaaacaca

SEQ ID NO: 552708 - DNA, 995 bp, Homo sapiens
agcggtccagcctgggcaacgagcaaacctgcgtctcaaaaaaaaaaaaaaaaacaaaaaaaaaaaaaaacgggggcccaagggccttttttttttcgcgcagagggcccggcccggaggtccctggggggaaagtttccaggtaggggggaaaatactcggtgtgttaggtaagctaagacatcacagccccctaagaattgctcgtcgcgctatcgatggcatttctctaggaagactcctattaagcggaggcgaagagaaccgcccttgtaaatacccccaaatttatggggagcgatgtaacttaatgggcgcagaagtgagcaacagctatacaaaaccagggcaaagaaacgtagaatgcggcgccacataacactactctttcagtgcaaatattaatccccagggtgaattgggccacagacagaaatagactttggggcacttaataccttcagagcgccactatactcccagtggtaaaagggtgaccacgggtgttatttggtattatattctcccacaatcaccacgtggtaggttataaaaacaggaaaggggcaaaatgaagaatgtgatctccaagacagattaatacaaaaagtgtcctggttaacgcgcgaaaccaaagatggtatttttcggggcccccacaatataggaggcacatatatgttgcccacagtggtagtgttaaccacaatatggcgtttggggcgcaaattcgggagtgcacaaaaaacaaccacgagggcgaatctacggacttattccggggcacagcaaacccaaaagtcaaggggagaaaaaaatcccccttcaatgggtcccagacagtgtggtacaaccatctcaaaatttgtggtattagggaattgaccaaaaggcctgcgttatatataatttattgggacgaattactttgccccccttatcttacatacgatctcgattggtcgcatcagagtgtcataagggccacaagcgat

SEQ ID NO: 552709 - DNA, 726 bp, Homo sapiens
  misc_feature (343)..(343): n is a, c, g, or t
tggtccccggggtgctaccctttatggcgggggtcttaggagaaaaaaaagggtaaaaaaaggagaaagcttgaataaaaagagggccaggaccctaggggtgccagagccatagttcacggggccaaacgcccatataccacccaggccgtggacaagaggtaggtggcctcgtggggagaggaactccttagggccgtggggccctcagaactcaagctcgtgcgttgggcgctgcaagagggcgtgggagaggggcagtgttgttcctggctcataagagggagaggcgtgtgagagacgtggtggggagggaaggccagtgggagcgagagtggggcangttcttggccccgtgtgtgtcccgtgatgctgcctcccaagggcacagtcccagtgctccccaggtgccctcaagggagaaagcttagggggaagggccccggaatatagaagagaacacctgaatgagagggggtcggcgcagggggctgctgagggtgtacactggcttccacttccctttctccagcctcctcagtcccagatttggaggaaagctgtcccaggaacctgtggccaagccatcgcgtcaagtggtgatccccaggggagtcacctggtatcgggccgagagtgtgccaaggcacgaatttgtggggtcccaacatgacgagaaattgtctaaccgagaaaaaaggagccataggaagaccgaagattaca

SEQ ID NO: 552710 - DNA, 375 bp, Homo sapiens
agaggaagtatcagaaagaagagtggcagatagacttcctctgcgcatgtacatgtagcctcctctcagaaagactgatttctgtgtgagaagagggtgtgattcaacttttgcccagcaggaagaggtccattagaaaagtatcaaccaagatgcttataggcacgataatcactgattgttaaatctattcatcatgcccatagctaaaaatggtttaacaaataagtatgtacaatacatttccttaaattactcagggacctttaacgttaggacgttttgggtcctgatccaccaagataagaaaggcggtgaatcttatcttgccctagtaggagtgtgtgtgtgtgtgtatgcatgcacatagaccga

SEQ ID NO: 552711 - DNA, 265 bp, Homo sapiens
cagaacgagaccctgtactttgttttaaaggcctaaccaatggacagccctttcaagactgaatggtgaggccaggtacagtggcgcacacctgtaatcccagctactttgaagcctgaggcagtggggcacacctgtaatcccagctactttgaagcctgaggcagaatcaagtgagcccaggagttcagggccagctttgataatggagcgagatgccatttttagttaaaaatatatattaacaataaagtaacaaatttta

SEQ ID NO: 552712 - DNA, 109 bp, Homo sapiens
  misc_feature (1)..(1): n is a, c, g, or t
ngtcggtctgtatgtagccatgataattttaactctatgcagagtatctaatccatccatttgattcagtaactccattaacgttctctgaatctctctgtcagctgaa

SEQ ID NO: 552713 - DNA, 1037 bp, Homo sapiens
ggtttcggcagttatccatcttggtgcatgctgacgaaaaatcaagatgatgctgacagagcataaaaggcttctgaagactgtggacaaaggcttacaagttgctactggatcgaggagcctgaagaaagagggccctggatgtgattcaggcaggataagaatacgtgaaacacgactgtgaaagagcggaacagaaaacaattagagaaggaaggaaagggctacaaattgtacgaggaggatgatcctgagcgtgttcaaagcaagctgtatctgaacagacaagtgaaactcttggcagagactggaaattgacgaggaaagagcgagaagccgaagagatgcgctgaccggacccgaccaagggcagacagagattgaagcgcatgaaacagccagatgggacaacgcgagtggcctgataaacagcttgtgaggaacagtcggaatggtcgtgtggtgcagctggctaaacttcgaagatcaatcaccgaaaggggagcgaaagatgaagacactctcgggaacttcctgatagcaaggagagtgaatatggagcaatgtgaggtgaccgcgtaggtcacagggcacagaaacctttcccctgctatctcccttcctggttcgaaaggactcattcctttcctccaattcaaccccaatagagtatgattgcttacagtgcatgtgcgttccaatacgaattactatcgatagagtacatctttgtaacatgaaaaatgagcgggctgggtgtaagacgaacgttgccataaccagccctaacagagccagttttagacggtgccgcaagggggactatttacaaagcgtaccaacgatgcaccaagtgattgcagactaaactccgtgagtgtgacccccctatgacgtgttaccgagtctgcgataaccaccgaagaccagagcccaaagtcgtgtgctccaccacaaagacggaacacagacatgaacaccagagtgaccaatatgacaccgtatttacaacgcgtctgatgtcacaacctcgtatc

SEQ ID NO: 552714 - DNA, 307 bp, Homo sapiens
aaataaggaagggtcccaggtgtgagagccccgagtagagaacaataatgaacaattatagtaggaacaatagttagagacagctaatcacaaacaacctgcgggcacaatgacctcattccacacgtagcacccttcagcaggaccctataaaactttcctccagcccttgcctctttgcaggtagccccttcactgctgagctgcccactgcatcatattttcacaatttctccaataaatctgcccttctttacctacaactatcttggtaaatggctttaccacctgcaaaactgaccctagg

SEQ ID NO: 552715 - DNA, 907 bp, Homo sapiens
agcggatgtgctgtatctgaaagcataatgagaaaacgaattgtacttgttacgctacatgtctaaaactggatctgttggaggttagtgctgtgtactgttgatagttctgagtgtgcaggcctacggataactttataccaaagttttcacataggcagttaggcttttactgtaactatcaagacaagatgacagacaaactattggcatcgactgaaagccgataacatttggcctcatttggatttctttacccagttcacgagtgtaaacgaagttagactctcatgctttcattgtacctgcaggcctgtgggcattgtacagtagataacttaatttctaaaaagaacagctgccgtatccttcttcctaggtcaggtatatagtctgtcatacatcacgaagaacttcagtgattggcaaccaatacgaactcctggctctatgacactctttgacacttggttctagtatcattgagttaatatcactcagtatatattcttctgtattaagctcactttgggcgctcacttttacagcctgatcatacctttaggtcatcatcatcgttgacatataggtgtctatgggactattgaatgcaaggatccccgtattaacgttggaggccgcacgcaattgttgcgtgatgattgacgctatggaaccgtcaatttcttggctgagacaggggatgcaaattgagaggcaaaggggacatctgtgcaccattgggtcatcgggaaaaggtactacacagcaatggtgccccaaaggaggtaccaagtacacactggggacccaaactggcaagaaacggtaaacgagcagtgaacaatggcccatcggaagaatacgatacacagccagtgacaagcaaacacgaagcataagcata

SEQ ID NO: 552716 - DNA, 696 bp, Homo sapiens
cccaagggtgcgactccgaagccaacacaatactcttaaatgtccggctccgcacagatacgaaactgggctgcagggagaattattaatgaggagtgtggtgggatggcatcagcagttttgacctgtcgtgccgaggtatacttctacacccctaggatctgcacgagtgtctaagtgcctctcgaacatcattgcacaataaagcactcaagcctctcagaaatcactcaaggaagggaggacgaggtatgatggaagcttcttcacagaaaatcttgcagacatcatgttcttggctgtgtttcgctccaccttgatccagctgtctatgaaactctaaggactttcgctaaaatgtcccattttgtcttgtttccattggatgaaatctgtcacaaaggtgcctagagctccacacgactcggggcctgatggcatctgctgcataatggtggctttggatgagctggtccccaagcagtgccagcagctgggccttattccaggggctcctgcataagtgaacacgcacagccaggcgtcagaatgtcagagcatcatgaggcttgagagctgcctggtactgtgtgctccaagcctggcagggaggctgtgtgcagatgctaaatccaggatgaaaggcttggagaacctggagtaaagctcgtgaatggttccaggcccaggaagtta

SEQ ID NO: 552717 - DNA, 237 bp, Homo sapiens
taacctaaaacacccgggggtttaattttaacgggttgcccaaaagcaccactttcccaagaacaccggcgctaacaggggggccgcccaagaaggcagcaggagcacacttcacgagcttccttctccctctggggcgcaacaagagggaggggtgccgtgggaacattccgcaggcgctcgcaagggcggcaagcgcaaggaggctccccaagcaaaactctgtgttcagagtgg

SEQ ID NO: 552718 - DNA, 374 bp, Homo sapiens
ctctagagatcccctgcgggttcttctgacggggtggctgccaggcggaggggcttctcacttctccgacggggtgtgctgccgggcagaggggctctcacttctcagacggggcggccaggcagagacgctcctcacctcccagacggggtcgcggccgggcagaggcgctcctcacatcccagacggggcagcggggcagaggcgctccccacctctcacgacgccgggtggccgggcagacgaccgctcctcaccttcctagacgggatggcggccggggagaggtgctcctcacttcccagatggggcagccgggcagaggggctcctcacatcccagaccgctgggtggtcacggacagacgaccccgc

SEQ ID NO: 552719 - DNA, 169 bp, Homo sapiens
gtagtattatgctgaggatggagggctcaaatggcgggtcttccagagccagctcctgcctcctttccacccggatatctgcgtaactgaccaccgagtgtgtgcacacgcatgaactctgggcttggatgttccacgtgactggtagtgtgactgtagtacgtagtgc

SEQ ID NO: 552720 - DNA, 118 bp, Homo sapiens
  misc_feature (38)..(38): n is a, c, g, or t
gttacaaagttataaaagacaaaacacccactgtaganatgggctcttgatgttactgtacagcgtgtccaaggtaacaagaagaaaaaaatgtgagtggcatcctgggatgagcagg

SEQ ID NO: 552721 - DNA, 1047 bp, Homo sapiens
  misc_feature (7)..(7): n is a, c, g, or t
  misc_feature (64)..(64): n is a, c, g, or t
  misc_feature (66)..(66): n is a, c, g, or t
  misc_feature (71)..(71): n is a, c, g, or t
  misc_feature (73)..(73): n is a, c, g, or t
  misc_feature (80)..(80): n is a, c, g, or t
  misc_feature (95)..(95): n is a, c, g, or t
  misc_feature (110)..(110): n is a, c, g, or t
  misc_feature (136)..(136): n is a, c, g, or t
  misc_feature (431)..(432): n is a, c, g, or t
  misc_feature (439)..(439): n is a, c, g, or t
  misc_feature (1009)..(1009): n is a, c, g, or t
  misc_feature (1012)..(1012): n is a, c, g, or t
  misc_feature (1016)..(1016): n is a, c, g, or t
cccatgncctgcagaaacacctggctgggctgggcctgactgaggccattgacaagaacaaggntnttttntnacgcatntcaggcaagaagganttttacctggcccantttccacgccaccgcctttgagttgnacacagatggcaacccctttgaccaggacatctacgggcgcgagggaggcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtggggnnggaaaancagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggaagactctggtcaagaagcatcgtgtctggcgttgtggggatgaactttttgttttgtttcttccttttttagttcttcaaagatagggagggaagggggaacatgagcctttgttgctatcaatccaagaacttatttgtacatttttttttcaataaaacttttcccantgnaaanaaacccaaaaaaaccgagactagttctctcc

SEQ ID NO: 552722 - DNA, 120 bp, Homo sapiens
gccgtcatcattttctcagtgtttcaacagacaccgtgatgttatggcgttcgcgcaattttctgcggcagcgttggtccaaagtcgctgtaatgatcgtgaagtaaagaaagtacaggc

SEQ ID NO: 552723 - DNA, 339 bp, Homo sapiens
  misc_feature (115)..(115): n is a, c, g, or t
  misc_feature (139)..(139): n is a, c, g, or t
  misc_feature (156)..(156): n is a, c, g, or t
  misc_feature (201)..(201): n is a, c, g, or t
  misc_feature (286)..(286): n is a, c, g, or t
  misc_feature (338)..(338): n is a, c, g, or t
cctcagacgtggtaaactgaggccggcgaggagggaggctgagtccggggaccaggcggccccttcactgctctccggcccgtctcccccctgcgcctgttcgtacgggctaggncggcggccgagtccagcgggctcnggggcccaggcctgtcntgcgggcggcgcctcctcctccgcgccgtccccatgctcgccctncgcgtcgctctcgtccgagttgtcctcctccaagtacggtaacctgccaccttgtgctggggccgcgggatgcggggctagtcgnggccacccccggcgcagcttctgctccatccgcaggtaggagaccgcggtcnc

SEQ ID NO: 552724 - DNA, 1329 bp, Homo sapiens
gactagttctatatcgcgagcggccgtcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagcgaggcggcgggcggcgcggcgcgcccgcatcttctctggagcgagaggagaggcgcgacaaagagaagaaggaccaaccgacagggcagaggaggaggaggcggagggcgcagcgcgccaaggcgagggaggacccgaaacaaacaaggaagggagagcggggagaccatgaacaaggcaaggcgggggagggaggagggaggaggagagaagaacgagagaccaaggacgaagcgaaaaagacaacccgcaacaggagcgagggagaggagcgaaggaaagaagaggagggggaaggaaacgaaaacaacaaacaggcagacaagaacgaacacacagacccagaacgcggaaaagaaataacaaagatcaaagacgtgatagtggtaatgtagagcatatcgggcgatgagagctcagacgcttggccactgatttagtttgtataggctagtagctatagaataatagaaaagacagagcgatgtaatagttagataataaaacaaaacaatggtatgtcactttcttataacttcaaagtatagagaagagagacgaaagtcacacacaaggaggaggccggggaggggagagacagggcggcgagcaagccgagagagacgcgcgggccagagggagacggacgacgggagacgggggcgcagggagaggagagggagggcacggacgagcacagcgccgcaggcggggcggagggaggcggcacggggagggcggaacgagggggcgaggaagagagacgcagggcgcagcgaggaacaggacgaagccgacagagacaggaagaaggaacgagacgaagaaagaggacgaaggcacaacgaggagcgacggcgacgggagagagagggcacaagcgagaacgaagagagacgagggagcacaaagacagcgggagcaggagagacggggcggcgagtataatttcaaatatggtatatatatgtgcggaatggagagataaatacaaaaccaactcgagttaccaagatcatacaagataaactctgaatctcaatatcaggatagcgaacgatccgcatctcattatgatatgtagaaggaaaaatcattaaacaaataacatacatagataataatataagatgatgcacaaataagattacata

SEQ ID NO: 552725 - DNA, 192 bp, Homo sapiens
  misc_feature (86)..(86): n is a, c, g, or t
  misc_feature (94)..(94): n is a, c, g, or t
  misc_feature (96)..(96): n is a, c, g, or t
  misc_feature (102)..(102): n is a, c, g, or t
  misc_feature (106)..(107): n is a, c, g, or t
gatgaaatgatctgctgcaggtctcttagccctaggattcatctttcttttcaccgtgggcccttacttgcattttattagcaacncatcactngncatcgnactnnacggcacgtacttcggtgttgctcacttccacattgccattcaataggggctgtattgccatcatggaggcgtcattcactgatt

SEQ ID NO: 552726 - DNA, 231 bp, Homo sapiens
acgggagatgtctgaggcgtgtcttccaggccctcccacagctggtgccctccacagggtagacttgaacactgggcctcaggtgatccttccacctgggcctcccaaagcatggggattacaggcgagagccacgggtgggctaaaatatttatatttacctgacatgattggtggagtgggggggcagggagttctaaaacaacaagtaaaaaatcgtgcgggggctgc

SEQ ID NO: 552727 - DNA, 239 bp, Homo sapiens
tcccgtacgggaagctctaacaggcttcatcagatcttcggggctgaacccatcatacaccatagtgtggttgaagatagggatggagggctaccctacggctcaggtcatctggcgagttatcctacttgtatctggaaatgtggtacatatacacaaacagaatatatcttgactaccccttaagcagtgatatatcctttcatacccttcacccagatatgcactactccagtaat

SEQ ID NO: 552728 - DNA, 141 bp, Homo sapiens
ttcgacccacgcgtccgtgttcctgaaaaagtgatttgtattagttttacatttgttttttggaagattatattttatgatgatacatatacaaatataatcttccaaaaaatatttaaataaaaagtatctttagagtga

SEQ ID NO: 552729 - DNA, 315 bp, Homo sapiens
acaaagagtccaaaagttaccaaaagaactactttccaggatgagctaataagagcaattacagctcgctcagccagacaaaggagttctgaatactcagatgactttgacaggtatgagattgtttctttaggggatttttctgacacttcagcagatgaaaattcaggttaattaaaaaatggatgactttcatatatccagatggatgaagggaagggtccctcaaaactattgtttttggagaaaccaataaatcaaacggtaacacatccacagagtagaccagagtgtgccatacatgatgaagagaga

SEQ ID NO: 552730 - DNA, 157 bp, Homo sapiens
ggcagagggtaggtatcctttctcttcaataattttcttaatggcacctggaaactcatctgctgacctcttggctggacaggaagctgcatctccggttatcttgacatttcttaacccaaacctctcatctaaaataataaaaccatcaattggc

SEQ ID NO: 552731 - DNA, 465 bp, Homo sapiens
  misc_feature (20)..(20): n is a, c, g, or t
  misc_feature (37)..(37): n is a, c, g, or t
  misc_feature (80)..(80): n is a, c, g, or t
  misc_feature (171)..(171): n is a, c, g, or t
  misc_feature (217)..(217): n is a, c, g, or t
  misc_feature (243)..(243): n is a, c, g, or t
  misc_feature (246)..(246): n is a, c, g, or t
  misc_feature (380)..(380): n is a, c, g, or t
  misc_feature (396)..(396): n is a, c, g, or t
  misc_feature (398)..(398): n is a, c, g, or t
  misc_feature (432)..(432): n is a, c, g, or t
  misc_feature (439)..(439): n is a, c, g, or t
  misc_feature (442)..(442): n is a, c, g, or t
aagcggaaccataggcatgntgcggccccagatgagngcggagggcaaagcaggtgccggggcagcgcacaccccacaancaagcgcccctgcccagcctctgtaaacagaccctcacaggtccctcctgggccttcagtcacatccctgagaaacacttggcggcttctncccgagagggccagggtgtccaccgagcctgctgaagccagctgtnccctcccttcttgcagagcaggctcnacnactgctgaagcccagcacctgcagggcccagcctggggaccaccaatgcccggcctcttccagctcagaagcgcacacggcagccacggggcagcggcaaaggcgatggtacagagcaaatgcctccccaggcngtgacaggcacgcacnantctccagggcgccactgcccacgccggcctaganctcctcngtnatgctccccagggtggcggtcgc

SEQ ID NO: 552732 - DNA, 312 bp, Homo sapiens
gttcccgctcggtacctgtgactaataccaagtactcgctggactgttcagcgtgccagacctcattccattccaaaattatgcccggatgctatccgcccagctgctcctagtaccaccattatagtactactcagtaccagcttcttcacaggttccacgagtcatgtcaacacagcgtgttgctaacactattcaacacatcacaatgggtcctcttcctgctagctgcagccgctgcatctactcctgctgtccgcaccgttccacattataaatatgctgcatgagttcgcaatcctcagcaacatc

SEQ ID NO: 552733 - DNA, 825 bp, Homo sapiens
acgacatatgttagtgtcggcccaattcacacttgggacacagtcttttttgaggtgtcgaagcaaacgtttttatattgcgcttaaccccgggcccagcccccattttccccgcctttgtgggaaagaaaagttgtctctttccgcgagaaccatgtttctgggtggagcgtgtgaaaacacattgtaaaaccatttcatggcccgtctaagaaggggacaatagtgccttttgcggtcatcaacctttccagaacattcctttgtgttatgcccccccctcagataacagttgccccgggagaaatcacccccccccacacgggtgctgttccgtccaacaagccccccgaggcaatcttggttggacaacgtattatctcggactcgcccccgtttttctaaggtcaggcgcctctttgtcaactctcgcggtatttctaacctgaaacagcctggtaaccggcttatacgaattttgctccacacaatgttgtgaaactgacgtgtttcttctggaagccaatatcagcgcacctcgtaaaccacagtttacatctgttgaaatcgacaacattgacactctgtcttgatcaagacagacaaatttggatggtttatgcacatcttcaaaggacagttgtccagatattctccccgccccccctttcaacgccagtgcggtcggatgacggtccccggcgtcccaccatatgcgaatatttaagggaagccctcggttttttccaattcacgggggcaaaaaaaataggttgtttatataaaaaggcgtcacaaaacccaatcccccctcgcaaaaaaaca

SEQ ID NO: 552734 - DNA, 917 bp, Homo sapiens
  misc_feature (914)..(914): n is a, c, g, or t
gataaagaagggcattacataatggtaaaggaaacaattcaacaagaagggctaactatccaaatcatatatgcacccaatacaggagtacccagattcataaaacaagttcttagagacctacaaagagacttagactcccacacaataatagtgggagactttaactccccactgtcaatattagatcaatgagacagaaaattaacaaggatattcaggacttgaactcagctctggatcaagtggacctaatagacatctacagaactctccacctcaaatcaacagaatatacattcttctcagtggcatatggcacttaatctaaaatctaccacataagtaaaacatttcctcagcaaatgcaaaagaactgaaatcataacagaccacagaccacagtgcagttacatggaaattgaataagctgcttctgaatgactcctggataaataatgaaattagggcagaaataaagaagttctacaatgaagaagacaataaaggataacgacgaatacaggatggagaacaaagagacaatgtaccaaaatctctgggacacagctaaagcagtgttaagagggacattatagcactaatgccacatcagaaaggctagaaggaattcaatggaacacctacatacaattaaaagactagagaggagggagcaataatcatagtagcgaagacagaataactagatcaaccgaatggagtattgagaccttggaatttcccaatatcaggatccaattgtggtggaaaatatatttggcctcgtgtcttaggaacatatcctgaacagtggggtcaccggcaaaaatcacgagaggtaatcaaaaagaagagtgttacccccagggatccgttccttcgtcctgctggcccgtcgtcactctctacangtg

SEQ ID NO: 552735 - DNA, 781 bp, Homo sapiens
gacaatcttgagtggtacgtcatcgtttccgcagccattcatctgctaatcggggaaaatcgcctcagcagaacaagcaagtaaaacacggatgtcccccacattcacctgatccgtacttagttaattctgggttctaccagtgcctgtgggcacacttttgcacagatcaaattcatgtggaaaaatgttctgtttgtagaactcctaggtattcacttatagtgctcatgtccaggaatggccagtgagttagagccccctgataatctgcttttgttagaacgttatgccaagataataaaaccctgtccccttcttttctagttctaatccaggtttttagaccctccagatttatttacttttgcatgagatttgtttccttcattatttgatatgttgctatacgcttggattagagaaaaccttcgcttgaaatgtacttgtgcacggtattaaagcaccactgtggagctaaacgtttggcactttgtcacgtattgttctactcgtgttgtaacctgaaagtgctcactttttaaaattcgctagcttaaccacctgtgagctgatagcctctgtgaatttttttagagtttctccaacttggtaattctttaaatgtttcccgatagcccttagttttagctgctgtaaaatagctactttgcgttatttgatatagaattgttttttaaaaactccctttatttataccgagacctttataatattttaccaaccttcttatattctggatcaatatttctaattccca

SEQ ID NO: 552736 - DNA, 152 bp, Homo sapiens
gttgtgttacttttagttttatagcaatctgattcaattatacatatgaatatgtatattctttttcatattttttcccatatcggtcatcacagaatattggtagagttctgacatcttaatctgggcccagcctgctggtccggctcact

SEQ ID NO: 552737 - DNA, 172 bp, Homo sapiens
  misc_feature (23)..(23): n is a, c, g, or t
  misc_feature (30)..(30): n is a, c, g, or t
tggggcactagcatttctgatgnccttttncactacgtaggcactgctactcttgaggatacccggacgagccgcagtcagaggtataaggaggagcagtgacgtccagtatctaaactgaacacgggaaccattctgcacaggagacttttccgtaacttaagctgctaca

SEQ ID NO: 552738 - DNA, 207 bp, Homo sapiens
acaagtcactctagaggattcccaccatgcttgtggccccagattacgatgtcatgacttgtaacaaccctttcgatagcaatctgattcaattatacatatgaatatgtatattctttttcatattttttcccatatcggtcatcacagaatattggtagagttctgacatcttaatctgggcccagcctgctggtccggctcact

SEQ ID NO: 552739 - DNA, 162 bp, Homo sapiens
tttcaatctccctccaagctctactctggaggagtctgtcccactctgtaagtggaatccttcctttacaactctacctcctcactcagctcctttccctgatcagagaaagagatcaagggggttggagggagaaagagaccagccttgtcctaagcctca

SEQ ID NO: 552740 - DNA, 230 bp, Homo sapiens
acatcatatatcagaacaagtatcacctatcaacttcaaaaaagtaaaggttacaacgagtggcacacttataaaatacttgcgtggccaaggaaaggtatatagtaaaagttgtacaccatgtgtatgtactcataactttaagtgtgaggccacatgacagacagtacatctgttaaattctataaattgttaaacgcaaaaaagggaaagcttcaacaccccatccc

SEQ ID NO: 552741 - DNA, 479 bp, Homo sapiens
  misc_feature (35)..(35): n is a, c, g, or t
  misc_feature (85)..(85): n is a, c, g, or t
  misc_feature (101)..(101): n is a, c, g, or t
  misc_feature (103)..(103): n is a, c, g, or t
  misc_feature (110)..(110): n is a, c, g, or t
  misc_feature (149)..(149): n is a, c, g, or t
  misc_feature (157)..(157): n is a, c, g, or t
  misc_feature (230)..(230): n is a, c, g, or t
  misc_feature (236)..(236): n is a, c, g, or t
  misc_feature (240)..(240): n is a, c, g, or t
  misc_feature (284)..(284): n is a, c, g, or t
  misc_feature (311)..(311): n is a, c, g, or t
  misc_feature (315)..(315): n is a, c, g, or t
  misc_feature (319)..(319): n is a, c, g, or t
  misc_feature (334)..(334): n is a, c, g, or t
  misc_feature (337)..(337): n is a, c, g, or t
  misc_feature (354)..(354): n is a, c, g, or t
  misc_feature (392)..(392): n is a, c, g, or t
  misc_feature (400)..(400): n is a, c, g, or t
  misc_feature (405)..(405): n is a, c, g, or t
  misc_feature (419)..(419): n is a, c, g, or t
  misc_feature (476)..(476): n is a, c, g, or t
aggaagcaacaaaggtagaaaagaaaccttattcnctatcaaaggccaaaaaagcaagaacaaaaattcattcccctttggaganaaatgtagtccatctnanaaaaaanaagaaaagtcctggctgtcctgcaacagggtccacaggncaaatacntcatcccacaatcttgggccactagtaaacacccattggcatatccaccaacaacaaaaaccaggcgatttanttagcnaccnaaaataatgcacagacctccccaggctgtttcacaaatttgggncggcgtgatgagaataacccgatactnaggnatgnccacggacttcaggnacngcaccatgctctatagnttcgcagcgtactcctccaggggaatgtgctgcttggnattctcanctctnagtgcactgtcatnggccccaaagaaaatggtaactgctactgggatgtccaaactgtgtcctttcctgantaa

SEQ ID NO: 552742 - DNA, 106 bp, Homo sapiens
aaaagagaaaaaaaaagcgaaagcaaaaaaagaaagagggagggaaccaccgcaaaaaagaaagcagcgaaaaaaaaaaaacaccatcaacaggcaagaaaaaaag

SEQ ID NO: 552743 - DNA, 508 bp, Homo sapiens
  misc_feature (215)..(215): n is a, c, g, or t
tggaattgtgtgttatggatggcttcatgcaaataatacaacaaataaatataatatgaagttgtgatgcatgtaaagattttgatataagatataaatgcaacaagagtaaatgcgatgcataaatagatgacttgacacatttaatcatcatataattatgaaaggaaaatatcacatgagatttcacatttgatatcatgataagttagttnccataacatggaaaacctgttttcaaaacttgacaacgtattatatcaaaacatgactgcgaatttagaacatgacaacttacatctcagaatctgtgttaagaatgcagcacatgacaacaatgcaatttccagaacaaatcaaatacaattatcaaaatatgacaccactattcagaacgttttaatgtagttatgtcaacacctgacaatgcagttacatccgaacatgacaatgtgatttcaagaacatgaatatgaagttatcaaaacataacaccacacaattccgg

SEQ ID NO: 552744 - DNA, 250 bp, Homo sapiens
tggcatctcagctggggaataaagaatatgtctcatcattacaaggctcttgggcgagattcctataacagaagacagatcaacaagaaaaaaagcatcaagatttatttaatataagttttatgtaacataggagacttcagaaatgaagacccaaagaaacagataaatctgtgtatttttatggacagtcttgcagaagtacgattggaggacaaaagggtacgctctaatggtaacaaattggtcg

SEQ ID NO: 552745 - DNA, 475 bp, Homo sapiens
  misc_feature (5)..(5): n is a, c, g, or t
  misc_feature (62)..(62): n is a, c, g, or t
  misc_feature (249)..(249): n is a, c, g, or t
  misc_feature (381)..(381): n is a, c, g, or t
cgccnggtctgctatgatctctttcacttcgcctgcctcaatgaacgtgctgcccagctacnccgaaacacgccacctgcgcgctatcagtgcccaggctgcaattgcccattcttcacaccaaccaacctggcttgccccgtggcctccgcactgagagagaagctggccccagtcaactgtggcccgcgcaagactgggcctccctctgatcgatgaggtgttgaggcccagaagcccgagccctcnaacacgtctgacttctctgacttgtctagttttaatgccagcagtacccctgaccagaggaggtagacaggcgcctctgctgccccagccttctacagccagggcccccggcccccagcttccccaaggccnggcccgagcagcacacagtgatccacatgggcaatcctgaggcccttgactcacgcccctaggaagggtgtatgatacgcgggatgatgaccgg

SEQ ID NO: 552746 - DNA, 146 bp, Homo sapiens
tttaggccagtcatgtaaaaatggatctccaggcaagtcttgctcctggatgcctctgcaggccaaattctccagaagttggctctcctaatcagtcctgctcatgtctggctacacaggcccagactcttaccacacagttcaga

SEQ ID NO: 552747 - DNA, 232 bp, Homo sapiens
atatgcgcatctggtgcaggcataggacagcaacgttgtatcaactatgaagagctcgtccgcattgtgctgaatggcgtgaggaccttcccagtctccccagagtcctagcctttcccctggtgttaaaattgtatctagcctaaagtttccctaggctttcttgtctcagcaactttcccatcttgtctctcttggatgatgtttgccgtcagcatctccgctttggaaa

SEQ ID NO: 552748 - DNA, 122 bp, Homo sapiens
gtctgtcgtcctgtcacgctcggtatgttcttgagtgcacgtgtttataaaaaataaaacataaacccaccatcacaaaaaaaaaaattttggcagcgaagagaaataaagaaaaactgaag

SEQ ID NO: 552749 - DNA, 595 bp, Homo sapiens
gcatttatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattggctgtctttgttattatattcatctgtaatgtgaagagtttatctcattgtggttttgatttacattcccctgatgggtgatgatttttaacatcttttcatatacttattagccattatgtttcttctttggagaatgcttgtcaagacccttacccactttataaacggttatctttttaatatgaactggaatagttctaaaaaatatatcttaaaacaagg

SEQ ID NO: 552750 - DNA, 842 bp, Homo sapiens
aaggcgtgaggtgcgaggcctgtgaggttatgttggaggagggcgctccaacgggtgcttcccctgcgacacagcccccatggatcgcagcttcagtcgtctttccgatcttccgacatgccgcatgcggaccccttagtccggtgcatgctcgtcgcctggcaccagctcgagctgcgatacgcgctgtacgacgttcgtagccccgacgaaacgacggtggagctggtgcttccatgagggtcggacgtcgtcacgcttgaccaatccagatcgatgagaactggtacgagggcttgctgtgactggtccagtcgggcttcttcccgctcagctacgtggaggtgcttgtgcccctgccgcagtgactcacccgtgtccccgccccgcgccctccgtccacactggccggcgttttatgaaagggtgtctcttgaattcaacacggtgtgctccgtgtctgtccggggtggtagtagtgtcactgaccgaggccaacctgggcccagagccctgaggtactccctgagcaggagacccacacattggattgcaagagggactaatctagagagtgggatggaggatagcctgtattacaactagcgaagactacacaatcagatgacgagctacccttacccaactccatggacggccagcatcctccacccgcataaccaattctcgcccagctggacaagggagggcaacaataaagtgctctaaaaacacaatgtcatctgggaagccccactaggcctgaacggacggtaccgacacatagctacatgagtccgcacatacagaaggatcgagcgcccatggatgcagaatgacag

SEQ ID NO: 552751 - DNA, 292 bp, Homo sapiens
aggatcgtgatgtatcgcccaacacgaatgattaggttgggtagttttcctgcttgtgtaatttttgataaataagacgttaatactgttttaatgaaaacagttaaatattgaattatttagtaaaataaccatatatttaatcttaaggtttctactcacctaaatatctgaaattcacaggctataaaatggttgacagggaaataactttacatgatgactcacagttttcataaataatgcaggtaaactatttatataaaataattaggtgttggggataacatca

SEQ ID NO: 552752 - DNA, 854 bp, Homo sapiens
gcttgatttggaacaagagttcctggtgtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtgtgggggttgcctcctgttcgaagtgcactggaaccaatcctggccgtttgtcatggggtcatgtataaacagctctcagcctggatgctccatggacatcctcttggaccaggcatgaaggaattccttaatcaacacatgggtgccatacttctggtaactgtcatgtgcccagccagaagcaggacgacggacggatctgggcatttgtgagtggactgacagtgaaaacaactgagagaaactgcgagtgaccttgcgcctgattgacggaagagaacatgctggcaccatctctgacagagcaggttttccctacgatgtggagaatttctggcactcctacgatagcccagtgacgggtctgctgaacgacacgtcctatatcgtaggcgaactcttgtccagatgtcccgagaactcagacatgagaacctgacctcagacaacacggatccagtgtgaaaaaccaggcgcaggacacctagaacggccttgaagaagggcagcacccggagcatcagagcagcaaggccagcgccagccaggcatgccggccctgcgacaccagggtgcggtgagagcgacatccgcagcactaggggcagagcgtatctcggcacacgcgcggcagaacgacccgggacaaccggggccagctgacaaccagacaggac

SEQ ID NO: 552753 - DNA, 117 bp, Homo sapiens
cagactgtcgacattccagaccatgtcgacattactctgaagggacgacagttatcgtgcagggcccacgacgaccctcggagggacgtcatcacatcagttagactcagcctctgg

SEQ ID NO: 552754 - DNA, 597 bp, Homo sapiens
ggtggaccttcggggtgtacgtgcgtccggggatcttcaggcgcccggggtggggcactcggccggtcgcgttgggcgttcttctgtgactcgatctgcggccagcttgtgcgcgcttcacacctccgtcacgccagtcatggttgacagctcgctgaaggcaacggtaagaatagtcagaggctgatcccgcaagaatatactgcgctcgctcgctgcctatcaaggacggtagtaaggaagagtgagtgagaggattggaggcaaatggtccaggaacgatgatacgcaaagtacgtgactacgtcatggtgcgtaagcataagcacgcggttctgttgagtagccgtcaggagagcaaacagggcaaagggatacggcgcgttcgtgtggtcagagctctttctagaccaaatagataagtgtctggtgtcaagtttgaacacctcatagacatagaactacttgcggtgtgccgggttttgtccatcatcacatgactcgagcggacgatcgcacgacatggatttacggtttccagggggcttagaagattggccaagtcatggacaatggggccattggcccaaggaatag

SEQ ID NO: 552755 - DNA, 227 bp, Homo sapiens
tcacggagcgactcttgatcctgcatggtctcttgggccaggactgttgatgcctttgagtttgtatcaataaacttaaattgtgtgagataatatttaattgctcagtgatgttccataacccggctaggatcagctaggagtgctgggagatagagggcctcccggactcctgctcccttcgtgagctctgactctccgtggaaatctctcccaggccagagcta

SEQ ID NO: 552756 - DNA, 277 bp, Homo sapiens
tacggtccttgccggaatcaccatagctgtctgccacaaagttagaactaatttacattcccaccaagaatgtaaacacgttcctacttctccacagcctcactagcctctattgtttcttgattttttaataatcgccattctgactggcgtgaaatggtatctcattgtatttctctgatgatcagtgatgtcgagctttttttcatatggtccattggctgcttaaatgtctgagacgtgttggtcatatcttcacccactcttgataggtggt

SEQ ID NO: 552757 - DNA, 190 bp, Homo sapiens
ggaaccgaatcttgaaatctcctctcgtccatagcattctgaacatcctgagtcatctgcacgcactccatcagcggcaggcgcacggcgtgcttcccgttcagtgacacgacgcaagctggggtgtacggggtggcctctagcaaggtgatgactgcctccactcccatgcggatggccaacatcctgt

SEQ ID NO: 552758 - DNA, 182 bp, Homo sapiens
  misc_feature (1)..(2): n is a, c, g, or t
nnggcggcgggggaggggttctcccccctgtgttcttcttttctggaggcccggtttggggtcttccattaaaaccccgccccccccccggggaatttttctcttttttttttttagaccccccgggtggttttttgttgaaacccaaaaaaaccccctttttttttgggggggggccccca

SEQ ID NO: 552759 - DNA, 182 bp, Homo sapiens
ttagaggatcttatgtatggggtctgtacgtgagcgcgatggacaaggcggcggcgagcgctctaagatgatcgacaagaactgcgggaggacggagagaaggcggcgcgggacgtgaagttgctgctgttgggtgctggggaagtcagggaaagagcacccatcgtgcaagcacgatgaag

SEQ ID NO: 552760 - DNA, 329 bp, Homo sapiens
ggctggagtgcagtggcacaatcacagctcactgcaagccttgaccgcccctggatcaggtgatccacctcagctactcgggaggctgacgtgagagaatcgcttgaacccgggagttggaggttgcagtgagccgagattgcaccattgcactccagcttgggcaacaagagtgaaactcttgtctcagaaaaaaaaaaaaaagtatgcaactagctgggggctgtgacgcgtacctgtagtcccagctacttaggaggctgaggtgggaggatcactgatgctcaggagttcgtgaccagactaggcaaaatagcaagacaccatct

SEQ ID NO: 552761 - DNA, 637 bp, Homo sapiens
  misc_feature (186)..(186): n is a, c, g, or t
  misc_feature (320)..(320): n is a, c, g, or t
  misc_feature (349)..(350): n is a, c, g, or t
  misc_feature (512)..(512): n is a, c, g, or t
agtctcggaggggggggccgggtacccaaattcggccctataagtgaagtcgtattacaaattcactgggccggtcgttttacacacggtccgtgaactgtgggaaaaaccctgggcggttaacccacaacttaaatcggccctggcaggcacaattaccccctttcggccaggctgggcggtaantaagcgaaagaagggccggcaaccgaatcgggcccttcccaaacaggttggcgcacgcctggaaatgggcgaactgggcaaagttggtatagcggttaaataattttggttaacaaattccggcggttaaaacntttttggttaaacttcaggcttcaatttnntttaaaccacaataagggccgagaaattcgggcacaaaattcccgttaatataagtcacaaacgacatatgaaccgaggaataagcgggttggaaggtggttggttccacaggtttgggacaccaaggaagtcccacctaattacaaggaaacggtgggacntcccaaacggtcacaagagggcgccatccaacccgttaatccaaggttatttaaggggggtccgaaggtggccggtaacagcgacattaaatccgggaaacccttgagggagagccccggtttag

SEQ ID NO: 552762 - DNA, 370 bp, Homo sapiens
aggacgcggtattacaagatagagcctctgtgcgtgacctaaatgctataatggtcatttacagaggaagtcatgatgtggtccacggcctacaatgacactgttgagatattaccctaacaaagtctatatcctttctgagtgtttgtggaactcaccttgagacactctacatcagcggggctcttggtaatacaggtctctgcgttatgcagaaacgggaaacatcatgctcccttttggagctgagatgttaagaacacttaaacccttgccaaacttttttatatatgcttgaaaacgcatgggttttactttgtggtgcgctagagggatacctatcagaggatcaccggggcgggggtttttt

SEQ ID NO: 552763 - DNA, 452 bp, Homo sapiens
tatattatgtagatacagggtttcaccatgtcgcccaggccggtattcgaatgcctgagctcaaggtgatccaccaccttggcttcccaaagtgctaggatggcaggcgtgagcgaccaggcgcggccaaaacagcatatttcaacagcgagcaccgcaggacacaactaggcacagcccaaaaaaccaggatcgggagtgagatggacgcggtttgaatccgtcgttggtctcttagcctggggtgacgtgggcaaactgacttcctttttccgagcctcagtcttctcagtctgtaaaatgggcgctgatggcactcctctcatccgggggctactatagggagtcagtgagtgtgtgactggccgtcagtgaagagcctgacccattgcatggctgttacagatcatggtgttgtggcaggttgtaatgccccccaaaagatgtccagg

SEQ ID NO: 552764 - DNA, 220 bp, Homo sapiens
attagacactaaaaacaattagatgtcagaggcaggtacaatggaacgagaaatcaaaccagttactttatcagtgtattccctcttctttacaactgtaacgcaaaaaaagaaaaggcattctgcttgaagatcagaataaatcagccaatatagttttcttctccatattaagcataaacagctacaagaaccctaagttgttgtctaattgcaatca

SEQ ID NO: 552765 - DNA, 820 bp, Homo sapiens
gcttcagttgagtggtgattgtgccattgcaccccaatcttaggcaagagagtgagacctgtctcaaagagtaaataaacaaataaagtataatattggaatctgtattgtgtacaagaagatttaaccgagttgaagtttataattgataattatgcaagatataggtgttccgcaaccttattttatgctatgatgtaactgttaggtctatgggctttcacactaaggctagtctttaagtttgtcgaagaagtgtgtaacaaatttaaggacaaatagtaacagatattaacaagtattaacaagtgaaattaaagattgtaattctatgaagattagacaattaagaagcaagatataatttgaattcaaagtaatcattcgaatgttgcatatggaagattgggatagcactgcttgggtactaagcgagattattaaaatataattgttacattttggaaaaacttatgtcagggtcagttttctaaagatatttacaacagatagttatactctcaggttacctcagtatccactattattccttttcaaagaataatttcttcattcttatattctgaacttttttctcattctcagagtatatcttaaagtaattggttaacgtattgtggaggatatagtttccatgagcttccatacttgagaattgacattctaaatacatttatgaactttttccctgaaacagtggtagggcaagtttaatggttaaagagtgtttaaaggaaagtctagataagcttggattggatgctggaatgttcaccttgtactttaaaattttagcaac

SEQ ID NO: 552766 - DNA, 325 bp, Homo sapiens
taccggaccctaatatagagtggccatgtgacgtcacgaagagtataagcgatggcgtagagcagatgcagcacgtacgcacacagacatggggaactaggcatgacgtacacaccgagatgcagcaacgacgtacacgggccaggtcgacgtacacacataatataatgtcacacagacgcggcgatggcatacacacagacggtgatgatagtacacacacagacacagtgacaacacacaccatgacaacgacacctaataagataataggcaccaacatacacatagcttgcatagccctattcacataggccactcaata

SEQ ID NO: 552767 - DNA, 170 bp, Homo sapiens
gtggtagcctaaataggctctcattatcagtttgaaaatgacttgttgatttgacttagacatattaagagtacttgttactcatttcttgtgcatagggtcgtgagcagctattcccatagtaaaactcttgcttacattctaaagatctattcagttcctaattgtaa

SEQ ID NO: 552768 - DNA, 242 bp, Homo sapiens
gaccttaatactctccgcagacaagcaccctccacagtcagccgaatgtctcctcagcataaagctttcttaagcctcatatacgaaaaaaactgaaagcaatctatccttgtgtgccactgggtgttctttccactttataccgaaagcaagtagcccatgcttaggaagtgtgtaaggccttttcagtattagacaatcattctacaaggagcttttcctctctctgagatgtcatgcag

SEQ ID NO: 552769 - DNA, 653 bp, Homo sapiens
ggggcaagggcttgctttgtcccccaggctggggggcaggaacttatcacaggctactgggggtgacattttacccgtttgggggaaagggaaaaacattacctttttacctttggaaagttctccccgatttcaaataaagaaagaaacctttttttggggccttttactctcccattataagggaactatcttaaggttttcctctacatatatgggcagccacttagacaagcgtaatttttgcttcaactgttgaacataatttaaaattctcaagaggaaaaagacaatttttttggttgccccgtgtgtttgctctttttggccttttttccggcccgaggttccaagaatccttttggtaccactccctttgtttagagaattggccttaagaaaccctataaaagaaaatctgcccgtgacaaattcccttaggttttccctcatgaaaaagtggaaggattttcttccccaaaaccctttccccccaattcttgagggattggttcaccagggttgggaatccaaggtggatagtttttctttttcagcttttaaaattggtcccactcttggggccgattcctgcagcccgggggactcacctagtttagagacgcccccaccggggggggcccccctttttt

SEQ ID NO: 552770 - DNA, 175 bp, Homo sapiens
ctcggtccattggagcgtagatctgatctgcttcgccgtgagttgtctcgacgtcaccctactacgacttgtggacagaggagccagaactggcttctttgtcttggtgatattacttgccttcactttggggttgtggagcatgatgcagcctagcactgggctctgttctggc

SEQ ID NO: 552771 - DNA, 626 bp, Homo sapiens
ctccttggctgactcaccgccctcgcagcgcacatggacgcccccaggcaggtggtcaactatgggcctggtcccgccaagctgccgcacgtccaggtgctagtctccgagatacaaaaggagactcattagacttagcaaaggagatggcccacttagatggttcgtggccaaactgcagttcacagcgtcactcacgatatgagcgcaagcacttattacacacacgtagcagagaagtctctgtgcgcggaacttggctacgctgattcacagacgaactatacaggtgatcgtttctgcaaggaggtgggtgcggccagttcagtgctgtccccttaaacctcattggcttgaaagcacggccaggtgtgcggactatgtggtgacacggcagcttggtcagctaaggccgcagaagaagccaagaagtatgggactaataaatatcgttcaccctaaacttgggcagttatacaaaaaattccagatccaagcacctggcacctcgaacacagatgcctcctacgtgtattatatgcgcaaatgagacggtgcatggtgtggacgtttgcataaatacccgatgtcaagggagccatactggtttgtgacatgtcctcaaa

SEQ ID NO: 552772 - DNA, 253 bp, Homo sapiens
  misc_feature (66)..(66): n is a, c, g, or t
  misc_feature (166)..(166): n is a, c, g, or t
  misc_feature (193)..(193): n is a, c, g, or t
  misc_feature (204)..(204): n is a, c, g, or t
  misc_feature (247)..(247): n is a, c, g, or t
tacttggggatttgttaaagtgtcatatggtgtccacaaaatactaaaaagatctgttccccgcgnctcactaaaaactcttcttcatgcaatatctatattgtaatatgacaactgctcctaacacccagagaagaactacagcatctactctttagcatctgtngctccgcactctgctttgctattatancactcacgcantctggctccgttcactattactgctgtcactcccgtgtatatnccctct

SEQ ID NO: 552773 - DNA, 637 bp, Homo sapiens
  misc_feature (13)..(13): n is a, c, g, or t
catggtgtcttcnagatcaggtaccgtcatggcacgtagcaaacgtccagatactcagtaggtaccctgaagatatagttcgatagctacagacgggcgatgggttacaggccttgacactcggtctccatcagtgtgcatacctccgactgcacatggactgcattgccatgcacgctttggcagcgtaagcctcccgttctctttccgtgcattgctaagctagtttgccatatcattcagtgaggatcagctctcacacatattacggaatgatgcctaccactgctcgcacatgaatgggttcaggatgtcgaatacataatggcatagacaggagaatctcagtcagtggtaatagttgtgacgtaaatagagcacaggtatgaggcatagattgacatagactggtgatagagatacggcctctgggacatttgtgctgagagttgctcatagagccatgtagcctatcaaggatctagggtgagagcaatgtaggcacttacgagggcttacgctccatggctgttacaggtttgttcattatgcattcgctttaattccagagccttgaatctgtggctgaaatctggtaatgtagtcaaaggtggtagcacataggttggcaggtgag

SEQ ID NO: 552774 - DNA, 795 bp, Homo sapiens
gcgatgtgtgcccgtgtgttttgtcccgccttgtccccaggccccgtggggacgcgttgtagaccctctttccccggcttgttcaaactctcggtgcagaattcagggcggtgtacctatctcagggctcatttgcgaacatggcatgtctggttaaccttcgctgttcggcgacattttgctcttttcgactacccacaccagccccgccgccccctctgcagttgttttggccgcccgtcccctagtgtctggtggcaaatttctggtgtttccccccggcctcgatttggcaaagaacaaaggctaggatccccaaaatccgcttggaaagttctgtccacccaaaagacaacaaggaatctatatgcctctcaacacacgtgggagcgcccacgaagatgctcgcccgccatagggacaagaagcgctccacagcatccccgcgccgatggcggacggacgccccgccaaaagccaccacccgcctctggggggacgtagagagccgggcacacgcgcgcggccccagcgatatggacccccccgggcgcacaaacaatagggaccccactacgttggggaaagaaaaattgggtctagaaagaataagggtggtctgcacagacagacggccatgctgtgtgcccgacacagccgagaaacacaacgggtctggagagagatactcagcgtccacaaggagggagcgtacgctcgccagagaggcaaagggagaccccgcaccgaccgacccctccccggcctcgccaagttttgtccccccacaaaaca

SEQ ID NO: 552775 - DNA, 455 bp, Homo sapiens
aacaatcccggacacacggtgaaacccgtctctaccaaaaatataaaaattagccgggcgtggtggcgggcgcctgtggtcccagctgctcgggaggttgaggcaggagagtggcatggacctgggaggtggaggttgcagagagcggaggtcgggtcaccgcagtccagcctgggcgacagagcaagactccgtctcaaaaaataaataaatacataaatacataaataaataaaataaaaataaaaaaacaatagagagtatgatttaccggcatagaatagtcggcgtctttaacacactcgatatcggtcacatttctgttaaggtcccaggccaactgctgagcctttgctttcatccttaggttcgtgattggtgggtttggatctaaaacggtgacaggttggagttagaagagatacgtaagaatcttaaaacggcattgtccgggg

SEQ ID NO: 552776 - DNA, 117 bp, Homo sapiens
gttccattacgaccgaagttgtcattcccaccgaaacacctccatgacaccaccaaagttccagaaccacttcgacctcttggcgtggatagaagcactagccatctcttgcttaga

SEQ ID NO: 552777 - DNA, 146 bp, Homo sapiens
catggtcttaaccagtgtcagatggaatcagtggataaatccccaggtttgtttgtccttcaaatgggacaatttgaggaatgctttaggcagaggactcagatgacagagcgccaaccacccacaatagaaacctgctcatcaca

SEQ ID NO: 552778 - DNA, 123 bp, Homo sapiens
  misc_feature (61)..(62): n is a, c, g, or t
ggcacgggcttgtcgtgctctctgagagaaagttgaaaagggtaaagtttagatatcggcnntattgtaagcataggagtgttggttttctcttcaacagacatcgcttttgcggttcccggg

SEQ ID NO: 552779 - DNA, 400 bp, Homo sapiens
  misc_feature (25)..(26): n is a, c, g, or t
  misc_feature (43)..(43): n is a, c, g, or t
  misc_feature (56)..(56): n is a, c, g, or t
  misc_feature (84)..(84): n is a, c, g, or t
gagaggagaggattggggggtaggnnaaggtgggattaagganaaaaataaagtgnaaaaagaacctggagtggtgaccttgancagtagacgttccaagcaatgccacttaagcccaataagaaaactttgaagaaactgagagaagtattacatgaattgtataaacatctagacagcagcgcagaaggtattattgatgctcctatggatattccaggtttaaacctgagtcaataagaatactactctctatgtgtactataagattgattgaagtttggtggaattagaattgtttttgggctgctcccccgacaaccctgtacttgcgctcgtgcccgctatccaaaataggacggtgtatggtaacaccctcccttctacccccctcgcccga

SEQ ID NO: 552780 - DNA, 283 bp, Homo sapiens
gattgccatctgaaaatagatatcgtgaagtatcttcaatttctatttgtggtgattttcaagcacaaagaatgaaacttcgttataaagaagatggaaaaactttatacgcaaacacaataaatggatctggacttgcaattgatagaataattgctataattttagaacagtatcaaacagaatctggttatattgaaattccggaagtattaattccatattttggtaaaattaagcagataacaaacaaataacacaataaaagtaagaaaaaaaaaaa

SEQ ID NO: 552781 - DNA, 936 bp, Homo sapiens
  misc_feature (537)..(537): n is a, c, g, or t
gtgcaacttcagtcaaacgttctcacgaaccttcgaacgcatggtaagagacacaactaattgtaagtatcaattatgatatcaatagatcattggaggtctacctagcacaataccctaatactcacatactcctcaacactatgtgactatgctgagcccaacatacctgcacaccaatgtaaagttacctcagagtaatctcatgcgcaacaacacaaaaggaaggtacaaagggactcaccattgacgagatggtagggatacgtgacgactgacaacatgttcgataagaacttcacgagatgggactactatgatagattgagacaacaattaatccttatgctcatgggattgggaacacgactctaagtactggctgaagacacatttgtgattataccttcgcgctaaacacgcaaaattctaactcgcattccacctcgcctcagtgtccgtagtcaaagaaagtaaccaaacttgccatctgctcaactaacattacactgaggaaagtataaaaactcgataatntagtatacatagttcggctcgtgggaacccgacgaaacacaggaggaattggcaacttcatgcccctatatgccaatccgtaaggtcagagcctagcacaaaggcccccatgaggggttatacaccaatatgtcccaatgcaccttacaaaacctgtgactattaaaggctcaccaggttggattcaaatatagcaggccgtcggggtaacctcgaatttactggctcacctccatggaacatcacgaggaagctccaggtccaaggtggggaaattaagaacgtgaggaggggaaccccaagaaaacttagagaattttccgaccgctaccttaatcaaagcgtaggaacttgcacccttttggaaaccagaaaagcttgaagcccaaaaaaaatgga

SEQ ID NO: 552782 - DNA, 206 bp, Homo sapiens
aggtggcaacatcggggcatcccccgtacgtcaggcaccgtgaggtcttcgcagaagcgtggacgccatgagggcgtctgtcgtccttacctcgttcaaaactcattttgaacgcatcccttattgcaaaatctaccttcgtttccacgctagagtatatacccctttggctcttcagacttacgaagtcctacgtccatcaatgt

SEQ ID NO: 552783 - DNA, 109 bp, Homo sapiens
gttgaatgaggaccttcaggaactctgcccctcaccccaacccatcctccccaggaggaatccagggactcagacctgtcccaggcttcaggaggctggttccagagga

SEQ ID NO: 552784 - DNA, 828 bp, Homo sapiens
  misc_feature (54)..(54): n is a, c, g, or t
  misc_feature (100)..(100): n is a, c, g, or t
  misc_feature (104)..(104): n is a, c, g, or t
  misc_feature (136)..(136): n is a, c, g, or t
  misc_feature (191)..(191): n is a, c, g, or t
  misc_feature (237)..(237): n is a, c, g, or t
  misc_feature (239)..(241): n is a, c, g, or t
  misc_feature (275)..(275): n is a, c, g, or t
  misc_feature (282)..(282): n is a, c, g, or t
  misc_feature (309)..(310): n is a, c, g, or t
  misc_feature (317)..(317): n is a, c, g, or t
  misc_feature (348)..(348): n is a, c, g, or t
  misc_feature (365)..(365): n is a, c, g, or t
  misc_feature (393)..(393): n is a, c, g, or t
  misc_feature (396)..(396): n is a, c, g, or t
  misc_feature (403)..(403): n is a, c, g, or t
  misc_feature (432)..(432): n is a, c, g, or t
  misc_feature (509)..(509): n is a, c, g, or t
  misc_feature (513)..(513): n is a, c, g, or t
  misc_feature (625)..(625): n is a, c, g, or t
  misc_feature (648)..(648): n is a, c, g, or t
  misc_feature (673)..(673): n is a, c, g, or t
  misc_feature (694)..(694): n is a, c, g, or t
  misc_feature (700)..(700): n is a, c, g, or t
  misc_feature (702)..(702): n is a, c, g, or t
  misc_feature (756)..(756): n is a, c, g, or t
  misc_feature (802)..(802): n is a, c, g, or t
tagaggagttcacatcattacatcaacagtgtgaatttctaacagaagaaaaantgaatacaatagtttaaaagtagaaagaacatgcttgcaagacaanagangattcactaaggatgcacgattgatctgagangtttttaagcctcgtactcgccctcctcctcctcgaactccccttgttcgtcggncgtggcgtcctggtactgctggtactcggacaccaggtcgttcatntnnntctcaggcctcggtgaaatcaataaagtccatgncctagcncgtgtaacagtgaaggaaggcatatgnnccggaanatggaccgtgaactgctcggagatgcgcttnaacagctcctggatggncgtgctgttgccgatgaaggtggccganatnttcaggncgcggggcgggatgtcgcacacggccgtnttcacgttgttggggatccactccacgaagtagctgctgttcttgttctgcacgttgagtatttgtttgtccacctncttnatggacatgcggccccggaagatggcagccaccgtcagtagcggccgtggcgcgggtcgcaggcggccatcatgttcttggagtcgaacatctgctgggtgaactcgggcancgtgagcacccggtaatgctggntgccccggctggtcaggggcgcgangcggcgcatgaagaagtgcangcgagngnaggacaccatgttcaccgccagcttgcgcaggtctgcgttcagctggcccgggnagcgcggcaggtggtgaccccgctcatggtggccgacacaggtggntgaggtcccgtaggggggggtggtca

SEQ ID NO: 552785 - DNA, 365 bp, Homo sapiens
gggcccccctttggctttggggttaccccccccttgcctttttggttgccccctgttttcccgggggattggcctctgttggcccggggccattttgggggtaaaaaaatggtacccagggattgccccatttttaattttggctttggcggctttattttaaaggtcggttttgacccattttttcccttttttttttgggggttccaaaggccccggttatttgtttcccgggaggtcctccccccccccccccccccctcctggtccccctttttttttcccgtttgggggaaggttttaggtccggccttttttttggggtggggtttttcctctaaaagaaaaaaagtttttttaaatta

SEQ ID NO: 552786 - DNA, 202 bp, Homo sapiens
cacggatttgctggtgcagtacaactaggcttaatagggacatgaggtgtggagaggaggggaagataagaccatagagagagctgaaaaccagatggcttgtgctaagagctgcaaatgcgaagcaaaagatttgggagattgtttttatttgtgcttatttttttcctatcacaaagtaatgaatgatccttgtaaaaaa

SEQ ID NO: 552787 - DNA, 116 bp, Homo sapiens
gtgagccatgatcacaccactgtattccagcctgggcaacagagcaagatcgcaccccctggaaaaaaaaataggtgtcttgataaacatctagggggttaaggtttcatctcgaa

SEQ ID NO: 552788 - DNA, 338 bp, Homo sapiens
  misc_feature (104)..(104): n is a, c, g, or t
gaggtggtgtctcccggatgggttaaagcagatctctagatgtaaagggaatattcactgggagaaaagaatcctcccagccaaagcaaagtacttccacacangcgacaaggagttgaaggcgggctccgcactcgccagtgccttacacactcgctaggcttacttgaattggacaggaggattttatttaatgtctctttatgtaaaaagcagagaggataagtccaagtgttctcccttcctatctgtgggctctatgctagtaacacattttaacctcatctgtcaaagctacagtctaaaaaagaagttttatcaacccttgttcaacactt

SEQ ID NO: 552789 - DNA, 274 bp, Homo sapiens
  misc_feature (54)..(54): n is a, c, g, or t
cggctggagaacgggaacgagacgcttagcgcgcgaccccccaaagacacacgntaccaccaccccgtctctgacatgaggcaccctgaggcgctgggccctgggctctaccctgcgagatcacactgacctggcgcgggatgcgagaccaaactcaggacactgagcttgtggagaccagaccagcaggagatagaaccttccagaagtgggcagctgtggtggtgccttctggagaagagcagagatacacatttaatgtaccagcatgagg

SEQ ID NO: 552790 - DNA, 320 bp, Homo sapiens
  misc_feature (78)..(78): n is a, c, g, or t
  misc_feature (134)..(134): n is a, c, g, or t
tgaaggggaaccttttaaatcccaaaaaaaagggatggtttattaaacccaacccctgagaaaacagccagggtttgnccctccaaataaataaagggcttgccccttacatgaaggtcccctcttccctttcnaaaaaggaaggcaggaaggatggatgttaaaaaagttaagcttcccggttaagtgctgccaaaaagttaaaaaggcatttaatttttttgtgaaaagggaagggatgtccctttataaggggtaagggagggaaaaccagggcaggaggggaaaaggaggagaaacgtttttggggccccccttta

SEQ ID NO: 552791 - DNA, 513 bp, Homo sapiens
catttgctcttcaccatacacaattcatctgcttgtgttctcctttcagataactttgtcatgtttggtgtcatttgacagattatgactttagtgttgtagtgatgaaatcaacagagacatcgattaattgtgtttcaatctacaatatatttactattgttgggtcatggcctgaggagagtatgttaatgtacttctcccccacttcatctcttcaactttgttctcacgttcagctggttttgggggttggttttcactcaagtttgacattgctttgctcagggtataataaggaaaggtaactgttgatctgggagaatggcttttactctgcatctcccgcacactggtgcgtagcctcatatgctaacaaaggcagtttcactgtctttgttgctcagcagtgcatatgttatagctaatttctttatacagtatgttagtttgtgtcattctaatgtctgtatatttgatcatgtaacttaataaacaactttgcctgcttta

SEQ ID NO: 552792 - DNA, 798 bp, Homo sapiens
gcaggacgcgggccaggagctgctgggctggagcggcggcgcggcatgtccgacagcgagaagctcaacctggactcgatcatcgtgcgcctgctggaagtgcagggttcgcggcctggcaagaatgttacatgctgacagagaaatgagatccgcggtctgtgcctgaaatcccgggagatttttctgagccagccattcttctggagctggatggcacccctcaagatctgcggtgacatacacggccagtatagaccttctgcgactatttgagtatggcggtttccctcccgagagcaactacctctttctgggggactatgtggacaggggcaagcagtcttggagaacatctgcctgctgctggcctataagatcaagtaccccgagaacttcttcctgctccgtggggaacacgagtgtgccagcggtcaacagatctatggttgctacgatgagtgcaagagacgctacaaatcaaatgtggaaaaaccttcactgactgttcaactgcctgcccatcgcggcatagtggacgaaaagatcttctgctgcacggaggcctgtccccggtaactgcagtctatggagcagattcggcggatcatgcggccacagtatgtgactggacccagggcctgctgtgtgactgctgtggtctgaccctgagcaaaggacgtgcaggctgggggcgaaaacagacggggcgtctctttttaccttttggagccgaggtggtgggccaagttcctccacaaggcacgacttggaacctcatctggcgaagaaaccagg

SEQ ID NO: 552793 - DNA, 279 bp, Homo sapiens
tggatgcagcgtgaagctacagtgtgggctgaagtggtcaaagcacccgtatgacgtcacaggttgcagctggtccaaaagcaaccaggaccctctattatatctggtgtcacaaagtatattgcaggatcctatgagtgtgaaatacggaacccagtgagtgccaggcgcagtgaaccagtcaacctgaatctcctcccaaagctgactaggccctacatcaacatcaagaagttaaaccccagtagagaataagggatgtgttcgccttcatctgtg

SEQ ID NO: 552794 - DNA, 4008 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtgagggcgggcccgcggcctccctcccgcacactcctgctgcccccggactgcttcagagcgagcagccccacctcatcgcgcttggggacccgggctgccgccagctctgaagcctcggccgccatccctgcccgattatctggagcccctgcccccagcactctttctgcaagtgtcttgctcacagtccttagtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552795 - DNA, 3812 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552796 - DNA, 159 bp, Homo sapiens
gggtggactcgcgcctacctgggcgatttgaaatgccgacaatgtagtgtctgcatcccgccaggatgaatgccgaggttctagcgccagtggccccgagtagtgcttgcgcattagctcaaaaaagttctgagcaatttttgctccatactccagtga

SEQ ID NO: 552797 - DNA, 126 bp, Homo sapiens
ggggtgtctgtgtcgggtgtcgaggaatttcccagcagtttctccgctggtgaagacccagaggaagggggagtaaacttgggatggggagattccatttccaacagggtccgggtgggtaaggcc

SEQ ID NO: 552798 - DNA, 3911 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaaaaaaaaaaaaaaaaaaaaaaaaaaaaaaaaaaaaaaaaaaaaaaaaaaaaaaagaaaaaaccgcgcggggcgagacattcatagggcgcgggcgggaaaaagagagggagaagaacaaatagaccaaaacactcaactcaatcccacaagacgaaaccacccaattagctcttcaacaaaccattacaaacatacacacgcacacacaccacataaaataaaaaaataaaataaatactaaaaacacacaaa

SEQ ID NO: 552799 - DNA, 3984 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtgagggcgggcccgcggcctccctcccgcacactcctgctgcccccggactgcttcagagcgagcagccccacctcatcgcgcttggggacccgggctgccgccagctctgaagcctcggccgccatccctgcccgattatctggagcccctgcccccagcactctttctggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552800 - DNA, 3683 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552801 - DNA, 3462 bp, Homo sapiens
caggcccctccacgggcgttctctggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552802 - DNA, 3403 bp, Homo sapiens
cccacgcgctcgcggacgcgtgggtcgacccacgcgtcgggccacgcgtccgcgaatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552803 - DNA, 2829 bp, Homo sapiens
  misc_feature (3)..(3): n is a, c, g, or t
  misc_feature (70)..(70): n is a, c, g, or t
gtngggtcccgagagcgaggggcctgtcactccgggtccctgtggtttagggctgtttctgtagcgcctncgacccccctggtcttcactgtgaaggctgcaagggagaaaagaggcccactaggaacattctggggagccaagggtggggtaatgcaccacccggcccctgcgtggcccagatgtgggtggtgcgcttctcatacctggcagattagcctaggtccccggagcaccagcttcatcctctgtcctctttcctcctgtggcccaagaggagaggtcaggtcagatggctggaggcagcttccagcagaggctcggtgtgggtggggccgggagaaacatgcccctggggcggtggctcactctctggtggtggttccacacccaccgtgtgctggtcgtggagccaggctcggtgcctaccaggcctgagtcaagatgtggcacctggtgctgtgggtgtccccccgctcccgggggtcatgtctgtccttcgcagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552804 - DNA, 159 bp, Homo sapiens
aaatgtaggccccgtgtgacaggctcatgaggcagtgcacgggcgacctcatccagcccaacctgtgacaaggtgtgcgcactgctacaggggctacctgctgacctggacgcgcccgcacgacctccgacgaggagctgggcacacagactgcgcacc

SEQ ID NO: 552805 - DNA, 2292 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552806 - DNA, 133 bp, Homo sapiens
ctgagaggtactgagaatttaaatcctccagtatggatgttatatgactgaaatttattatgagtgatagttatggaccaacactcaaggtttgtttatataaacagccaagaaagccaagagaatagagata

SEQ ID NO: 552807 - DNA, 159 bp, Homo sapiens
taaactcctgacttcaagtgatcttcccgcctcagcctcccaatagtgctgggattaccaggcgtgagccaccgcgcccagtcagatgctcaatttaaaaagagaaccacaattcatttaaaaagagaaaaatggtgttctcacacaataaccaagcaa

SEQ ID NO: 552808 - DNA, 3952 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcagttatgttttttaaacctatatatggaagcgtaacctaaatacagaagagtcacaaaggagcaaactgtgagcttcacagtgcgggcacccggggagggaggcagctgcgctcaccccaaagccccagcaccgttcatcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 552809 - DNA, 83 bp, Homo sapiens
aaacccggcctttttttgggggacccccttcccccaaatttttcccccgttttttgggccccctttaaaggttttttggggga

SEQ ID NO: 552810 - DNA, 1003 bp, Homo sapiens
ccccgcccctgtccacaggatcgataacggcgcgatgaaataaccaagatttcactttcaagatggaaagtccgtcagactcagtctgtggttttacctagacactcctcaggcctctgtcgaatccatcatctccctatacaaatagttcccgaaaactaacctatgagatgcaacacttagagcataggattaaggaaaacaagattttcatttaagttcctcttacaagtagtggtgaaaccgtctgtacaatgtatgagacgtgaagaaaatgactcagagcctgttatcagagtaaaccagcatcttccacagaggaggaactgtttggcaatttcgagaaggtattatacatatagacagtgaatttgaagaagatacacacatttgaaaaatactttgaatgaatctcaatgtctgtgaatctcagtcacttgattctggatcatgctgatgctctccaaaatgagtttgtgagtgagaagacttgctaaacaaagattaaaggttgaaaaagccaaatgggtgaagcaggttcatggagaaagaagaccttcttcggaggctaaatactagtcgaaaatgtatagatcaaagagagtgatctgtctcagttacagtgtcaataaagaagtggagaagctgtagccagctcttgctttatgagttgcagtcagctgtgtctgaagagaagcaagaaactaaagccttactcaagttgatagaccactatgggttagatgataaattactacactatagacagaagtgaagaagaatttatagatgtttcaattcctggattttgggtccagagatatctttggagaaatgaccaccttgaatttacgagaatactttagggcccgttggttcattacatttatggcaatggagattgcgccattggaaacccgtggtgagtgcaacaagggccaacatagtggcacacgaagaacacttgtcacccggggtgaccagcaactcccggctcagcccc

SEQ ID NO: 552811 - DNA, 474 bp, Homo sapiens
gagaggaccccccgccgagccaacggccccccccttagctctcggcatttacttggggttcccagagatttcaccctcttcttaagtaatggtcacctttgggtcctgcctcccacaccagacagccccccacccagagcaaggctgccaaggccactggaccctgtccccgccccagccctccccgctgaccatcttccgcttggtgcagaggaaggcgtggcactcgaggctctggttgtgctggctttgggcgatgtatgcaaacaccttgtcgtgcatcttgtctgctgtgcaataggagatcctgtatatggacacgttctcaatgagctggttggtgaggttgtctgtcagaataattccccgtggcgacaccttcagagtcaccttctgcagcttcttcccactggccttagctgaagccacggtcaacccacaagccacggtcaaccacaagccacggtcaaccac

SEQ ID NO: 552812 - DNA, 226 bp, Homo sapiens
gttgactacggcggaagagacaaagaggaagtcagaaagagaaaaaaagagagacaaaaaagaagtcaaagagaaagaaaaagatatggaagtagtaaagaaaatagtgtaccctattcctttaaaagccagggtaaatttaaaacctataattgataattgaaggtcttctgtgtaaccctataacactccaataccaccttgctgtcagagtaaacaaggacat

SEQ ID NO: 552813 - DNA, 151 bp, Homo sapiens
  misc_feature (92)..(92): n is a, c, g, or t
atcttatattgttgaagatgggatcttatcttcttcaaatttaacacacctcaacaaccgagagaagaaataaatttagttattgctcagantaacataccacttccaaaaggcatctgatttttaaaaaattaaagatttctgtaaaacc

SEQ ID NO: 552814 - DNA, 602 bp, Homo sapiens
  misc_feature (19)..(19): n is a, c, g, or t
  misc_feature (41)..(42): n is a, c, g, or t
  misc_feature (50)..(50): n is a, c, g, or t
  misc_feature (66)..(66): n is a, c, g, or t
  misc_feature (92)..(92): n is a, c, g, or t
  misc_feature (102)..(102): n is a, c, g, or t
  misc_feature (155)..(155): n is a, c, g, or t
  misc_feature (179)..(179): n is a, c, g, or t
  misc_feature (185)..(185): n is a, c, g, or t
  misc_feature (187)..(188): n is a, c, g, or t
  misc_feature (191)..(191): n is a, c, g, or t
  misc_feature (195)..(195): n is a, c, g, or t
  misc_feature (197)..(197): n is a, c, g, or t
  misc_feature (199)..(199): n is a, c, g, or t
  misc_feature (201)..(201): n is a, c, g, or t
  misc_feature (214)..(214): n is a, c, g, or t
  misc_feature (240)..(240): n is a, c, g, or t
  misc_feature (258)..(258): n is a, c, g, or t
  misc_feature (275)..(275): n is a, c, g, or t
  misc_feature (297)..(297): n is a, c, g, or t
  misc_feature (317)..(317): n is a, c, g, or t
  misc_feature (329)..(329): n is a, c, g, or t
  misc_feature (335)..(335): n is a, c, g, or t
  misc_feature (350)..(350): n is a, c, g, or t
  misc_feature (352)..(352): n is a, c, g, or t
  misc_feature (355)..(355): n is a, c, g, or t
  misc_feature (363)..(363): n is a, c, g, or t
  misc_feature (371)..(371): n is a, c, g, or t
  misc_feature (373)..(373): n is a, c, g, or t
  misc_feature (396)..(396): n is a, c, g, or t
  misc_feature (408)..(408): n is a, c, g, or t
  misc_feature (414)..(414): n is a, c, g, or t
  misc_feature (431)..(431): n is a, c, g, or t
  misc_feature (433)..(433): n is a, c, g, or t
  misc_feature (437)..(437): n is a, c, g, or t
  misc_feature (450)..(450): n is a, c, g, or t
  misc_feature (452)..(452): n is a, c, g, or t
  misc_feature (466)..(466): n is a, c, g, or t
  misc_feature (468)..(468): n is a, c, g, or t
  misc_feature (484)..(484): n is a, c, g, or t
  misc_feature (498)..(498): n is a, c, g, or t
  misc_feature (506)..(506): n is a, c, g, or t
  misc_feature (527)..(527): n is a, c, g, or t
  misc_feature (593)..(593): n is a, c, g, or t
tgctgagtttaagttaaanacccatatgaatttattaaatnnaaaatgtnttaaagggcggcggtntaggagggggagtgtggtagggggangagggaaaanatgatgaacggccgtgggcatcccgtaggggcccggccccacccccgcccaanccaccccctcggcaacgctgcatnagcttnannatnattncnantngtgctgggctggnagggcgaaaaggctggaaaaaaaaanggaaaaagggaaaaaaancgcctccaaaaaaaaancctggcctgccccggcccctangtaaaaagctgggccctganctgaggcgggcntcccancgccccggcctgatntnttnagggaaanggcgaaangnaggggaggcgagggggccgggangcaggggtagtngtcgcnaagagccggaacaggtnangacnaattttgaataancntttttttttttctntnctggttttggaggggnttcctggggctcgntggcaganctggccccctgggtgggcttngtgggcagggacgtggaggcctcctccctggtggcggtggtcgtggtgggtgcaggtgtgggcgtnagggcccct

SEQ ID NO: 552815 - DNA, 1174 bp, Homo sapiens
ggtcctgccaatggcagctgtgctcagggggcagcaggcaggcggagggcgctcagacaggcttctcctcgcgtcgctcttgcatcctccatgggtcctgacgtctcttcgctcggggaggcctggctcgacacgaggtcctgtcgtcctgacgaccgtatgcgcagccttcgtctggggctcgctgagtcgcgcggtcacagcctgggcatctccgagagtggctatgcggcagcacgtgagggcaagggtagccccgtgaacggccccgggagggcacgagaggaagacaatcggggactggcagaatgagcgccgaacgggagagagcaagcacgtgagagaagatataggaacgaaagcagtagcacatgtcaaggacacaccgggaaagacagggaacgagcacagacaagcagggagcaaatgaacacacccatagggcatcggggtagcctacacattcacggagggcatgcgcatgagtgacacaggcgtggagcagtcacgctgcagcaagagaaaccttgggtcgcgtccgcacgataacgcctcgtttgacaatcacaatgggcctacagtacccccaagtacgaacacacatcgagcaagcggacaccggcccaatagccgttgggcctaaggcttacacgtaaccgacagtgcggaggagaatccccggagggccaacaaaagggctggagctacggcaggtgaagaagcacacatagctatgggatagacgacaggggcgaaacggagtcggcccaccatttcaggaggaatactcagacatggtgactcactttacaacaacgacaaatgtcacgaaaagggccacgcaagttggacacggacattgggctagcccaggaacgaggcagttggcgacgcgcagtagggaaaggtgcacccccgaacaggtgattgcacgcgggatcacacactatttgcacaaaaagaaccggagaaacacgggcggatcacccgagaaagaaaggagtatacaaagggaggggcagcaagcctttaacaaggcgacctgtgggaagaagggggatactgaacaacaagaaggctatacacacacgaggttaagccggcagtggaactatgaagagcgcgagacacgacacacgcacggtaacatacgcagctgcgcgcaaaccggcag

SEQ ID NO: 552816 - DNA, 161 bp, Homo sapiens
gaagacgctcgtaccaggaccaggaccaaaattgatctaatggtctacgggtcgtgtgtttaaggtaggcttgctgatttcagagtatgaagtgcattaggaaaatcaagctgattactgaggatgtcagggtaaacctccctcctacctccatggcatgg

SEQ ID NO: 552817 - DNA, 589 bp, Homo sapiens
  misc_feature (140)..(140): n is a, c, g, or t
tcaaccggggcctccggtttgaaacttcgtgaggattccagtacaggcatgtttgtagtcaagcattattctggtccagattctgtccattatgcggcctgtcctgcatgaagctccctgtgagagaatcatcgtgtcanatcgatctttcatgcggtgattatttctcttacacaccatgaatgttcagcacatcagacgtgagaaaactcatgtccattccatgcctgaaaaattattgtgttgggtctaaaatacaatgactgcatagggcttctgtctcatgcgcttgctcttggtgggtccagatcatgagcttcttccagtaagtcaggattgatctcataggcacgatcttcttagagaagaaatcatccgtgctataatcagggctgtggaaagtcatgctgcaattgtctgaccagtgtagttttctggaacccctgaaggcctcgcagaaggtacaggtgtttcctaaatctgtgtcgccgagaaggtgtcccacacaggggcgaccgggccgtctgctccagcagcagctgctcctgggtccgcagctcagccgcccaaaagattgaatcaatctgtc

SEQ ID NO: 552818 - DNA, 447 bp, Homo sapiens
  misc_feature (1)..(1): n is a, c, g, or t
  misc_feature (389)..(389): n is a, c, g, or t
nggaagggaagtggtgaaggtgtaagggctcctcagctccctccgtgaactccgagttcagtcaccccttcccgcgaaagaattcaaagaggaaggccagggtatatgtcatgcactgtgctacttgttatatgaacctgcccaggttatatgtcccgttctgaaaggccggcacattcatgggtgctcagcgttatgtgcaccttgttgtacacgttaacccattcagaatggtggtccagtttctcagcttgcagggcctctcttgtcatgaacccaaaggccctgttaatgtctttgaaatgaacgtgcttgaagatggcatcacggccttacagctcattccaccccacagccctcaggtttgacaacatcgtggtctctctccncacgcgctcagtcgtgtgtgctatcgcccgcgtgccgttattcctacagcccgggatg

SEQ ID NO: 552819 - DNA, 857 bp, Homo sapiens
ggcgggcgcggtggctcacgcttgtaatcccagcactttgggaggccgaggcgggcggatcacgaggtcatgagatcgagaccatcctggctaacacggtgaaaccccgtctctactaaaaatacaaaaaaattagccgggcgtgatggcgggcgcctgtagtcccagctactcaggaggctgaggcaggagaatggcgtgaacccgggaggcggaggttgcagtgagccgagatcgcaccatgtgcactccagtctgggcaacagagtgagattccgtctcaaaaaaaaaaaggaaagggaaaaaaaatttagtttatacctctttcctgtgtttcaaccgccttgaaattttctggaacattccaaattcagtggaataatccaaaacaaattttatacggttaacaatatttaccttccttatagtaatagtatactttaaaaaggccctcagggtatatatcttctaaacagtacaattcagtgcagttactttaaccaagtatgtctctagtggagaacaattaggcctatttcactggtgtgtaagcctcagtgctaaatgggtggccaataaatattcgctagaattacctgaatgtgtaaaaccattcgttttgtgtgtacaatggcaaaaattcaaaggggcctgttttatgtaatctgtgagattattattaattcggatcgagaaagagagcgcgggggactagactagtttcattttaaaacttcattattggtgtttcgaaatcttccttttaagtatttcaacatgggtgcccaaggtttttggttgacaaggcaatttgtttgaatgtgttcccctatagaattgtgattggaggatgtaat

SEQ ID NO: 552820 - DNA, 873 bp, Homo sapiens
gggcggcggtagatggaggagggaggccgggacaaggtcgtccggtgcagccccagcagtctccagtcggcgggcccccggcggtcacggtacgagaagccgagcggtataggagcggcgggatgccggggacaaggacaaagaacaggagctgtctgaagaggataaacagcttcaagatgaactggagatgctcgtggaacgactaggggagaaggatatcatcgcctgatatcgagccatgcgactggtaggaacttgtcgaacggcgagcattcgattgcttcgtagcaatcttcgcatggacgttcaggtggcccaaggcctctcagaagtttctgcgtccacgctatgggcgaaactgaaggtaaagtctagtgaggaacatggggccctggggagaataagcgtttggctgctgacatcatctccgtcttgggccatgaccatgagtggggagcgtgagtgcctcaagtatcggctagtgggctcccaggcaggaattgggatcatggggtcatgagtatgtaagagcatctggcagggagaagtggctaaggagtggcaggagctggatgacggatagaatcgtccagcggcgagccatctgcatcagtcctggtcgaagggagatctgtcgcctatacacttgcgccacaaatgcacagcatgacggctggcgacctggcccatgcgacatggcgccccggtgggacattgcctgcgggacaggccagttgactgcagcactggccttatgtggcaagggtcggccgcaccaggttttcacacggtggaggtcaactattgcggtttccttacaccgctgagaaactccttggcaatatgcgatagcacgacccgcacctgtgg

SEQ ID NO: 552821 - DNA, 967 bp, Homo sapiens
gaagtcatcaccaattgtatggagcttcatacgtatgatcccattaactcgatgctgagtatttacatggataattctagatatatcgatgcgcacgtgtgcaactatgctggcaacatggaggcgaacagaaaagaaatgaagcttgactcggcttctggcttctctactacatcaaatatcttgtatactggggcatatatgcgatcaaatagttcgtacagagcagcttagcggttgaagttgatgaagataagaaactatgtcactcgatatgaaaatgttccggtaatgttgactgcctcaggtcttggcttatctattctggagaatatatgcagtagatcctctcccatataaagcagcaactacgattttcaactctactgcatgtctatgaagtggatatttgaaactagtgttcacggtgacattggtgaccaacctaaagttcgtgtcatgacgacggtaaggtctctagatctgagctttagaaatttacgtaaggctacactgagttaatctagaaatttagcaaaacctgtgtagccgtattcccaggcagtgcagaatatagtaattaagtgtcagtaagtgatatggaaggctagggtacaggcaccggagacaacctgatgtcaccttgctagtaccttctgtattctctaacattcagtctaagaatcttaagcaccttggtgttattgaatcaggtggaggaggccagtaagaaacctcctgaggtgatttggcgaccaagtggtgcattgtcaccatgcattctgctgaatcatccaacaaactggtccttacctgaacaggccacgtatggatgtccctggctggtggtcaacaggccccttccacttaaatgggtcggcgatcggcaaagggaaccacaaggcaactggcggcaataattgtgtgcattaggccgcaccaggcattaaccttcacaaaatacagg

SEQ ID NO: 552822 - DNA, 166 bp, Homo sapiens
cacataaggaaatgacgaagagagtcagctactacgggcagtcttagccaacgagactggactggctcgcattgcatgagaccggctgaacggcgatgggcactgcggctgaccacctcgctcttcagtacgactcgccctgaccggctacccacgacatacgctc

SEQ ID NO: 552823 - DNA, 143 bp, Homo sapiens
  misc_feature (56)..(56): n is a, c, g, or t
  misc_feature (114)..(114): n is a, c, g, or t
  misc_feature (137)..(137): n is a, c, g, or t
gggccagcaagcccccacctgacttgaccttaggcccatagagagggctgtgcgtnctgccccagccaggatctggtcgctgccccaggggactgatgggcagagtgcctgtgntggactgtgaccatccctgatgncctgac

SEQ ID NO: 552824 - DNA, 435 bp, Homo sapiens
  misc_feature (248)..(248): n is a, c, g, or t
  misc_feature (288)..(288): n is a, c, g, or t
  misc_feature (327)..(327): n is a, c, g, or t
  misc_feature (384)..(384): n is a, c, g, or t
  misc_feature (417)..(417): n is a, c, g, or t
  misc_feature (426)..(426): n is a, c, g, or t
cagaaagtggctgctggcagattgcggcaatcctcaacatcggtcaacgtgcgaagatccgctgtttgttaccaacgttgatgacacccgtctggatgatatcgcggcgtggacttaccgcgcaccggttgaagatcaggcgcgtttaggttttgccatcgcccatgcgctggataactctgcaccagcggttgacggtatcgaacctgagctgcaaagcaaaatcgacgtcatcgtgcaggcactgncaggtgcgaagaaaccgttgattatctccgggacgaacgncggtagcttagaggtgattcaggcggcggctaacgtcgnggaaagccctgaaaggtcgcgggcgctgacgtcggtatcaccatgattggcccgttnccgtcaacagcatggggcttgggcatttattgnggttggcgnttcgcttga

SEQ ID NO: 552825 - DNA, 290 bp, Homo sapiens
tactacatactacctaccacgttcaggctgaggggtagcagcgttgtcatccccctcagtcttctgacctacacctatacaggaccttgttggtgcatcagcgctagcattatggattgcacggtggagaccacatgctgagtgtttgcagatcagaggagtgctcatctgtctctggttactgcagtagcctgtaactggatatcttggggcgtggggtgaccacgggaacaaggaaccgtggagaagcatcagttcttccacaatggctgggtgccgataaatagcga

SEQ ID NO: 552826 - DNA, 243 bp, Homo sapiens
ggcgacgcagggagcaacagaggctcaggtgtccctggtatgctcaggctcagctctgacataccatcagagctatggcaggttgagaagggctctaaggaacaactgtggcaggttccagcatcgtgcgaaagactttggagtcaggcacacatgagtttgcaccacaacaatgccatttattagccacattagtttacaaagtatctgctctaagcctcagtttcctcattccaaatgggg

SEQ ID NO: 552827 - DNA, 398 bp, Homo sapiens
atggacaggccagcagattggtcatattcactgtagaatactgttgatagtgctaacgtgcatgcatgaggaacagtgtcgtagtcagcaccttcatggctcatcggctccgaagttaagaaaaggcctgtggaagcaactggatagatgcctcaccatataggtgtacaagattagatgtctgtgatatactgaatcacctcacagcgctctagccttcgtcaggaataccagtgctaagatctccagtgctgcgtcctccgcaagaatgctacgctcatgtcggcgcaggcggtctggtattctgtgtagtcggtacgggaaccccagaacagcaggtggacgcggacgagactttacaataagtagtcggcctggggcttcgggcacgcaacggg

SEQ ID NO: 552828 - DNA, 105 bp, Homo sapiens
gactgtgatcctcgtgactggggtcctattgaggccagtggctgaattatgggcttggaacatataggatccgctattattcacagtgatgtcgggactaaagag

SEQ ID NO: 552829 - DNA, 128 bp, Homo sapiens
agagatggaacagaaatctcggtctttgtgtatcagtggcaccgtcgatctgtagggatcatctcatccctcaggtgactttatcatgtgaactctttatctgtcaaccctcccccatggggaagaga

SEQ ID NO: 552830 - DNA, 860 bp, Homo sapiens
tctcgagtaagagggaagtgcattctcgattccgtagacggtgctccgccggtgctgcgcgaaatgtaacttccggctgttgcatggctatgtggtccatggaggaccctcgccttcgtactaggtaactatgggctgacctctttcctcatcatcaaggatcagcgatcgatggtgcgcgtgcttatgggagcattgaggcctctcaagtctcatataactggaccagtgataggctgtaggcacatattacatatgagaatcatcatattggatcaactgggcttgtataagatgatggtggataatggatggggatgtgactgttactaatgagtggggtcaccatcttaagcatgatggatgttgatcatcagattgccaagcgtgatggtggcacattgtccaagtctcaacgtgatgatgatcccttggtgatggaatcacgaggagtggttgtacctggcgtggtgccttgttctgatgaagcggagccagttgctagatcgtggcattcatcgcaatcagaatagtcgatggctatgagcaggctgctcgtgtgctattgaagcactgggagcttgtatcatgcgagtagtcgttccgtgtgtgtctttcggcgtcaaccgtattcccgttatttcagagggttccaagccacgtcctggtctccatggggtcacctgttgtcaccgtcggattggttgggctgttggtattgcgttctctctgtgatgattggggtgggagacgtgtgcttggtgtgttttgtggaggggttgccggtcgtgtggcctttatggttcggcttgtttcggcaggtttgctccctttccacatgttcctgtactgttctcttg

SEQ ID NO: 552831 - DNA, 1107 bp, Homo sapiens
  misc_feature (672)..(672): n is a, c, g, or t
ggtgaagaaaaggccacctccaaagaagaaatgggcatgagttcagctcacacatcaacaagctgagggtgaaagcgtcagaggcagatcaaggtcctgggagaaaccgggtaccaggcatgtgaaaccagaggatatcacgaaggctctgaattaatgtggcgaaatgaacgattgtacgatagttgggtaaccaagagagtgggaaaggctgcactcaagtcaggtaggaggagagaaagaaagagaaaagctcggtgcatcaggtgtaagcgttatcagataaagctctagtctagaacagaaggtagaggctcctctttggaggtcatcccgtgctgtcatcccaggaactggaagtttgcagtctggcatgcgatcacgtcaaggcgtcaccatgacaattatctcatggcactcccggtgtgtccaaagtgacgtatcatccgtgacgctcagactcttctcgctagagattagccctggggccagtttctccaccgggtgaaccctgtccctagcttaagcaatccccttgggactaaaatatatccaggtaaatgtgtctttgcatggttcagcacggcatagaggagggatgtgatccaagccattggttatgtgcaccacaaggggaattaagatcacttacccacagatcttcacgtgagnacggtaccacaagtgtggaaattgcgtagggcacgtgtttcccctcttggggccgcgtacccccttcaacatagggtagatcccgggggccaatattaccaagggttggcattgaaaggtcccaaaacatatgtgtggcccccttggggacaccaagatattcgcttcatccagataaaatttggctctttacaccattaaattacgcataccaaattaggatagaaaaaagctagggagagtatttttccaaacgtgggggaggattggagaggcagaagaatagaggaattaaaattatagggaaagttacggcaaaacacaaacacgttggcggacagggataaattttatacaaagaagcagtacagggtttgcaacatattgttatcccattaaataaggttaatttatgtttcttttaagagtggaaaa

SEQ ID NO: 552832 - DNA, 532 bp, Homo sapiens
ggggaaaaccattttcccccgggaaacggttttgcccttttttccccccggctgaaaattcccccccccaaaagggaaaaaaagggggggccccccccgggggggggccctttaaaaaaaaggggtccccccgggccccagaaattgggcccggggttttaaaaaggggttttttttttaaaaggggggggggtttcccccaaaaaatttttttggggggggcctttaaccaaattttttaagggaacccgggaatttaaggggggtttttttcctttttttcccccccctttgggcaccgggggccccccccctttttgggccctttgttttgtttttgaaaacagggggacccccccggggggggggttttccccccggggatctttaaagaaaaaccaaaatttttttgggaaaaaaaaaaaattttttttgaaaaggtttaggggaattttttcccgaagggggggtttttaaaaggggttttccccctttttttaaaaccccccccccatttaaaggggccaaccca

SEQ ID NO: 552833 - DNA, 1437 bp, Homo sapiens
  misc_feature (543)..(543): n is a, c, g, or t
gcctggaggggtgggtaccgggaccgcactcagcctggggttgggaggcggcctcctataggaagcgacctgggacctacgatttttagactgactgtgggttcactggaataacacaaggaagaaacaaatgagcattgcaggcatcgggactgtcacatttgacaagatcaaagctgcaggaacaatggcacagtgacggtccagagagatggcacagggatctgtggcttggattgctgatgctgtggcgagaagaccaagcgtgccttatgaggatgtcgcaaataccactgaatgagcttcctgaacctgagcaagacacatggtggcaccacagaatctgtcaaagaacaagaaatgcagtgaccagacttagccttacagtacctccatgagaatgttccccccattgggaaacttgacgcttggttcctttccttgtggatggatttctcaaagtacacagataaagcatggttcgtacagtctccaaattcaaaactttgagtaataaaatcagactcaaaattgtacaccatntagtttgtggtagcaaagtgcatgggaaattgattgggaaatgcgaattttcagaatggtgaatattcggtcttaacctaaaatttcatgggacgtatttgacctgctggtaaattgcttacttgattggtggtgtaggttaactccataatgtgtgcggaccatggttggtgtgagaggacaaggcggacgggagcattcacgcaggaggggacgagtagatcctgtctctttcgtctaactctccctcgttcttcggctaccgaaaggaacgcaccagaaaacaaacaaaagacaagtaagagatcggcacactaactgacaacgcggagagcgggcaaagacgcaggcaaggggagaggtgagagacagagagggccacagcgaggcacggagaggcggggcgcgcaggacgcacgaaaccgaggtgcgagcgagcagccacgaaggaacgaggggcggagacaagcgagagagagagaaaccggacgaggaccaggaagagagacggaaagccgagagacgcgcacacagcgacaccgaccgcgaagcggcgacagcgaagcgagcaacggagagagaaccgcgggagacgagagggggagaagagaaagaaaaaaaaaaaagagacaaggcgaaggagcgagaggagaagggggcgagagaagaagacaagagagaggagcacgaaccgaagaaaggagaagaaagaaggagaaaaaacaggaacgaaaaggaagaaaagcgagcaagaaacaaccagcaagaacgacaaacagcagaagggacagaacgaggacggaaacgagaggggacgagagagagcgagaggaacaaaagaagagagcggaaggaagaaggcaagcagaagaaagaaacagagagacagagcaa

SEQ ID NO: 552834 - DNA, 172 bp, Homo sapiens
agggcactccacaatccattccccttcacgccatcgaagaagaagaagttgttgtgaggagggtcccgctgagacaggcccttcacaatttcctgtgccaaatatccctccaaccacctgcacacactcggggccactctcgcgagaacgcagtacctgcacacaagtcctc

SEQ ID NO: 552835 - DNA, 154 bp, Homo sapiens
atcgaagagcctaaaggaacgcaccccgttcgagtacgatatgtaggtatcactgacatttcttacccgaagatcatcaccgacgcacaggaaaatgctgcacgtcgccgtgaacagattcagcaggaagaagctcagcgtgaaatctctaagg

SEQ ID NO: 552836 - DNA, 434 bp, Homo sapiens
  misc_feature (71)..(71): n is a, c, g, or t
ccacaagatctccacagcaaaagtgggaaatcaacccagtgaagggagcaacctggtgcggcctacgtccnatctaccgctacttccgaagcacggtcgcaagccagggaccccccaggcccccacggccgcccaaggagcaggcccccagacaagggtgcccggcctgccctgccccctctctgagagcctggccagctcttcgcccctcacctttttggaaactctggagtattttatggttccacctccccacctccctcccccgtcagtgggatgattggggagggtttgttcaggggagggggggacccccctcccctgccttgcccggtgccaacttcctttgccccaaggctggtcccagggccccctcctttctgttgtgcccctctccccaatttcattaaagatttcatgaaacattacccctg

SEQ ID NO: 552837 - DNA, 112 bp, Homo sapiens
aacagtcattttatttaacagttgttagatatggggagtagtgtgattgaggtggagtagattaggcgtaggtagtagtagaggttaatgagggtgatggtggcatatgatg

SEQ ID NO: 552838 - DNA, 207 bp, Homo sapiens
ggctgcacgtaaacttcagagaaaaatcttaaaagcagaccatcctttttggatggtctattctaaggtagaatggttcaatggtaactgactaaaattggatgttaaagatatttagggtttttttggttttctcttaatttttaatttggttttcaggtttcctggtatattttggctgtactggggccggttttagatgggttt

SEQ ID NO: 552839 - DNA, 172 bp, Homo sapiens
tcagctcggaccggctctgctgggctcctggcagcacgtgtgcagactagagacgattgcagcgagaacattgggagatctggtgcggaaggtattggagacaataatccttccagatattccggaacgtcttgccgaagcatcaggtgtgtgtctaaccggcccatgtaca

SEQ ID NO: 552840 - DNA, 364 bp, Homo sapiens
  misc_feature (282)..(282): n is a, c, g, or t
aagagacagggttttgctctgtcactcccaagctggagtgcagtgacacgatcatagttccctacagcctcaaattcctgggctcaagccatcttcccacctcagcctcccaagtagctaggaccacatgtgtacgccaccacatccagctaattttttaaaaactttttgcagagatggggtctcgccatgttggtcaggctggtctcaaactcctgggtctcaagcagtcctctcacctctgcttcccaaagtgttggggattacagggcgcgacaactngtggctcagccatttttgtttattttcaatcttctatcttgggatttaaagttttctatgtacagctttcttttccgggggt

SEQ ID NO: 552841 - DNA, 137 bp, Homo sapiens
ggatccgagctgaatacaccaaatcttattaaaagcgaaatatcagccttctctctctctttggctatttgaaaggtagtcttcaattgggcaggcaactggcttctctctccaaatagtaacaggttggggtatag

SEQ ID NO: 552842 - DNA, 882 bp, Homo sapiens
  misc_feature (1)..(1): n is a, c, g, or t
nggcgcgcctcgtcctgccaccccgctgtgttgtgcctcgagggcactttccgtgtcttttatatgtgggcggcgtcacaaaccagcggggttggtcggcgcaaccttggggcacgcccctccgtgggtccgctccgaagatacgcaggtggtgctaccacccgccgcgccagttctgtcaagcgcgtgcaccaccccgcgcgctcttccttcgggtggtctggagagcccgcccttttccccctggggagcgccgtataccaagacagatcgcttggggcctcaactacgcccccccccgtggcgcccaaccatcggtgggtgacacccacccctgtggcaattgacgatacagccttggcactaatttcccaccccccggcgcttctgtggtcgggggcatccccgcgggacattccccccgggtcatttggcgtgggtgcgattggcgccctgggagagtcccttcctgcttgcacccccggggtggcgcggcgtggagtgtctctcccggggcctgccaaaatttgtatccgcgcccgcacggtcgtcctgccccctcccctgtgggccaagccggccggcggcttctcgcactctctctcgcgatccagaaataacggcgacatgagtgtgttctaacacactgacataacctccccgggtgttttattaaagagcccgtcctcccccgacaggagctatcaaaatcaaaccagagggactattaacaaattctgcgcacaatgtctttttttttctgtaaacctaggggcaggacgaactatttgttgtcttcgtgactctcaacaccacacgcatctaggaacttctttcttcccccaggcattaatttagaaaataaaaaaccccaacaaaaca

SEQ ID NO: 552843 - DNA, 169 bp, Homo sapiens
caaatatagatatttaacgaaagctgcctaatactggcgggagacggcttaggcagaagcactagttactttgccaggggcccttcaaaagtcgctggcgctcagaatgctcttagtcgtgcttgttatgtgagcctttcgaagagactaattttctctcggaccattt

SEQ ID NO: 552844 - DNA, 242 bp, Homo sapiens
  misc_feature (105)..(105): n is a, c, g, or t
  misc_feature (114)..(114): n is a, c, g, or t
ggaatttcccccaaaagcctgacttcccacctcagcctcctgagtagctgtgactacaaatgcgcaccaccacaccaagtaaatttttgtatgtttttgtaaacngtcttgccntgttgcccatgctggtctcaaactcctgggctcaataacctgcctgcctcagcttcccaaaatgctaggattacaggcatgagccatcgcgcctggcccttcccatgtgttcaatgtgcctctttgtg

SEQ ID NO: 552845 - DNA, 748 bp, Homo sapiens
aatggacaccctctttagtaagtggtgctgggaaaactggataaccacatgcagaataatgaaactagacccctatctctcaccattacaaaaatcaactcaaaatgaattacagacctaaacaaaagactaaaattataaaactgctagaagaaacacataagggaaactctgctggacattagtctaggcaaagattttcatagctaagacctcaaaagtacaggcaacaaaaatagacaaatggactatattaaactaaaaaccttttacacagcaaaggaaacaatcaacagagtgaagagacaaactattgaacagggagaaaatatttacaaactattcatccaacaagcaattaatatccagagtatacaacagcaaaaaaaacaaaaaacccctaatatctccctttaaaaggtgccgcaacaagccttgcaatagattttccccctacgaggtcagatgcacacgggtttttgaacacgccgtgacggtcccttagtcttccaagaagactgcaactccaaccctccacaatgaaggctgtccactctaactccccgtagaatcttctccccacaatgctatatctgacacacgccactaaggccactacgatattagcccaaatactcaccaatcaaccacacaaacaatttgctgcccccgcgccccagaaacgcgctcacaaccaccctgcgccacccacgcccacgcccatcggacactgtcacagagccccaca

SEQ ID NO: 552846 - DNA, 718 bp, Homo sapiens
  misc_feature (431)..(431): n is a, c, g, or t
  misc_feature (594)..(594): n is a, c, g, or t
  misc_feature (642)..(642): n is a, c, g, or t
ggtgattgctggattgactcgttgtgctgtacaccatatgtcctatgcagccgagtctggtacccttgagtaccgcacgctgggatgagcccttcgcagttcctgaagggcctggcttcccggagccccctggtgctgtgtggagacctccatgtggcacctgaggattgaccttcgccacccccagggggaccaacaaggatgctggcttcacgccacacaggcgcccaggcttcggggaattactgcaggctgtgccacctggctgacagctttaggcacctctagcccccacacacccctatgcctgacaccttttggacttatatgatgaatgctcgatcccagaatgttggttggccccttgagttactttttgttgtcccactctcgtgttacctgcattgtgtgacagccagagtccgtttccnaggccctcggcagtgatcactgtcctatcaccctatacctagcactgtgacaccacccctaaatcactttgagcctggaataagcccctcaactaccattcctctttaacactcttcagagaatctgcattctattctcatgtataaactaggatctccaccnggctcctgtgatagagttcttttagcccagattttttatttgaggttntgtttttaaaaaaatgacaagactactaatgactttgtttgaattatccacatgaaatccagagccatagtttcca

SEQ ID NO: 552847 - DNA, 952 bp, Homo sapiens
cccagctccgggggtcccgcagtcgctggcccgggacgcgccggccgggctccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccagggggtcttgcttccgaagtggtcctgctctttgtctacgcagatgattgccttgctcacggtgtggcaaagattgcaaatcttactgctggtgatggaaccacgccctactgttgctcctactacgcttatatcggagaatatcctctcgggcactgccatcgcgggcatgtcttgggaactagtactctctactcactgcgcggtcatctgctgggactcgccactatgcactctgcactgctgcatgaagaaccacacgggcgaccccgcgctgggcactcctcaggacgacctcacatcaacaccgctctcctcctatcctgcaggcaccaccaccctaccggtcacgcaccactcacactggaatactgtgcagcactcgcctccctccatactcccccacccccacagcgctccacgcacagccgtcctccaccgccctgccctactcctggcacaccgcccccgccacctaacctccatgctcccacgacccacgaaccactgctgcccaactggcgccgactctctgccccaggccacccaaccaactgccctctactccagaaacaccgcgccacgaccagcacacccgcctccacccgcccacacaaccacccacggcgcgccccacaaccgccgcccacgcctgcgccccacccccgcccaccgacacaccacccacccccccaccccgccccccacgccgcaccccccccg

SEQ ID NO: 552848 - DNA, 126 bp, Homo sapiens
tagattctgaggatccctatgagcgtgaagagaggaatgagataaaagcccagacttcaggaaatgaaatagagagaaaaagaagaaatggagaagaagagggaaatggattaacttaggagctca

SEQ ID NO: 552849 - DNA, 225 bp, Homo sapiens
gcagataattgtcctgcaagaagctcctggactgatcaggcggaggccctgcaggtctaagaccagggaatcacgccagacgtcttgagtagggcatccaggtggagaaggaggagatcatcaagactttatccaaggaggaagagaccaagaaataaaacctcccactttgtctgtacatactggcctctgtgattacatagatcagccattaaaataaaacaa

SEQ ID NO: 552850 - DNA, 978 bp, Homo sapiens
  misc_feature (34)..(34): n is a, c, g, or t
  misc_feature (77)..(77): n is a, c, g, or t
  misc_feature (82)..(82): n is a, c, g, or t
  misc_feature (90)..(90): n is a, c, g, or t
  misc_feature (104)..(104): n is a, c, g, or t
  misc_feature (106)..(106): n is a, c, g, or t
  misc_feature (120)..(120): n is a, c, g, or t
  misc_feature (171)..(171): n is a, c, g, or t
  misc_feature (173)..(173): n is a, c, g, or t
  misc_feature (182)..(182): n is a, c, g, or t
  misc_feature (185)..(185): n is a, c, g, or t
  misc_feature (224)..(224): n is a, c, g, or t
  misc_feature (237)..(237): n is a, c, g, or t
  misc_feature (270)..(270): n is a, c, g, or t
  misc_feature (305)..(305): n is a, c, g, or t
  misc_feature (356)..(356): n is a, c, g, or t
  misc_feature (420)..(420): n is a, c, g, or t
  misc_feature (442)..(442): n is a, c, g, or t
  misc_feature (450)..(450): n is a, c, g, or t
  misc_feature (462)..(462): n is a, c, g, or t
  misc_feature (494)..(494): n is a, c, g, or t
  misc_feature (507)..(507): n is a, c, g, or t
  misc_feature (631)..(631): n is a, c, g, or t
  misc_feature (633)..(633): n is a, c, g, or t
  misc_feature (857)..(857): n is a, c, g, or t
  misc_feature (868)..(868): n is a, c, g, or t
  misc_feature (881)..(881): n is a, c, g, or t
  misc_feature (898)..(898): n is a, c, g, or t
  misc_feature (902)..(902): n is a, c, g, or t
  misc_feature (904)..(904): n is a, c, g, or t
  misc_feature (957)..(957): n is a, c, g, or t
tgtttattttatttttatttcttttatggtaatntttttttattagatatatttttagctattttatttattttatngtggntattttgntttaatttatttancnttttttaaaagttnttatttatctctgagtaattatctcacagttaaatatataatatctgaatngnatgaaaatntantttttaattatttttaattttttgaaaataattactatnaatgttgctaatntccatttcttaataactgaacttgattacctanaagtttgttaagaaagggtcatttgtaattttttnttcttaatatattcatttacaaaagcagttagaaattgatataacatgttnaaagccattagatatagctaaggctcgtttagctctatctgtaatcaaatccagattcatggantattatgaagtcataaaaaagnatgagttngtgtcctttgcngggacatggatgaagctggaagctcatcattntcagctaactaanataggaacagataaatcaaacaccacatgttcttactctataagtgggagttgaacaatgagaacacatggatcacagggaggggaacatcacacactgggccctgttagggagttggggggcnanatgagggagagtattaggtcaaatacctaatgcatgtggttcttaaaacctaggtgatggtttgataggtgcagcaaactaccatggcacatgtatacctatgtaacaaacccgcatgttctacacatgtataccagaacttaaagtaaaataaatttaaaaaaatgaacttttgcactgttacattgtaatatggagcttgaatcacaagttatttaaacccnaaaaacaacangaacctccaacanctcaaaggtgctggtantttnanatgtgtttggatagaagtatcttttaaatctctctcttaatgaatgggtattnatctatgatttgtggggctgc

SEQ ID NO: 552851 - DNA, 1155 bp, Homo sapiens
tcgcctcgtgtctcgatagatgtctgtgagcttgttacagatgttgtttgccgctgtcgtgtgttgagcgctggctggtacagatgagtctctggaattgtctgttggattgccgcttagagtaatctttgttttatgagtctcctggtgtaagacctcctgaacggtcttctgatctaggtgtacccccctgaggttttgcgtggacgttatctcttgtcatttattcctgggtgacgtttcattccgaggttgccgtctttttaggcgactgaggtttgtagagaaatttggttcactcgcttttttcaacaagttatgttgccgttcccgtgtgacttctgtgttggaaacaattgttttgtgttcttgacatttgttttaataggtgttatagttgtagtccgacgccaaatgagatagagcatggcctttttctctgctattccatcatcaatgttattattgactcgtgcgctactggtgcctaattacttggcattgttttttggtttgaagcctgttgtaaagcctgtcagaatctactcagtagacccgcgggttgtagcacgatgctcgtccgtatgatgttccactatctccgtgattccagacgactaccaaatgtcccgttaacagagttctacctgaaattgaggttgagggctctcactagtgtgtagtgagttatctcgtcgtacgatttggtcacctcttcttatgtaccagcggagtgtcggtatactacctgacaagaagcatccttggaaaccatacaggaattgtttctattgtcatttgaggaaatgttttcctcttctaactcccagtaggaggtttagaacagaagtttatattcatggtagctacaattaactgttagcatacctgatatgtccgtatcttcgttataggttagtctcggatccgactaagtgtgcttaatgcctcgaggcacaagtagtgaactatgtgttgatatgttatgaagaaaagaattgttgtaagtcttttgattctactctatatgctggactgcattcacatcatggcagtgaaaataagtcagcttctttacagatggtatagttgatagatacatggattgtgctttgtgccatatttgtgccattcttttaacgaaccatcggggac

SEQ ID NO: 552852 - DNA, 298 bp, Homo sapiens
tgacggtgacgttgccttggtctggtggtggtggggttgtgtgtggcagtcgtgggtccgtggctggtggtgcctgtggtggttgtccgtgtgagtggtggtagtgtgtgctcttggtagtcctgtggcgtggttgtgccatgtgctctgctgtcaccgtgctgtagtcaccgtgaacggatggcagcaaacgtagctgaatctttgtgtgaggacatgtcattcccgtctccccgtggggctgccaggtaggccccagaatggtccccggagaaaatgcacagtgcagcctcatggc

SEQ ID NO: 552853 - DNA, 551 bp, Homo sapiens
  misc_feature (7)..(7): n is a, c, g, or t
acccagnaacagctatgaccctcccacctaaaaactaaagcagctattcacaattcacttgtgtactcttctctggccccttttaatcccccaccccacaaggctatctatcactaaacttaatttggggatttctgtgaccttttaagtttttatcacacatgtaactatcatatacattctttgatctcattcacttttgagctcaatgaaaacagcatcatgccattgagtagactcaagagacttgctttgcccctatttcctgtgattcacctttattgccaagtgtagctgtagttcactcaattttactgcatcatgatatcttataaaaccactttcccatggacagaactttagttattcctgttactagcctgattatattgccatgaccaaaatgtaagacatggctgaacatgcctggagttctggccttgttcacatctgtgaagtgtaactgttctccagcactgatatgtagcatgtgactacttacagatctgacattgtgggccacgttcttgcaaatgtcatagctgttcctg

SEQ ID NO: 552854 - DNA, 150 bp, Homo sapiens
aaaccaaccaaccaaccaaacaaacaaacaaaatcaaagcctgtctgctgtctgccagtaactggcagccattctaccacttcagttcctaagatccaatgagcatgactttagagtgcagacccctctctgctggagttcagtcgacgc

SEQ ID NO: 552855 - DNA, 367 bp, Homo sapiens
cccttcccagggtaaaagcaattcgcgtgcctcaacctttcgagtagctggaattacaggcatgcaccactatgccccgctaatttttgaatttttagtaaacccggggtttcaccatgttggccaggctggttttgacctcctgacctcaggcaaccggcctgccttggcctcccaaagtactgggattacaggcatgagccactgggcccggctgccaatttactttttatatgacacttaaaaactggtagactaaactggggggggtggtgtgtacctctaaccccagatccttgggaggctgtgggggaaggatcacttgagcccaggagtttgaggaccaacctggccagtatgtcaagac

SEQ ID NO: 552856 - DNA, 1123 bp, Homo sapiens
ggatgctgtcccgatcccggtgctggtgtctcgggacgtcagccgcgtcgctctcagccttccagaaggggaacgtgccctctatgtggagacagtgcccgtgccatggtgtgtcatcccgtatagtgccagggggagcactaggtatacccatagatcgagctagtgaaggttgtcaattaacaacgagtgtcttcagatgattcgctttttcaagaactactaggctgtatgccaggatggacttggttacatgtctaatagcccaggagttgtgctggaactctgtcactagaggtgcagagtgtcatggttgggagaatacgctgaagtgggatgactagattgtagaacgcatgaagatggtttggatgtaggattgaaagactgagtgttggaaacgtcgtgtgaagggttccactaacgaggacaagatgagtcgatagacacgggaaagcaccattacggtaccatgcatgggcgggaaacacgccgacagggacggctacatcacatcgtttaacagcactacgagagacacaaacgctggcttgctgggctgccttgacattaaacgggcccaacggcccggcctgggaacgacgtcccttagctttgcgttgcagagaaccccacacaagaacgccaaggaaaccgcatactacggcaacgcagagcacagtgcacgtcacgccccagtgcgaaacaaggcaccaatctaccacgacagtccaagacattgacccaagcggtgcgcccaccatgcaggcggccacgtcaacgaaggccagcaccctcaatcaagagacatacaaaccttggtggtaccttgccaaaggttagccatatgcccgacaggcgtgtggccacccgcgagcccaccgtacccttgcacgcggacagacgtaagccatgtgacacgaagtggtcatgcaggtttcacgagaaaaagaattaagggacacgaaaacaatgtaggcacagggaagtgaccggacaagcaggacagtttgtctacagtgcggtactggaaaaggaaggacccaggaactgctgtatgttggaaaatgggttggtcgagaaatttggtaagctgcagacttgtagagactggagtgtagac

SEQ ID NO: 552857 - DNA, 261 bp, Homo sapiens
gtggtgtaccgtactgggttgggtttgtaccactgagctatgacaagttcttccagaatctaactttagagctctaaatattcacggctgaccacaaagatacatttctgagcaaaactgagtcgcgctatctgcaacctacgagggtcattagaggttctatgtacagtgttacctgcactggaaaattcaatagactgaagacttaatacccttaagaactgccctctcacgtgtaacaccacagtagcggggtaccga

SEQ ID NO: 552858 - DNA, 111 bp, Homo sapiens
cgtgaagcatgatagtggtattgctcagcttctggggaggctcaggaaacttacaatcattgcacaatgacaaagggaaacacctggggcatctctagagtctgagctgca

SEQ ID NO: 552859 - DNA, 578 bp, Homo sapiens
gagagagagagagagagagagagagagagagagagagagagagagagagagagagagagagagagagagagagagagagagagagagagagagagagagagagagagagagagagagagagagactctgtgtttttttatctttttttctttttcttaccccttttcttttttctccctccattaaatcattttctatttattactgcttgttttaccctattgattgtgcttagaacttcaacgtcttttgtccctttcttgtatcccacgtcccaatcgtttctcttctgtcttcggctttcctttaccccttctcgtgctttctgcctacaccttttatcttgcttttgtactcttgtctctggggtagctttttacttgccctacctcgttctattttctcgtggtctgtttttagctcccttcttggctttcctctagggtctatggtgttttctgttcctcttgctacatgttccttgcttctcctttctgcttaatgttttttctctttcgctttctgtttcccgttcgccttgtccctcttcttccttttggcttttgcctgcttttttt

SEQ ID NO: 552860 - DNA, 199 bp, Homo sapiens
ttgagctgctgaggtgggcagatcgcctgagatcaggagttccagactagcctgggcaacatggggaaactccgtctctactaaaaatacaaaatattatgctggtgcatggtggcacaaacctgctaatcccagactactctgcgagacgtgaggcacagagaatcagcttgagacccagagaggcggagtgctgcag

SEQ ID NO: 552861 - DNA, 969 bp, Homo sapiens
cccctagagaagctgggaatgaccgacatgttcagcaccgggtcatcgaagacttcacgagtctgctcagaccatgagcctctccacgtcgcgcaggcgctgcagaaagtgaagatcgaggtgaacgagagtgtcgcggtggcctcctcatccacagctgtcatagtctcagcccgcatggcccccgaggagatcatcgatggacagacccttcctctttgtggtccggcacagccccacaggaacagtccttttcatgggccaaggtgatggaatcccgttgaccctggggaaagacagccttcatctgggacaaaacgtggagatgcatcgggcaaagacgaacactccgaataaaagaatttcagtgttcaatgactctttctgaaggcagagaagacatttggcctttgcgttaaacagatggtaacaccaggatctagtctccaagaccttggctctccttggaggacctttaggtcaaactccctagtctccaccgtgagaccctgggagagaagtttgaagcacaattcccttaaggtctccagaacagaaggtgacgcctgctgggagcatctggggcactggttccaccgtctctctgccactcgggtctgcagactggttccaaggtgagggcccttggcaggacgggaactacggggcttacaggagcttctgtgtgcctggtagaacctataactggtcacgtcacatagcaatcatctgactgctggactatgatgggggtgtagaaggcaaaggcagtggagaaaccccgtcatctaagaaccatgtggatggcaccatccagaaaggtgtgaagtcgaaaggatgccgcttatgtgcaacctgccggcaacgctacaaacagggatcgattagcaggaatcgacgagacaccccttacaggaacgcaaacataaacacaccatcggagggaatatcttccataacaaagacagc

SEQ ID NO: 552862 - DNA, 159 bp, Homo sapiens
gcatattccaagggggtaatctagaaatatatatgggaaatagtccagattatgacattcagcatgtagaagaatatgaaaagtcctataacaaataaatcagttttccaaatatatttgatttgatttcctgactttttatatttttttcttttttgc

SEQ ID NO: 552863 - DNA, 105 bp, Homo sapiens
agagagaactgtttgagcccaggagtataggttacagtgagctttaactcactggattgcaccactgcactccagtctgggtgacagagcaagactctgtaactt

SEQ ID NO: 552864 - DNA, 701 bp, Homo sapiens
  misc_feature (148)..(148): n is a, c, g, or t
  misc_feature (480)..(480): n is a, c, g, or t
  misc_feature (579)..(579): n is a, c, g, or t
  misc_feature (583)..(583): n is a, c, g, or t
  misc_feature (608)..(608): n is a, c, g, or t
  misc_feature (635)..(635): n is a, c, g, or t
  misc_feature (691)..(691): n is a, c, g, or t
  misc_feature (701)..(701): n is a, c, g, or t
ggggctcaggcgatcctccgacctcagcctcccgagtagctgggactacccgtgcatgacaccctatctggcccttgttttttgttgttgttgttgttctttcttttttcacgtggtttcgcacttgtcacccaggctggagtgcggnggtgtgttgtcggctcactgcaacctgtctctcgggttggagtgattctcgtgtctcagtcttccgggtggctgggattgcgggcgtgtgccacacgcctggctgatttttgtatttttagtagggacggggcttcgctatgttggtcaggctggtctcgatttctgacctcgggtgatctgccacctcggctcccaaggtgctgatattgcaggcgtgagccaccacgcccggccgcatccggctttaagatttgtttttcacttgccgtgggaggatgtacttatctcagatgctagagccgggagaccctccccccacacccccatctnctgcaggagctctgatcgcagattggagtgctgaactctgcatctatggacggtgcttctgtaaccggccgcaactctggagtggcatagtaaagtggnaaangctttgcctttctggttaaagaccncaagaccttcagtgagacctttcctgnacccccactgatatctttatggaatgtttgtcgtgagtaacacaattaatgccgtnaatagtgtan

SEQ ID NO: 552865 - DNA, 284 bp, Homo sapiens
tgccctcgggcccccctggaaaataatggcctaaagggggtgtgggtgtcctcctaaaatccattccctcctgatggggggggggaatttgtgaagcccccctttaggaaaggttttgggggttggggtggtgttgccaaagaaagggggtttgaaccagaaaggcctagggggaagcgggttaaattgcagccttcccctttgggggatttttggggtgtcccttgccttccttttgcctcctccccccccccccttaaattaacggtttgttggaccctcca

SEQ ID NO: 552866 - DNA, 118 bp, Homo sapiens
tcacccacccacaagccgtgtaattcgtgaagttgctacgcggccgcgcctccttcacaagaggatgggctcttcccagctgaacccccagtgtgttgactcagaccccgtctgaact

SEQ ID NO: 552867 - DNA, 119 bp, Homo sapiens
tttcctgccaagccactcaggtgcttgcagggaccagtgataatggcgatgaaaattgatgattggtagtgaggtaaaaggagccttgggattaataaacatgcactgagaagcagagg

SEQ ID NO: 552868 - DNA, 220 bp, Homo sapiens
ttcagacggatgtgatttttgtactgactggtactgggactcagaaagttgtttactgaaactagaagcaagagtgttagagtgaactccaagtttctcttcaaagaatcagtatgtcagtgtgttcagctctcttattcttctgattctccagttttaaagtttaacttcctggttctctttgcccccttgcctctagtttcagtaaacaacgtttcct

SEQ ID NO: 552869 - DNA, 1250 bp, Homo sapiens
ccaccgtcgccggcggcctagttaccatcacaccccggtgaggagccgcagacgtgccgacagccggccccagagtcaccaatcaccgcaaccagtgagcagcgaggccgagacccagcagccgacaggtaggaaacgcaggatagggacagaagaaaggaagaaaggaaaggaactgggatacacacggaaacacacaacgaggaacagactcgaagggagaacaacgtccacgacgacgacgagagcgagaccgtaaacacccacacagacagcaacagcacacagcacaagacaccagcacacacaaccacacaacaacacaacacacaacagacacagacacacacggaacaacaagacaggagaaaagcagagacaacacgcacaccagcacacacaaaacccaccgccagccacgccgagccgccagagccgaccaccgaccgacgcgcacccccccaccgacacaagacagaggaggcgacaaaccaccccacgagcaaagcccaacgacgccgcgccagaagagggagaaacgcacgaagcggggagcacgcgaccacacagcaagaccgagcagagccagagcagaggaggcgagcgggacgaccccggcggcccaaccacgcacacagaccaccccaacaactcggcgaaggcgggccaacccacgcaccccacaagagtacagagccagcccgaacgggcaacacaccaccccgaagacacgaggcagcacgaggaaccaagggacaccgagcagacaaagccgacccgcccacgcgcagcgcggcccaccacacgcggaccgagcacacagcgcgcaccgcaggcagccgcgcgcccagacaccccacacccaacaaacccccaaaacagcaaagacccacgacacccagagccagacaccccggaccgaacacgccgccccggacgggcccgccccacaacaccacgccgcggaccacacccgacccaaccaaccacaaaaggagggcacacccccgccccccaagcgcgcgccacgcctcaccacgcgcgccgcgaggaccggcggcagacggcggcaggccaacgggccccgcggcccgccccccgccacgcccgcccacggggcagcgcggcgcgccccccgacacagcgaggccacacccgccggggcaacagccccgaggaggggagcgccaccgacaaccacgacccgaccaagccaccccacgcccgcggccaccgccaagacaccgcgg

SEQ ID NO: 552870 - DNA, 849 bp, Homo sapiens
taagggtttccctttgtttttttttcggggggggagaaactccccctcttttttttcccctttttcttttttaaaaaaaagggggttccccccctcggaaccccggacgtaaagagggcgcaacgtggtgtggaagcgggctgacgttgttgtgggcggcccagaggaaaatgtgcccagttgtgcttagagggccatctttgtgtcttccacaacacaataacctgtgtggtgttcaacccctgtgcagcgggggggtagagggtgggcccccagtggggcctcgacggctcctcaactatctgtgaaaacctcgatgggcgctagagatgttcccagaagagatagagccgccgctcgatattttttacacccgaagaagaggtcgccgtggggagaatatattctggggaatatataaaactcttctctaaaagagcctcttttggggacccccgagggatattcccgcacagatgttttcagaatatctctcccgagaagagagcctacttctcgcctaaggcaatctcccgaggagcccaacaacagataaatttcctccctcaactccgcgccctttcatcagacacacgtctcttgatgtgttccacgcgcggtggggtactctcccccacaggggtgcgtgtgtgcctcccaaaaactgtgtggcacaagagacattatccctcccaaacactttttgttctcccagcgtggggcagaaagtcgctctgtgccgccacactctttctacgcacagacgtgtgtttttctcgcgccggtgtgtctttagtgagacagacgacaatcaagtccaacttggctgcccaccgctgcaaacgcgga

SEQ ID NO: 552871 - DNA, 105 bp, Homo sapiens
gtcgacttacctacttttataaaataatgctgtgtggttgtgatgtgtatgtgtatttctattttagggtggggtgttggaaagggaggggtgttttgttctaaa

SEQ ID NO: 552872 - DNA, 285 bp, Homo sapiens
gggcagcaggagagaccaagaatgatgggcacataccgtggagatcccaactggtttatgaagaaagcgcaggcgcataagagggaatacacagagagccagctgcaggagagagaaagcatgtcatatggacctatcagatgggacagcaacagaggggcctcccagtgccggcatgacaggctacggacgacctcggcagatcatcagttagagcggagagggctagccctgagcccggccctcccccagctccttggctgcagccatcccgcttagcctgcc

SEQ ID NO: 552873 - DNA, 265 bp, Homo sapiens
ctgtgaccggtcgttcttttacagcgttctgactctggacacccctgcgcggagggcagggcgtagtgctgaatacctcgacactgaaaggactctcctcaatctacccagcttctgctaccggcagaggatcctagagggtctgtccgaataacgccgcttacctttgacgttctgcttgaagctgtctctcttttgactccttagacgcctgggcgagcttttcccgggcagcagctgcgaggcgatcttccagcttttgctt

SEQ ID NO: 552874 - DNA, 140 bp, Homo sapiens
gggtcggtaccgtcgcgtgttcaagctgcccaggtttcctttttctctacagctaaaccatcactggcctacagataagcaatattaaaacaactgtagctcaccagcagacacgcgaccagcttgagaccagcttgaga

SEQ ID NO: 552875 - DNA, 387 bp, Homo sapiens
  misc_feature (350)..(350): n is a, c, g, or t
ctcggtacctttatagccaatcccaggaggctgaggtgggaggatcacttgagcccaggaggtagaggctgcagtgagccatgaatgtgccactgcactccagcctaggaaacaaagcaagactctgtctctaaaaaaaaaaaaaaaaaaaaacaatggaaggcaaacagcaattccctgaggacacttcacacagtgtcctgtagctaagtgtctaggaaaaaacaaaaactccaaaccctttcaatggattgaggacaaggttcgcagaaagggcatttcgtgttgacagtgtgaaccagccgaaagcgtggccagaacccttccttgttatgccttcgtgcccttgntccgggtgggtttgaggggggttctgacccaggaggc

SEQ ID NO: 552876 - DNA, 126 bp, Homo sapiens
acgactggtgaccatgacattggtggtcctgatcaagaattagggtgtaggacgtgggccctgtttggctttttatagagaccaaactctatctgaaatcccaacaaaaaaatttaactccatatg

SEQ ID NO: 552877 - DNA, 213 bp, Homo sapiens
cctcgattcggtacctctggtggactcctccactacatattatacgccatccccaaatccacgtcactgccatatccatcagatcctcctcgtaaagttacttcctggtcctggtccgctatgaccaccccaccccagccccctcgcacgcttccagcgttgcgtaatattttcatgttaaagaatgaacacctctgagcgcgaggcgagggt

SEQ ID NO: 552878 - DNA, 152 bp, Homo sapiens
attttaaacactgagtctgcaattcagttttctctttcatgaagttgtgataaccagtgaaatgaattattatgcttaaagctactgtcatctagattatgatagtcactgttgtctagggtccaatctcattattaaatatcccttctgtt

SEQ ID NO: 552879 - DNA, 326 bp, Homo sapiens
  misc_feature (223)..(223): n is a, c, g, or t
  misc_feature (253)..(253): n is a, c, g, or t
  misc_feature (289)..(289): n is a, c, g, or t
aaagacagagtttcactctgtcacccaggctggagtgcagtggcacaatcttggctcactgcaacctctgcctctggagttcaagtgattcttatgcctcagcctcccacatagctgggattacaggtgcatgccaccatgcccggctaatttttgtatttttagtagagatggggttttgtcatgttgcccaagctagtctcaaactcctgagctcaagtantccgccactttagcctcccaaagtgctganattataggcgtgaggcaccacacccagtccaaagangaaatcttaacagaaattttaaaatatattgaactaa

SEQ ID NO: 552880 - DNA, 1210 bp, Homo sapiens
  misc_feature (766)..(766): n is a, c, g, or t
gaactcattggagtacaccgatagcgaattttgactacaagagtctgaaaggtactttattactgcacggtggtctgtgaagaccatcacagtgtccagatacgagggtagcggagctggacttgctgttaacagacagtctggtgaaggataagtgtccttactattatcacgtatcactggagacagtactagtgggtcctgctcttcttggtcatactcacacatcgaacgccatgagcagtgacattggatgaggtggctgtacacgggataagaacttcgtggttctcaactgtctagttgaatgacggaactggaatttaggacctagttgaccgtcgttcaggaggttgaggcagaacgaaagggacggttccctctgaggcacatcgcagtgaagtagcgcatgcgcaagggagtcactacagtatctggcttccaatcctcaaaaccagatcgctaatcgtaacagagggacccgaagcactgatggacttgacggactggacttggtatacgcctcatgcatcagacgaggccacggggagtgtagctcatcatttggctctcctgggtcactcgtggcgtgttgaaagcatgaccaatctgttgccccacagtagttcgctctcactctgtcccatatcctaaaggatagcgatcatttcgatggaaaccccaggtatagagggtcagtgtgacctggggatgcgcagagcaagtggcattcggactatcctgcgtggaagtatactgataggtnacgagaactccagacgcgcccataggtctaggcttcgaagagcaagctagtgtattccaagcggctcattgcgccaattcgcgtaattaggaaagtttcggtgagaaagggaacccaccgggtgatacgttgggtctccgaagagtaccaggctagcactggggactggccaggagcgtcaaactttgtgttgaagccttggctgtcccctagtagggcctgccacttcaaggtgtaaagctcgtacgtagggttatccccccttgcctacaagttgttcgtgaaccggaggcgacctcaatgatgcgtgaaaaccctagaggtggggtacaaattagtagttgcctgggctttaacgtcacagtctgagggtagaaagcatgcgataatcaagcgtgtccaaacctttgccggctgaacaaggaagaagccaacaatttactg

SEQ ID NO: 552881 - DNA, 978 bp, Homo sapiens
cccagacataggatgggtcagtagggcatggctctatatacctatatctcaaaacatgccagtggcaacctgtgctcgactctgaagacaatggacccacgatataggtgtgacactgttcacataactagtgcagcacaatgccgaggagtgatcagtcgcgacatattcacatttgacaccacgtatcttatggtgtagctacacaaatatcctacagcggcatttcactttctgcagcgcatagtactacctagacgcttctcatacactagctccaacggtacacgtagtcatactatatgtagtattcagctaccataccaaaacggttgtataccccatagcgtatatacaattgcacaccctacaccctccatttctatacagctatgttcctactccagacagatactagcgcctactcgtattctcacgccctaagcatacccactccttcgtgacaccaaccttcgcacgcggaatcacctttagggccttgcacgcgctctagtacattcatcccacgcaaatccaacactaacctaggctacctcttacaccaacctccggcttacaccccccgcctccacagccttcccctttttggcgctctcacgcacgcataagccaccagccagatcccctctaccagcccccctacccccaaactctggcgtctagttccacgcccaacctgtcaacgggcacacggaacgccaacaaggccttaagcacttggtgaccaccacacccagcccccactctcgttcgcaaggagcccttctcacgcccacccctagatgtcccctttattacaaatccccccaatccccttggctcacccacgcacacccagggacggctcccaatgcgagccactgcatttgggttcacgccgcaatcaccaggccattggcttcaccccacatcgggaacctcctttgcacgaggcctgccaccaacctccttgcaccc

SEQ ID NO: 552882 - DNA, 416 bp, Homo sapiens
agtttttaatgtatttatcaaaatatgttctgtgaaattttttctttttatttaattgttatgtctttattggtacatatttgcatatatttatggagtatacatgttattttcttataagcctagagtgtataatgatcatgtcggggtatttaggactcatcactttaagtattgtcatttctatgtgttgggaacatttcaagtcctctcttccagctattttgatataatacattgttgttaatgatagtcatcctactctgctattgaacatagaacttttcccttctatctaactataggtttgtactcattaaccaacctttcctcatctcccaccctcctccccacactcatcgcccttaccacgctactcctacctatctccccttttatactaataatcttataaa

SEQ ID NO: 552883 - DNA, 497 bp, Homo sapiens
tgctctatttcagttgaaaggctttattagcctatcctcaaggtcacttattctttcctctatcgtatcaagtctgttgataaacccacagaaaattttttcatatatgatattgtgtttttcatttctagcatttttttctgactcttacagattccatcactctactaaaattccacatcacgatttatgtatattgtccaccttttccattaaaccttttaatacagtaatcatagttatttcaaggtccctgtctgaagtttgcatgtcagattttgttgactattttacatcttgaacagtcacctttttttttatcttacgtgagtgtgtctatgtcataatttttttaattgaacccaaactttatgtataaaagaaactcaggtaaataatatttctacctggaaatgggtaactacttctttcaagctgttagcatggggggactgaataaatctactcagtagttgaattgtgtctgtattttactg

SEQ ID NO: 552884 - DNA, 131 bp, Homo sapiens
  misc_feature (8)..(9): n is a, c, g, or t
cattggcnntacagcggcgcagacggctgccactgcgcctgttgatcctgcagctgccggtgcagcgctgcccacagatccggctgttgccaaatttctgcggcggtgtgccaggcgttgcgctgcttcag

SEQ ID NO: 552885 - DNA, 495 bp, Homo sapiens
  misc_feature (105)..(105): n is a, c, g, or t
  misc_feature (467)..(467): n is a, c, g, or t
  misc_feature (481)..(481): n is a, c, g, or t
ccgtcattaacccaccatctatggaaatagtaacacaaccgggaatccagcggagtcctcacagccaattacatgacaagatattgtcacatcatcgtggccctntcgccacaggaggcgctagggcaacaggtatttgtgcatatcccattcatttattcattcagccactaaaggcacagaccatgcacaggcagtcactctgccagaggaaatggctgtgagaatgaattaaaaacagcctttgggaggcagagacgggcagatcacgaagtcaagagatcgagaccatcctggctaacatggtgaaaccccgtctctactaaaaatacaaaaaaattagccgggcatggtggcgggcgcctgtagtcccagctactcgggaggctgcggcaggagaatggcatgagtgaacccgggaggtggacttgcagcaagctgagattgcgccactgcaatccagcctnggtgacagaagcgnctccgtctcaaaaa

SEQ ID NO: 552886 - DNA, 108 bp, Homo sapiens
tctgcgggttaaaggagggcaatttctacatcaaataatacgaaggtcatacgctactaagaagaattttatggacgacaagggacgcgcggcggcggtgatataggg

SEQ ID NO: 552887 - DNA, 556 bp, Homo sapiens
  misc_feature (349)..(349): n is a, c, g, or t
  misc_feature (376)..(376): n is a, c, g, or t
  misc_feature (446)..(446): n is a, c, g, or t
  misc_feature (453)..(453): n is a, c, g, or t
  misc_feature (476)..(476): n is a, c, g, or t
  misc_feature (481)..(481): n is a, c, g, or t
  misc_feature (525)..(525): n is a, c, g, or t
  misc_feature (536)..(536): n is a, c, g, or t
ccccaatatatccggcctatcccaaatgatctgtcttgaagtttcctgattctttcctctgcctgagtctgctgttaaatccctctagtgattccgaccccttctccccccattcagttactacatttttcagctccacagtgtgtttggtttttagaaataattttctctttgtttatattctcacttgtttatatattgtttatctaattttgcttagttgtccacactctcctttagctcattgagcattttttagatagttgttcttaaggttttatagagtaagtcagcagcctctgtttctttaggttggtttgtggagatttctttctttcaatcgtcccgngtttccctatttctttatgtgccttgngatcttttgtgaaattcaagcatttgcaaaaccaagctacctgcccttgcagactggctccatgcatggnaagggcntcactggataacgcaccataaangcttnggggccctctcaaactttttcttggggagccatcttccctgggnccggggcatangcataagtttaagttcctcc

SEQ ID NO: 552888 - DNA, 106 bp, Homo sapiens
ccacagctcgaagagggggcggaggctagtgcagcctcagaagaagaggcaggtccccaggctatcagagctctatccactccctcgcgtggccggagagtggctc

SEQ ID NO: 552889 - DNA, 885 bp, Homo sapiens
gagacgccgtacgtgccagatggtgttacctggagcttaaaaagctgcagcaaagttgtaaacctttctgtaggaggaataactgttggcgtcaaaaagacaatgtgtttcaacaaattggccaagaatcaaacattaaggaagggccgaagtccagggacctgtattgtacacattaggccagcccaaaaacccacattttaaagggctaaagacacacaacagccaaaaacccaagttaccccaaataactcgtataagcgcacagaataacacacatttaatgcaacattggaaggcgcaacacaaaggttacaccccaggacgtataccacataaaaagcgcgtttagtggggtaacactgtggtcaacaacacacacggcgcaaccttttggccaccaagtatagtcgccaacataagaaggccatcttacccacaccttgttgaaactcccttccttgcacatgcacagtcgtacaccctggaatttcccctatcagcgacaggctgttcatcattggacataagtggacaacacaccaccaaggttgtaacatgcgggtcgggcactgggacccacggcctttacacacaagcaaattctcactgtggtgcctccctggggtttgtgttcaaagcgttatttaaccatgtgggatgtgaagttggcccaatttcgtcaaaaatttccgttaccaagacaagaaggacagcctacactgtcaaccagtttggaccagcggttcattcatcattctcccaaacaatacccagaacgcgagacgcgatgaatcaaaaccatacacataaaataaactatactgatctctggcactactcatcgtccactacgcacccatccgctagtccactcgccactca

SEQ ID NO: 552890 - DNA, 302 bp, Homo sapiens
cggtcctggagctggtttctcaggtagtatgaaagaacataagaaaaaatgccctcacctaactagcaagtaatattaagaataagcttgaccgggcacggtggctcacgcctgtaatcctagcactttgggaggccaaggtgggtggatcacctgaggtcaagagtttgagatcagcctgatgaccatggagaaaccctgtctttactaaaaatatagaaattagtcaggcatggtggcagacacctgtaatcccagctactcaggaggctgaggcaggagaatcatgtgaacccgggaga

SEQ ID NO: 552891 - DNA, 454 bp, Homo sapiens
  misc_feature (249)..(249): n is a, c, g, or t
gagacgccgtacgtgccagatggtgttacctggagcttaaaaagctgcagcaagtgttaaacttctgacaatggccaagaacaaattaagagggccgaagtccaggaatgtatttcacatagccagccaaaaaaactttaagggctaaaaacaaaggcaaaaccaggttaccacttaattcttaagaaggataaaacattatgaatgaggaaaaaggttaaacagagtaaataaaggctttgtgtaaantgtacaaaagggaacttgtgcacaatttcggcaaaaagcattttcacctgtgaaccttctgcagaaagaactgattcctcagcagcgtcatgaaagcaaaccagttaatgttgatggaagctacaagattaagtggctctgtgtgtaatatactggtgatgcatctaattctccacaaagaccaataaatttgaatgttttattc

SEQ ID NO: 552892 - DNA, 924 bp, Homo sapiens
gcgtcttgcattactattgtgcggctgcaggaggtgtcgagcggcgttatttttttttgcggtttgcctttttttttctttattttttatttgggaaccgcggttgttaaaaaccctgagggaacctggaggggggcctccgcactctcttaccattcttttccatccgagttttgtgactccgagtatggacaaagtgtgtgctgtattgggaggctcccgagtgcatttgtgcagatgctgtggcccagtcaatggcccggaaaggcataccgacgtggcggctcattgccagaaacctggaaggggccaaagccgtcgccggttgacctcggcggagatcattgggcattaagctgtgatgtggctaaggaacatgatgttcagaatacatttgaagagatggaagaaacatttaggtcgagtaaatttctgggcaaatgcagctggtattaccaggggatggtcttttacgtaagaacaaaacttgaagatatggtatctacagtttcatactagcctctggggtcccatgctagacctgtaaacgctgccatgcaggactagtgatctcgaacaacgaggggagggctcatatggtaacatgtaggaagcatgtgttggctctaaagggcaattctggccagttccggttataccaggtgccctgtaaaggaggattagtgggatttaccaggggtgctcttgctaaagcaggttagcgagaaccgaacattagagttgacgtgtatttgccccagggattttgtgacccccgagattttgacgcaacgacgtgtacaagacgaactttttgcgcgaaaaaattttcctcttgggaacgttcggggaaaacttattgcaggtggccatgtcggtgtgtggctctcgctttagaaattccgcgtttattcacagggctgt

SEQ ID NO: 552893 - DNA, 196 bp, Homo sapiens
cacacgccgatggtatcttacccactgagcaaggccaggatcgaacccgcaacctcatggatcctagtggtttcgttaaccactgagccaggacagaaactcctgattacttttaaaaatagttttactgagatataattcacatataacacaattcaccttttcaaattaacccatcggcgggggtaccgagctc

SEQ ID NO: 552894 - DNA, 897 bp, Homo sapiens
  misc_feature (51)..(51): n is a, c, g, or t
  misc_feature (72)..(73): n is a, c, g, or t
  misc_feature (76)..(77): n is a, c, g, or t
  misc_feature (82)..(82): n is a, c, g, or t
  misc_feature (86)..(86): n is a, c, g, or t
  misc_feature (97)..(97): n is a, c, g, or t
  misc_feature (99)..(100): n is a, c, g, or t
  misc_feature (105)..(105): n is a, c, g, or t
  misc_feature (109)..(109): n is a, c, g, or t
  misc_feature (112)..(112): n is a, c, g, or t
  misc_feature (130)..(130): n is a, c, g, or t
  misc_feature (132)..(132): n is a, c, g, or t
  misc_feature (142)..(144): n is a, c, g, or t
  misc_feature (153)..(153): n is a, c, g, or t
  misc_feature (159)..(159): n is a, c, g, or t
  misc_feature (170)..(170): n is a, c, g, or t
  misc_feature (178)..(178): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (227)..(227): n is a, c, g, or t
  misc_feature (252)..(252): n is a, c, g, or t
  misc_feature (271)..(271): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (311)..(311): n is a, c, g, or t
  misc_feature (848)..(848): n is a, c, g, or t
gacatttctaacaaacgccaggtagacggatgttaaaaatgaattccaccngcgacgaaaggtaaacaatanncannacccntcangaaacctcccntnngcaanggantgntctccccttctcctcatnanttggcgccannntttcaccangcaacntggttcctcangcctctangccntntantcgccttttccacttgtacatccccccaccccctccacanttcttctgtgaattcatgaccaggnacttctctggctgattgtntccgtgtgtctgangnaggngcacgccggaacctgggaanctactgggcacctctaatgcagatgagaaaaacttgagaatgtgaaagtagatcagtccccgctcccacccgaagctgcagagacgcgggacattaaccagtcagcacgcgggtggtgaagtaactcaggccactctcctccccactgcccagggcgggtgcacgcccctaggacctcctcccaggccccacacccacgcaaggcgacaggaagctccccacgcctgccccatgacgcaacgatgaccgcttatacaagtatgtcagcggagggggaaggggagtgcctggaattctccgaggttggaaacgcaaaaccaatctcttgaaaaaccttgaaagggccagcacagcccacagtacaaaatgaagtccgaccctgaggagatctttaaaaacaaacaaacaaacaaaacaaaaaacacaacacccaagcctcccttctcccagtccagaaggagagcgaaaggttcacgtcccagtccactaagacagcacctgtgggcgcaggtctctgcggaaggcgcccgcgccccnggctcagactcctcggtgccgtccctgcacactgaaggcgatggctccc

SEQ ID NO: 552895 - DNA, 278 bp, Homo sapiens
ggtaagaagaattattaatacttagtgatgtgacagtttttcttaaataactttaaacattatttctccaacagttttcaggtagcagtgtctaaagaacataatttttaagatgaatatacaaagtcaccttggtcaccaaaatgctactttgccaacatggcctaacgtctgtcttagttcgttttcccttcatctttgcttgcaaaccaaggcctaaccataaaacaaggtaggaaaacacctagaaggtgaggcagggttattgtctcatgagc

SEQ ID NO: 552896 - DNA, 290 bp, Homo sapiens
aggctaccacgttgccagtgcactcagccagcctgcgcacatcgagagacccatttctatctaggtagacaggaatattatactctccaatacgccccctgaaacaacatgtgtgttacgtaaagctaatttgattaagacttaaggcgaacacccatatgagaaagttgtaattcgtctttcagacggggagagtcggcaggatcttgttagggttctagggccttcacttggctatttccaggacgttctcactcatactgtccgagtgagattaggcaatcaagctt

SEQ ID NO: 552897 - DNA, 166 bp, Homo sapiens
gagatcccatcgtgtctcagtggttaacaaatccgactaggaaccatgaggttgcaggtttgatccctggctttgttcagtgggttaaggatctggcattggcgtgagctgtggtgtaggtcgcagatgcggttcagatcctgcgttgctgtggctctggcgtagg

SEQ ID NO: 552898 - DNA, 228 bp, Homo sapiens
tcttagaggatcccggtgtatccctttgtctactaaaaatacaaaaagtagccgggtgtggtggtgggcgcctgtagtcccagctactcaggaggctgaggcaggagaattgtttgaacctgggaggcggaggttgcagtggaccgagattgtgccagtgcactccagcctggccaacagaacaagactccgtcttaaaaaaaagaaaaggagagacaaagggaaaca

SEQ ID NO: 552899 - DNA, 816 bp, Homo sapiens
cggcgcggtgcttccagcgaggtctctcctgccactccagccccgcgcccctcgccgcggcctcgggcgtctgcgcctgcagctgcctgccccctgcctctttggagtctctcgcggcctcaaagcgcggcctgcgtcgcttccggcatgttccctgacctgcgtggctgatgtgcttgcctgctgtgtgggctgccctgtgctagctgctgctgccgtcttactgctgtcctctggcggccctgtgcctggcccggtggcatgcaccactgctgtggtccctgcgcttgggatccatgcggcctgctgagtgaacctgggtggcctgggctggtgagcgctggatggcgatgccgcgtctgctgagcgttgtcggcgccgggccctggagacagctcagacagataacaatacacagtcccactttagtaaacctgtgatgcgtgaaacatttaacaaccaaaaggaaaacgttggtgaattctcctgctagactgtagtgcgttgacccactacatctagactattgactggcttttggtgcactgtgacgggaacccctggctagtaacaacctagtcacctccatcttttgacagatcaccatatatgcagaagttacgatgcaaatcactgatgaggagcaatgacaatgctcgatctggcatatggactaacagacagatcacggttgggcttgccaaatctgatagacaaaaatctatggacaatatgactgtaacgagtgcctgaaaacagtggcttgattgccagaccaatccattgatgtgggccaagagctcctgaactagaacg

SEQ ID NO: 552900 - DNA, 310 bp, Homo sapiens
gtaatctcgagagttgtgcagtgtcttaacaattccactcatttgggccaatgcttccttaaaaccctgataggctgggtgcggtggctcacgcctgtactcccagcactttgggaggccaaggcgggcggatcacctgaggtcaggagttcaagaccagcctggtcaacagggtgaaatcccagctctactgaaaataaaaattaccgcggcatgatggtgggtgcctataatcccagctacttgggaggctgaggtgggagaatcacttgaacccgggaggcagaggttgtagtgagcagagatcgca

SEQ ID NO: 552901 - DNA, 273 bp, Homo sapiens
  misc_feature (240)..(240): n is a, c, g, or t
aatcaccattcagagtgtggtgaggatcaataagataaactcatgtccttggcacataatcagatggtaactgctcagattagtttgaaattggagatctggtaacctaaggatgctttctaacctcgtccactcccatttcacaattcccaatggtcctcagtgactcaaatgtatttgttcccacaaatccatcaccttcttcctttagggtgcctccctaccaaaaaagacctggtnaaaagacatcagccatagccccttgaatgtagc

SEQ ID NO: 552902 - DNA, 119 bp, Homo sapiens
ctgagtgtgaccctgaccatgaagccagatttctcacagctccagcggaaacatatatggctacgaaacaccgggtgaccagcttcatatcaactgggacaacaacatggacaggctgg

SEQ ID NO: 552903 - DNA, 448 bp, Homo sapiens
tcccccccccccgaaaaaattttttgaagccccaaaccccaggaccccaaaatgggcccctctttggaaaaaggggtttccccaaaataattagttaggtgcgggcccccctggagtaagggggcccccaaaccaaaatggccggttttaaagaaaggcaaaaaatggggggtgggggctcccccctccattcccccccttttggaaggccaaggggggtgggtcccctagggccaggagttttaacccaacctggccaccatggttaaacccggtttttccttaaaaaccaaaaaaccacctggggaagggggggggcccccgtttttccagcatcccagttgactttgacaaaaaaatccctttaaccccggaggcaagggtttccgttaattgaaatttggccccggcccccccccctggggtacaaaaaaaaaaaccggtttct

SEQ ID NO: 552904 - DNA, 289 bp, Homo sapiens
  misc_feature (53)..(53): n is a, c, g, or t
ccacatggccccatcccagttggggaagccaggtgagttttgacccttgggcntgggcttttgcccctcccaacccagccgttgtttccctcgacagcgcccctgctgttttccccactgcatgtcaccaccacccgaaaatgccacggtggtcacgtgtgcactcgccctgttacatgtgcctttgcggggcaagggccttccctggtttttgtacactgcgtgtacccaagatgcctcacaccatccctgccacatacaggtgctcaataaacacttgtagagcaga

SEQ ID NO: 552905 - DNA, 900 bp, Homo sapiens
  misc_feature (41)..(41): n is a, c, g, or t
  misc_feature (47)..(47): n is a, c, g, or t
  misc_feature (106)..(106): n is a, c, g, or t
  misc_feature (124)..(124): n is a, c, g, or t
  misc_feature (199)..(199): n is a, c, g, or t
  misc_feature (214)..(214): n is a, c, g, or t
gctctcgccaggtgtcctcgtgaagtgacatcgtctttaanccctgngtggaatccctgagcaccgccgtgatgcccaggaagacagggcgacctgaatccaatanttccttaagatcatccanctattgatgattatccgaaatgtttcatgtgtgggagcagacaatgtgcggctcaagcagatgcagcagatccgnatgtcccttcgcggnaaggctgtggtgctgatgggcaagaacaccatgatgcgcaggccaatccgagggccacccttgaaaaaaacccagctctggagaaactgtgcctcatatccggggaaatgtggctttgtgtcaccaaggaggacctcactgagatcaggacatgttgcctggcaataatggtgccagtgctgcccgtggcttgtgcatttgccccaatggtgaagtcacttgtgccagccagaacatgtctcggccgaaaagaccttcctttccaggcttaggtatcaccactaaaatctccaggacaccattgaaacctgagtgatgtgcaagttgatcaaagatgagaaaaatgtgggagcagcgaagcaacgttgttgaacatgttaaatttccccttctcctttgggctgcatccagcaggtgtcgacatggcagcatttacacctgagtgctgattcacgaggaaccctgattctggtcctggaggggccgcatgttgcaggcttgctgcagttgctccactgtgctgtcccatcttactagggaaacggctggcgttgggcggggacccccgtgaagagcgctgggcccgctggggccggtggcacccgtgttttcccaggggcggcggcgggtgtgtctcccctctcgtcacctcctgtccctcgtatattttctcactctgggggttc

SEQ ID NO: 552906 - DNA, 911 bp, Homo sapiens
gggttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtttggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgcaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagc

SEQ ID NO: 552907 - DNA, 530 bp, Homo sapiens
tttaatatgtctgttagtagtatggaatatattccagagggagagattttggttagaacttatggacgatatattgcgaatcacgagtgcagtaagtttggacacgattaaatcctatgaagctcctgcaaacatcaattcttgatatctagatgctgtgaaggaatttcttgttgcaggagttgaagaacttaaactttataagtatgagtataatagtggacgaagaattagaatcctacaagggacactttggtcctaatcgctgagtgagatttagtcctgattgagaacgctatgccagtggttcagaagatggaacattaagactatggcaaactgtggtaggaaaaacgtatggactttggaaatgtgtgcttcctgaagaagatagtggtgagctggcaaagcaagagattggttttccagagacaacagaagaggagctagaagaaattgcttcagagaattcagattgcatctttccttcagctcctgatgttaaggcctgagcgtcaatcatatgttgc

SEQ ID NO: 552908 - DNA, 638 bp, Homo sapiens
  misc_feature (16)..(16): n is a, c, g, or t
aatgccaatccatggnttcccaaatcgcccgcacatccaaactggccggaactaccgccaaaaataagtcaagtacaacttagagtcacgtctatctaccggaagcttctcggaaatgtttaccgtatcccctaggggatttaacggactaactctataaggacaaggtagactcggaggaggaacctctctcttctagtaacccccgcctactccaaagcaacccccttgcccctactacttcgaaatttttccccaacaaattaaagaaaacgaagaataaaataagggtgaaataaactcctttcctcgaatgagataaaaaaccggggcctctacgatccccaacgatagactgtaagctttcttccccctcgcggaactaaaaacctcctactctcatccctaaccctccctacgcgaaacgggaccgatctaaactctaacgcgcgagattcgtatttacaccctctccctacccctcgccccgagaaatagaagaaggtagaaaacgttaataattgaaccaattaactatcttaggcgactaagaaaggcggtacgaaaataaaggacaaccgaacgagggagactccgaactcttttcaaccgcccgagcctcccgtgctcgctcctag

SEQ ID NO: 552909 - DNA, 149 bp, Homo sapiens
tttttttgtttttggggtttttttggggggggggctttttcatgttacaaccaaatttggatttattttttatttgtttccctttcaaggtggatcatggggaaagtggacagaatttttttgttaataattgggttaggtgtttgcta

SEQ ID NO: 552910 - DNA, 641 bp, Homo sapiens
tggtaaaaatggggtctctcactgggttgcccaggttgctctgaaactccgggcctcaagtgctggaattccaggggtgaaccaccacgcccggttgagatgtccctttacctgtggaacttgatcaacacaaaatcctgaggcctggtgtgggtgtgtccctcgggggcagattctcaacgggggacacttctgcccccagggacacttttcaacatcctgagacaattctccgggtgtcatcacatgtgtgcacgcactgtagttttgtaacctagaacacgctatgtgggcacctcggggataagacgcccaggggacgctggctacaattcctggcacgggaagattggaccctgcccagggtcctaggggcaggcctccaggcagggtaggagggcaagcgtgcatgcggggctgacttgtgggcctgctacggggaacaccccttgacagcaccagggtgcagcagggaatggtggctcgtggggggatggcgagatttctgtggccattggaggccagggtgaacccaactgtgggtggtgtgcccatgtccctgaaagagatggtctccaagctgaagaagccccgggggaatcatcctcctggataagggctggcaagctgtggatgttcag

SEQ ID NO: 552911 - DNA, 142 bp, Homo sapiens
tccggccggttgaggcagatcccatgtctacaaatttcaataaaaaagccgggcgtggtcccagctactcgtgaggctgaggtagaaggatggcttaagcccaggaggttgaggctgcaatgagccgtgtttgtaccactgc

SEQ ID NO: 552912 - DNA, 225 bp, Homo sapiens
ttcctgtggatgggcccctaaacccaaatctgactggtgtccttttaagaagaggaagagacacccagagatgtgcacacttcagagacaagacacatgaggacacagagacaaggcggctacctgcaagccagggagaggggcctcggggaagccaaccctgcctacgccttgatcttggacttccagcctccagaactgtaagacaataaatgcctgttgttt

SEQ ID NO: 552913 - DNA, 272 bp, Homo sapiens
agagatgtgcgcacgcaagttggaactctcttagcgaaagaaggagcgtccctgcttggttctctgggcttcaatacattgattggtcgggaaaaaccaaggacctgcgctacgtctccccataccttggaaatgcgctgctactcgatgaccatggtccgtacgtccatcccggacaagaacatctctgggttgagattccactcttcgggtctccttatccgccagacgatgacggactagaggtagcctcgcgccttattcgcgcacga

SEQ ID NO: 552914 - DNA, 383 bp, Homo sapiens
  misc_feature (59)..(59): n is a, c, g, or t
ttgtaaaaatggtccatcattctctaagccaaaaatgcgggaaataacaattattttcnagaaatttcatatatattgaatattacaaaatcatgtaactcgaaatgtttaaatggtcacactgggccaggccaccgcgtgtcacgcctgtgatcccagcactttgggagaccaaggctggtggattacaagatcaggagtttgagaccatcctggccaatatgatgaaaccctatctctactaaaaatagaaaaattagctaggtgtggtggcgcatgcctgtagtcccagctgcttaggaggctgaggcaggagaatcgctggaacccgtgaagcggaggttgcagcgagccgagattgcaccactgcgctccagcctggg

SEQ ID NO: 552915 - DNA, 147 bp, Homo sapiens
ctctagaggatcctttgctggtcgcggtgcggtccaggttgtgtccaggttgtgctggctcaccatgacctgcttacaccttgctctgctgcagtttatactcaccaagaccctggacccagacacatactgagaccagcacaagcg

SEQ ID NO: 552916 - DNA, 267 bp, Homo sapiens
ggtgcagtttgtcttcctcccctagattactggtctggccctgtgactgctttaatgaatagaaggtgcagaagtcatactgggccagttccaggtataagctttagagaagacctgggagataatgcatatgcacattggagagccctgagccaacatctaagaagtcagctacagttctggatagaccatgtggagcagccacatggagagagagaggcctggacatcccagcatcatggctgatcccagcatcatggctgagcc

SEQ ID NO: 552917 - DNA, 159 bp, Homo sapiens
gtaacaaacattccatcgcaccatactctccgtccagatgaatagaaacttataaatccacgccctccccaattatatgttttttatatattttatttatcagggttagataggaaagatacccaagtctgataggggatatataggggggaacaggac

SEQ ID NO: 552918 - DNA, 231 bp, Homo sapiens
cgaggaagcgccacaggaacatgtctgtacatctgaccccctgtttcaggaatcgtccagatcggtgtacatcgtcacagtggggcgagtgccggtctctgagcaagacagtgcgcttcagggtgctcaaggtcaccatggttgccggtaccaggagggagttccagaagttctgaggctggacatcggcccgctccccacaatggaaataaagttattttctcattccca

SEQ ID NO: 552919 - DNA, 777 bp, Homo sapiens
ccacgcgtccgcaagatcatcgaggacctgagggctcagaatcttcgcaaatactgtggtacaactgcccgtcatcgttctgcagattgacaatgcccgttcttgctgcatgatggactttagcagtcaagtatgatgacgatgagcgtggcaccatgctgaaccaagtcttgtggagaacgacatctcatgtggcgtccgcaaatggttcatttgatgacaccaactatcactacagacgtgcgagcttggagacagaggactcagatggctctcaaggagggagcgtgcctcttcattgaagaagaaccagcgaatgaggaacgtataaagggcctagcaaatgctccacgatttgctccagctctgaggtttgagccgctggatgcgtgacgaatgccccgcaaagtctcaggacctcgccagatgatcatggcataacatccggtgtcaccaagtgatgactgagctggactcgtgaagaacccgagaggagctagacaagtactggttctcagctagattgaggacgagcaccatagtggtcaccataaagttctggttgaggttggagcttgctgatgacgacgctctacagatactgagaatgatacagtcgcagtctctttggatgattcagacccgtgcgatatctcatgaaggaagattcttgaatggctcagtattggcatgaaaccaggtcctgagagtggaggttggaatggaccgtatatactattaacgaatggagcatctcaaagggatcctgctgcaccg

SEQ ID NO: 552920 - DNA, 283 bp, Homo sapiens
cccctccccaagacacttttccctagggcatcctatgtgccctcctattccacatataaacaaaataggagttttccctgtgccttccccttaaatggcatatgtatctttcactcttttttttcaccctagtggatctttaataccttaaaagctcaaccctgggcttggtgcggtggctcatacgtgtaatccccagcctttgggaggccaaggtgggaggatcacttgagctcaggagttccagaccattccaaagcaaaaacaaaaggattttgagatc

SEQ ID NO: 552921 - DNA, 1582 bp, Homo sapiens
  misc_feature (391)..(391): n is a, c, g, or t
  misc_feature (1582)..(1582): n is a, c, g, or t
ggctccgcggctgctattatccttgctcataccgcgctatggactccctcaccaggtactcagctgactgcactactgcacgtgtgccgaagcagagctaatcaagagatctctggaggcttagacgcacctcaagctttggtagacctggagggtgcatcagcaacttacgtcttctgtgatatgctacaaggactaccacatcctcatacctgggaacgacacattgatgattggctcgtgcctcctgagatcgcacaagtgtcgaagacagcagctgatattgtattggcgatacattgagctagcttagcccgtgagtaaatctatatgaactttgatagccgggcatatatgttgttaactcaaatgatagtgcgtcaaacaagcntcgattaacattggatataccccacttgaagtcgaacaaaggcattaaatatgacgtcataccacggcgcatatgcaacgtttagaaagggggagatcgcgcctaattgcaagatgcaaaaatagtttagtggaactaagagacgaacctacttcgtggcccattaaacagtatacgtataacacgaaggaggcctaaattaaaatacctggcatgcaaatatggcgattcaactttccgtggtgctagaggtacggtaggcaactaaacagtattgcagggccaccgctcagtttgtcgcgtttcaatacagaagccccaaattatggcggtacaagagtacgccgaaagcattcgcagcgctttgcgaatacggcgtgtaccagaggccggggaagagaacataaaaacctctagttgggcctttcccatattaccctcacggagctcgctaacggtagtggacattattggatccaggtgagcgcataaacaaatgttgaaggctacacactaatccgtaggaacgctttagaagtcgaaccgcacagcggtcctaacacgaagttaaaaccgcataaaatcgggtcgcataccgtggccaaccaagaatgcgggccaagttccattccactaccccgtcactttcgtatcaagggggggaacgccttttattccggaagacgactatgcattaaagcggtaaccaccccgaatctttccacattgtgacgagcctctgtggttgtatgcgcgacatgggaacccttttctgggaacgggcgacaaggccccaccgtacgacgataatacaaaaggccggtacagggcaccctttgtaaaaccggcggccgcccacacagaggatattacctttttaagagccagcctttaatacgatgcggggagggaacaggaaaaacaccgtgtccttctccctttggggttgcgcacattatatagtggataaaaaattcccaacgcacgggtatttaaccagtcccccctttgggacgattcccaagcgaccacttgacatctcccgaacagcaattaccgataccacgcattataaaactattgttatagccgcataggaggaatcccgtctcccaagagccaagtataagagcataagagtgttccgcacccaaagggacgccgcgtttaacatatagacaattcgcagcn

SEQ ID NO: 552922 - DNA, 136 bp, Homo sapiens
gacagcacagggaggcagaggggattaggggtcgcgggcggattagtcggccagacaagcggggcagtgagcagctaaaaagtcctctgctaggcttcacgtctcctctctgtgctgtccacctcctctgtgctgt

SEQ ID NO: 552923 - DNA, 142 bp, Homo sapiens
ctgatgtgattctgaatgaaattagaatcgattacagagtaattgaagaactgatgttgcacagtggctgttaaagcctgagacgtgtgcgtacgtgtaaataaagaattagaacttatgaacctttgcatgaatgatgata

SEQ ID NO: 552924 - DNA, 157 bp, Homo sapiens
  misc_feature (81)..(81): n is a, c, g, or t
  misc_feature (95)..(95): n is a, c, g, or t
  misc_feature (101)..(101): n is a, c, g, or t
ggctcctgaaggccaagggagtcaaggtggtggcctgtctgagtgttaatgatgcctttgtgactggcgagtggggccgancacaaaggcgaagnaaggtncggctcctggctgatcccactgggcctttgggaaggagacagacttattactagat

SEQ ID NO: 552925 - DNA, 114 bp, Homo sapiens
gatcctgaacagcagcaggccggcggcgctgaccagcacgcgatggggccgtgggcctgttcgatctggtcgaacgccgtttcgacggcgttttcgtcgctgacgtcgaaggca

SEQ ID NO: 552926 - DNA, 372 bp, Homo sapiens
tgttatgtcattgtgaatttcttcgataatggcccatttgggctaatcagctgagttagcgggggcaggcctcctatggagcaggacgggtggatggcaattatagggtgtttagtcatgcttatctctgctttctggtgtcgagtatatatactatggtcgtggtgctggagtttaagttgagtagtatgaatgcggtaatattttggataatataaataggttaattaagaatggttatgttagggttgtacggtagaactgctattattcatcctatgtgggtgattgatgaatatgctaagattttgcgtcgctgggtttggtttaatccagctcaactgcctgctatgatggataagattgatagag

SEQ ID NO: 552927 - DNA, 388 bp, Homo sapiens
aggagaactcacacccagactcttccaaagggaacccagtttgcccttcgcctggggcttttaaccctcttgtgatttaccctgggatttaaaagggggtcccaggtcccgcgaaatgcctgaaccccacctgtgtttgaggcctacactttggggaaaaaggagttatatttggttcttctggaatttggagaggccaatcacgcggacagccctggaaaaatgtgtgctctggctcggaatatagagaatgggacacatcacattcacgtcacctaagttggaatggcaccaaggcttttcaacacagacgcatctgtagccgagtggaaccttgtactaacttatgatagaatgtatccagaataaaagtttttacccgtgttta

SEQ ID NO: 552928 - DNA, 215 bp, Homo sapiens
  misc_feature (146)..(146): n is a, c, g, or t
ccggagcttaattcggccggggtgtggagctgacagataaggggggtgcgtcactgccttggagaatcttggacacggaggcaaagagaccctgcttgggagggcagatgaagtacctgaacgcccccaactgctgccatcgttcnttgccctcaggttcgtccatgctccactgcccacccactggcctgctggcaacactcctgtggtcccac

SEQ ID NO: 552929 - DNA, 179 bp, Homo sapiens
tctagagtcgagcagtgctccatgcttaactgatactttggcggtcagcacggtgctcactgtgtcgacggaacttgtacagggaggcatgcaccgcacatggtgaatacacgttgaccaggctccatgttaacgatatttggaggtcagcatggtgctcacgtgtcgccggaacttgt

SEQ ID NO: 552930 - DNA, 260 bp, Homo sapiens
tacctcctctgcgtcttccatctactgaaactggcgacgagggggtggggagcttctgttctggtgaagggacccgggtcaggcccccagcaccccatgctgagttggagaaaccccagatctctggggcccaagccaggcagtggtgtggtggcaggttgtgccaatctacctcagatggccatccccctgccgggcatgccggcgatcatgggcggtgaggctctgggggtcggatgacaccgtgcttatgcatccca

SEQ ID NO: 552931 - DNA, 342 bp, Homo sapiens
tactcattggggctggtcattacatggggatcactcagcaactcacactgcgcaagacggaaacaaactcccagtttcttaatcaaaaactagccaaggaacacgaaagagaaggaaaagggaagtcctaacatttcccctgtctgtggccaccagtagtgcaggattcccaagcttgcaagctaggagagcactgcctctagaggactgaagaaaagacccaaaaactagccaaggaaaaagaaagagaaggaaaagggaagtcctaacatttcccctgctgtggccaccagtagtgcaggattcccaagctagcaagctaggagagcactgcccctagag

SEQ ID NO: 552932 - DNA, 986 bp, Homo sapiens
  misc_feature (725)..(725): n is a, c, g, or t
cgtcggtctgatataaatataccttagatgaatgtggaagagctcagaagaagtacagttgttcagtggatttattgatgcgctcacaaagagggggccccggaggtacactctacatcaagtgaaatgcattctacatgaccgctttgaggtatgtaggagatatgttggcgttgggtgccatcaatgctagtgcttctgaaaaggaacaccttgaagctctcttaaagcatgttactacacaatggtgttgaagataatattcaagaagttgttgggcatatcagtgaaggtgtgtgcaggcctctaagggttcgaattgagcaagtaatagtagtgaacctggggcagttttattatattaaatttcataatctcctcaaaatgttagtcaccatatgaatcagggtattgttggacaatagtggaactggattattgactaccattgaatgaaatgcatttgctaaggcataaaaaatattcttcaattagcttgagtcttcagtgcaagtaaattatgggacaagggttgaagtttctgaacaaactgatcttggaccatggtgctgaataaatcagagactcatgtggctgtgtgaagtttagataacacgagtctaaagtgagtaacgtgagatgcttgtcaaggtgattgggtgcggttataatgggtctgggattcgtctcctaaagatgtgtacctgtattcaggaagcactttnggccaggtgcattggctctttaatgggaatcgctaattttggtgagaaccagtggctcaattagagtaccctgcaggaggttgaaatgtacgtttatgagacagttggaagtattataggagggcgatttaaaaggggggggaacataacggggaaaacaaggagtataaaacgagaatgtggggcggtcacgtataacaaacaaaaagatatagggaaagtggcggataaatcgctgcaaatattttatggtattgttgt

SEQ ID NO: 552933 - DNA, 157 bp, Homo sapiens
aagacagtagtcggatacgccggttatgccatgatcccccgcgcttccaggtccttccaggtcttccagaagccaaacatcaagaatcagccttcaggaacgccttgaaacgtaccagttcggtgaggcgatagccgcgatagcgacccatggccat

SEQ ID NO: 552934 - DNA, 244 bp, Homo sapiens
  misc_feature (76)..(76): n is a, c, g, or t
  misc_feature (135)..(135): n is a, c, g, or t
  misc_feature (145)..(145): n is a, c, g, or t
  misc_feature (237)..(237): n is a, c, g, or t
ttctagtacgcaattgtgtgtacagtcgcagctgcacaatacaatgacgaggaggaggccccacgacacatagtanaacttcagatataatggtttggtccgtcgcaatgcggtcattgttgtatgttcatatcntttagggttnccgatttatgcgttagccatattccagtgtcggaagcagggcgtcgattggatcccgaacgagtgaatgagtcgggccggcacggagagggnagtaaga

SEQ ID NO: 552935 - DNA, 104 bp, Homo sapiens
cggcaaatgtatcactagattctacgtagtgatctgcttttacttggtaattggtagttctcaaaagacttttttttaaaaaaataaagtccatacttacactt

SEQ ID NO: 552936 - DNA, 276 bp, Homo sapiens
atcctagcacttgggaggctgaggcgggaggatcacctgaggtcgagagttcgagacaagcctgatgaacatggagaaaccctgtctctactaaaaatacaaaattaaccaggcacatgcctgtaattccagctactagggaggctgaggcaagagaatcgcttgaacctgggaggtgggaggtttggccggggacccagatatgtggcgcctatgtgccatctcatacccgggggcaatgtgagcaaacacctgctgtctcaaaaaaaaaaatta

SEQ ID NO: 552937 - DNA, 466 bp, Homo sapiens
  misc_feature (25)..(25): n is a, c, g, or t
ggaccacttaggctagtacgagctnggtgtaatcggtcgaccttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552938 - DNA, 504 bp, Homo sapiens
atgttacatagagtacaattatagtgaattttgtaatatcttatgcagtctagttgtggtttttggatttttttttttattttggacaaaaaagagtgatttgcgccgtttggctatacggtgctctaaaactcctggcctcaagcaatccctcctgcctgggcctctcaatttgcgggaattacaggtgtgaaccaccaagcccagcctatgaagtctaatttttaagtgttaaaaatattagtagtgactcttatttctggctcaaattaatttctactttatgctaagagtaatatctcccttcaaaataatcagttccgatgtaatctgcttcgggttaacttgtgtatttggcaaaatcccgctattaaaggtatcccactattatgcagtctaccgtgtaagttaaaaagatttttaacaatctaagtaaatactgaaattatccaggagtagtgacatgcccccgtggtcccacttcctaaggacacagtagggaga

SEQ ID NO: 552939 - DNA, 576 bp, Homo sapiens
  misc_feature (23)..(24): n is a, c, g, or t
  misc_feature (31)..(31): n is a, c, g, or t
gctattgaatgtggcttatatcnngtgcgancgagtttccgaggattgtttttctggcgtttggagaagatgcctaaattgagggcggagtcgaaagatgtttaatcccacaaggccacgcggcggggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552940 - DNA, 445 bp, Homo sapiens
tggctaggagcgaggctgggtgtggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552941 - DNA, 105 bp, Homo sapiens
caattccagcaaaaggattaggagggggaaagggccctaattttttttacagcagagacaataaaccttccttaaactcggccgtcaactactttccggacgttt

SEQ ID NO: 552942 - DNA, 226 bp, Homo sapiens
  misc_feature (66)..(66): n is a, c, g, or t
tcgtggtgactagagttcccccgcatgggtaaactaagctaggaactgctcggcagcagcacaggntgctgttgagcgtgttgccacgtaatagtcgagactttcatcgctgaggtctggccggccatagtgggtcgggaacagggcggtggacagcccttgcacgatctggcccatggcttcgcgcgatggcaattcccggatgcgacccttacgccgatgcggg

SEQ ID NO: 552943 - DNA, 465 bp, Homo sapiens
  misc_feature (7)..(8): n is a, c, g, or t
gcggccnnctactactactaaattcgcggccgcgtcgactcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552944 - DNA, 455 bp, Homo sapiens
ctataatgaacagcgatagtattattccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552945 - DNA, 914 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (535)..(535): n is a, c, g, or t
  misc_feature (580)..(580): n is a, c, g, or t
  misc_feature (610)..(610): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaacaaaaaaaaaaaaaaaaaaaacaaaaaaaaaaaaaaaaaaaaaaaaaaaactccggggggttttttgtgngggggggggaaaagaggggtttaggaaagggggccgtgggccaangggtgtttcttgggcccctttttttgtgtnacagggggggaaaatggggggggcccccccattatgaagggagacgggaaaaataaaatttcgggaaaacaaccagaggtggttcaatcgggtgtttgtatgtactcctgcccgtcgaaaaaaacctcggcaccactccgaagcagacaagcgaacacatgcatacagacaggcacggagtcatcaacaacagtgagtggacaaacaaacaagacgagggaccgacgagagaacgagatcataacgacagatcagaaagcagaaagaagcagcatgatcagacgacacagacataagaacaaga

SEQ ID NO: 552946 - DNA, 407 bp, Homo sapiens
gcggccgcctactactactactactactacattcgcggccgctcgacgtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552947 - DNA, 85 bp, Homo sapiens
gagcttccagtttcctactatgttattcccactataaaatattctcaactttggggttttagccacttaagtttttattttctct

SEQ ID NO: 552948 - DNA, 916 bp, Homo sapiens
cgttttacttgactttttgtgtgcggacctttttgactttaaggagctgcccggaatataatgttaagggaccacaattgcttagtttaacgggtggtccctttgtctcagtccatcttggtataagattgtcccaaccttaacttgtaaagccataacgttatgacagacatgtccggagacctctgttaaaatcggttttagacatgacaccagggctcatgtaatattaagaatgttctttgattaaaatccaattgacatgtgacatgagtatttgaaatggtgcttatgggcttatcgaagcatattttttatttgtaatccgatgctgtccccagaataagtgtattgtaatatgaatgttaaaattggaccagagaaagccggcaaataagtggtatttgggaaattaaaggaagattgaacccgagtctttatattcctgaatttaattggattaatgggaaatttatccttgttctttctatattggacttgtttttaagtgaatcagctaatgttaataattttatgaccagatccaagctgagttccatattagccctgttgccactttataacttttaaaaatttgacatagaatttttgaaaattaacttgacccaaaaaagttaataaatattccattgccagtttgggtgccacaccaaactctgcccttgaattggaatagccaaaatgtggcccatagttccagtttagttagagccaattaaaagtgggaaattcatttagaatactttgtttcacaaggaatatgagagagataaattacttgtgttgattagggagatttgtcacttaaacctcttccattatttcaacctcttgtacagccataaatccatgtaaatttagagctatagaataaaataaccgattgcacccttta

SEQ ID NO: 552949 - DNA, 620 bp, Homo sapiens
  misc_feature (593)..(593): n is a, c, g, or t
ctataatgaacagcgatagtattattccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaagacaaaaaaaaaaaaagacaaaaaaaaaaaaaaaaaaaaaacaaaaaaaaaaaaacaaaacaaaaaaaaaaacaaaaaanaaaaaaaaaaaaaaaaaaaaaaagaag

SEQ ID NO: 552950 - DNA, 471 bp, Homo sapiens
  misc_feature (130)..(130): n is a, c, g, or t
gtctgacctgcacgctctctctgatgatcccatatgaatcgtatggttcatgtccttatagttgatgacgacgttgttctaggctgtcatgtagtcggctatgttgtggtccacgatgaggcgcagcaanctgtggagcagagtcaagtcgatcttctcatacattttctcaaagcgggattccagcatgacatggcactcgctttcattcgtctcccacacgtccggcagtttatggatgcctgaggagtagcagggcaggtctccagcaggtttagaaatcctctggcaaagattagcccccaagggagcttaatcataacctttccataacgcaatcccactactgattcccacggtatacattgtggactggcatgggccctactgggctttcccctcagttaaacagagaacactatttcccttaactaccacgcatcaagagagaggcttgcgggggatcctcta

SEQ ID NO: 552951 - DNA, 673 bp, Homo sapiens
  misc_feature (10)..(10): n is a, c, g, or t
  misc_feature (15)..(15): n is a, c, g, or t
tttaaaaagngcgcntgcgtgagataaggtcgccctcgcgtgggtccccattcttcacaaaggggaggacgttccaccaccgcgtgtccgccgccacacgaggaagtacaacgtgccgcctcgggcggtctttccacaaaaaaggccgctggctatatctgaccactgctaagaggggtcgctccttggcaagattacccgcgctgcgagggacaatgctctacgctcccccggcgggggtgagtattcaggtggggaaacaaccgtagtagacttccgcgccgaaccacccctctgggcgaggaagaaaaattctctctccgacgccccaacacgccccgccggaactctcaaagggcggtggaccagcggcgggcgcattttaacccggctccgaaatatgtccccgcagggttgtcaagagagctgtcaaacaacgcgcgccacaatcgaaggcccccaagatatacgactctgctcgagaaattcctacggcctctcatcccaggtcgcactccccggcagcatcatttggcgccccacggcgagctccacaaataggcgtgaaaagggaaaaagaaaaaaaaaggcaaaagaaaagttggaacaaaaagaagaaaaaatttttttaaaaaaatttggcctaaaaaaccatcacaaatccccaaaaaaa

SEQ ID NO: 552952 - DNA, 816 bp, Homo sapiens
  misc_feature (23)..(24): n is a, c, g, or t
  misc_feature (31)..(31): n is a, c, g, or t
  misc_feature (639)..(639): n is a, c, g, or t
gctattgaatgtggcttatatcnngtgcgancgagtttccgaggattgtttttctggcgtttggagaagatgcctaaattgagggcggagtcgaaagatgtttaatcccacaaggccacgcggcggggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaaaaanaaaaaaaaaaaaaaaaatctccccaaggggggaacccgggcaaaagaggggcgagagaacctaagggggggggcgccgggaacccctttgggccccttaagaggggggcaaatccagaactgcgggaacaacgggggcaacgggtccgggtgcaacacggtaccggaccaattccaa

SEQ ID NO: 552953 - DNA, 482 bp, Homo sapiens
ctcaacgctttatacttcgagcagcctggcagttgtgaaactgaagttgaacagtgtgtagagaccctggaatggttgtgttacaacaggatgatgctttgccatgaacttgtggaactcatctatcaacaggccacatctatcccaaatttctcttatatgggagctcgcctgtgtaattacctgtcccatcatctgacaagttaggccacagagtggcaacttccgccaatagctactgcaaagatgtcggactgaatatgaagtgaaagatcaagctgcacagggggatgaagttactcgaaaacgattgcatgcatttgtactctttctgggagaacttgagtcttagtcgggagatcaagggaagaagtggacaggttacaagagcagatattcttcaggtaggtctacgagaattgctggatgccctgttttctagtcctatggatgacgattggatttgtggagtaaaattgtta

SEQ ID NO: 552954 - DNA, 798 bp, Homo sapiens
  misc_feature (25)..(25): n is a, c, g, or t
  misc_feature (538)..(538): n is a, c, g, or t
  misc_feature (540)..(540): n is a, c, g, or t
  misc_feature (544)..(544): n is a, c, g, or t
  misc_feature (548)..(548): n is a, c, g, or t
  misc_feature (551)..(551): n is a, c, g, or t
  misc_feature (554)..(554): n is a, c, g, or t
ggaccacttaggctagtacgagctnggtgtaatcggtcgaccttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaaaaaaaaaaaaatttttggggggccttgggccctggagaaagttttttaacccantngttngggngcnggngccccataaggatcagtgaccacgggccaaaagggggccccaaggaggacccgggctcagcaaaggtgtgggatttcaccaataaaaaggccggggacacccgcgtttgacaatccacgggagtcgaggacatagggccaacacaggggccacggcgtcgaataaatacgccggtggacacagggagcacagcgcgacgcgaacgttacaccaccagatacacacgcacaagcaggaacaacac

SEQ ID NO: 552955 - DNA, 221 bp, Homo sapiens
gtctgaggatcccttattcgtgtgcactagatctgagaaacagactcaaattcttttttctgtgaccttaaatcaggctcagagccctataatggacttcacaattctattttgttgtatgtgaccaataaattatctttaaaactatgctgtaagtgtaaaatatatacagaacttcaaaggcatactacaaaagaaaaatgtaaaatgctaataatgtt

SEQ ID NO: 552956 - DNA, 587 bp, Homo sapiens
  misc_feature (169)..(169): n is a, c, g, or t
  misc_feature (219)..(219): n is a, c, g, or t
gaccgcggacctcagatgaatgcggctgttaagacctgcaataatccagtaatggcatacctcctgactcatatagttcgcatcaagcgaaaataggagaaccagagcacccgatgtggttgctacaggagtgggcatgaagcttggagagtcgtaggaccgattcaantccagaaagccattaacgaattcggagagggactctttctaagatggggnttctaggaccaaccaaaacctggtttgttactgggggctaagaaaaaaacccttggttttcctagaactttcgctctcaccaacacttaggcacgtatcacccatggaaagcgcttagcttgatggaatagggctgttggtggaaaagctggttttcatacccaagggcagaggctttaaccaacggaaaaattagcatggcttcccgtgggcttcaaaggagggaaaccgccaaaacgggggaacacccctttcaagacaaaaaagcaggccaaggcattgtactggccaataaagcatgactaacgaagactgttaagaggcaaaaatacgctctgattcctgacctcagactgattgtcctaatc

SEQ ID NO: 552957 - DNA, 220 bp, Homo sapiens
agtcgatctctagcaggatccccggccatgtgatttacagccactctcaatgaagtagcagatatgctctcgagagcttgatacttattgatacttggttggtcttgattagattagatacaccatgcccatttcagcatagagttcgggacatgagacgtcgaggggagatcgtggtgcgtgatcgtctttatatagttttcaaagtcacttcctataa

SEQ ID NO: 552958 - DNA, 797 bp, Homo sapiens
  misc_feature (181)..(181): n is a, c, g, or t
  misc_feature (205)..(205): n is a, c, g, or t
  misc_feature (249)..(249): n is a, c, g, or t
  misc_feature (257)..(257): n is a, c, g, or t
  misc_feature (280)..(280): n is a, c, g, or t
  misc_feature (314)..(314): n is a, c, g, or t
  misc_feature (364)..(364): n is a, c, g, or t
  misc_feature (368)..(368): n is a, c, g, or t
  misc_feature (378)..(378): n is a, c, g, or t
  misc_feature (390)..(390): n is a, c, g, or t
  misc_feature (435)..(435): n is a, c, g, or t
  misc_feature (451)..(451): n is a, c, g, or t
  misc_feature (466)..(466): n is a, c, g, or t
  misc_feature (472)..(472): n is a, c, g, or t
  misc_feature (482)..(482): n is a, c, g, or t
  misc_feature (493)..(493): n is a, c, g, or t
  misc_feature (507)..(507): n is a, c, g, or t
  misc_feature (618)..(619): n is a, c, g, or t
  misc_feature (629)..(630): n is a, c, g, or t
  misc_feature (632)..(633): n is a, c, g, or t
  misc_feature (636)..(636): n is a, c, g, or t
  misc_feature (641)..(643): n is a, c, g, or t
  misc_feature (645)..(645): n is a, c, g, or t
  misc_feature (651)..(651): n is a, c, g, or t
  misc_feature (655)..(656): n is a, c, g, or t
  misc_feature (660)..(660): n is a, c, g, or t
  misc_feature (672)..(672): n is a, c, g, or t
  misc_feature (678)..(678): n is a, c, g, or t
  misc_feature (697)..(697): n is a, c, g, or t
  misc_feature (701)..(701): n is a, c, g, or t
  misc_feature (727)..(727): n is a, c, g, or t
  misc_feature (790)..(790): n is a, c, g, or t
gggcgccgagatgtgggagctgctggccgcggcgtgggcagttcaggggctgggcggctgaggtccgagccgggctctgggttgaaggatcctgggctgggagcggagggggagcggaggaggagcgggcgggcggggaaggaagggtcttcgcggtcgacttaggggcctgccggctggnggggtcagggccggaggggctgtngcgccgcgggaagaacctgcctcggggcagagcgtcttgttccncgagatcnctccagcccgaatagcgcctggnagacagctcggagggctcggtggagaggatcgcncggtcccagagctccgttgggccaccttttccccccacactccttatgcntggnggagggaganccttttccatcntggcgaaacatcctttatatggtgcaaatatctattggcaacttngcctcggccataatgnagattttctttttcnccatcnacttaattanttcttttaacncaggatttttaggnggatcacatgaggagggggccactcttcagttgttacagatggaggagacctctttttttgttgcctgaacaaagatgggcaacttgggcttgtgtcacacagaggatatnncatattttanncnntgnaaatnnntntttggntgtnncatncaacaggtgggntgtggntgggattttacgattatgntcanagaaaatggtcaagttctatcatgtngatccaactcctttggccagttaggagttcctcatggacctcgaagatgtgtggttcccaggncattgag

SEQ ID NO: 552959 - DNA, 398 bp, Homo sapiens
ggggacactaaccacccttcccttaagggaccagcgactgcagttgagtcatgatctgctcggaatcctcctgctaaagaaggctttgggcgtgagcctcagccgccccgcaccccaaatccagtacaggaggctgttggtacaaatactgcagaaatgacaccaataatggggcagacacaacagcgtggcttaaattgtgcccacccagggaaggtgttgaatgggaccctgttaatggccccatttggatgtaaatcctaagctcaaatttttgttactccattactgtgatttttggttgggtccccaaaaaaatcgttaatccaaacccaaattatgttcctgctgtatttcctgcttccctgttgaattggtgaataaaaccttgctcttta

SEQ ID NO: 552960 - DNA, 133 bp, Homo sapiens
  misc_feature (24)..(24): n is a, c, g, or t
  misc_feature (69)..(69): n is a, c, g, or t
  misc_feature (89)..(89): n is a, c, g, or t
  misc_feature (91)..(91): n is a, c, g, or t
atttgtaagagctgtttatatatnctggataccagagttttgtcctgtaataggcatttcagttatctncactcagttggtggcttgtntnctcattttaatgatgtctctggatgaaaagattatgtttaag

SEQ ID NO: 552961 - DNA, 702 bp, Homo sapiens
gcagctcgaaaagcgatgcctgattctggtttcctggggctgcgtgcccacttcgtgtggacccagacgctgatgagcgtgcgagcagtgcgatgtgcccaatgaaataagaagctgggtgcttgtgctgtgctgtgcttgctcagggatgcctgctggtgtgcgttggatggttgacccagtatcctgtgaggactgtgctggctacatgtgatgctgcactgacgctgtgtgtgcttgctttgtcatgatgtgcccgcaaagtgaaagaactcgttacttctgttgtgacagctgtgcatccaaggtgaggaacatgtggcttggacaagaggaatgatgagaccaagaggtccgagacagacaagtcaccttgcatatcgtcaatggaagaaccgcctttcggggcgttggaccttccaattcccggtcagatggagaaccagcgcagtacccgagaaaagggtcgcccgttgacgacccgcagcgaaagaagagtggaaacgtgagttccgcagttcctggaccactccggaacagccaaagtgtggtacaccgctccgaaagctttgaccgcaaagagggaaaagagcctttcccaatcgtggggcttgtgggaaatggtggggagtgccaatggccgtaaattatgtgtcgcgatgtaaaatggctttttgtgggccccgaaagtagccaatgggg

SEQ ID NO: 552962 - DNA, 110 bp, Homo sapiens
gtttatttgacacgcctcctttttgttccaactctacaaacagtttccgaaacacagtggaaggttacagtgaccccacggaaagtatgaccctgctgttcgagtcttca

SEQ ID NO: 552963 - DNA, 302 bp, Homo sapiens
  misc_feature (91)..(91): n is a, c, g, or t
  misc_feature (121)..(121): n is a, c, g, or t
  misc_feature (133)..(133): n is a, c, g, or t
  misc_feature (268)..(268): n is a, c, g, or t
accattcgtttggagcgcgggcccggtaggtaagtgaagcatggtcatagactgttgtgcctaggagagtcctggtacagtgaactagtgncttggaatttcatcagcaagtaataaatcnccacggaggaanaccgaggcgtggctgaacgaaatgccagagtggagattctgagggtgcattatctggagtgctatcaacaggagtccaaacgacggaaggcatcgtactaatcgaagaagtctatccgacctaccggcaccaccntggaacgggcccccacgacccccgtgggaataag

SEQ ID NO: 552964 - DNA, 319 bp, Homo sapiens
tcttagaggatcccgcttgatgtacatgctcatctgtaccatgaagtttaggcagacatggagacacctcacggctccacctctctggacacaggaaagatgatatgacgagggagcacaggtcagcgtgggaagagggtcatgttggacatgggggtggggtggtcgtccccgagctcctcacattatgcctacaacaacgacagacacatgcatgtgcctttgcagaaacaaagtcaggtttcttcaagtcacaccgggacgggcaggaacaaatctagcctctcagtcccacacaaggcagctgtacctcacccgt

SEQ ID NO: 552965 - DNA, 271 bp, Homo sapiens
ttttccagagtcatccagcaattaaagaactgcctctgtagaccaacatacagatgtagatatatagtgtctagagaccacaccccggtagcaggttacgccatgtcaccgagccccattagattcccagagggtcttagtacctggaaagtcaggccaacaagcaacgtttgcatcatgttaatctcttaagtattaaaagttttattttctaaaagttataaatcatgtatttacaaacatatttttcacagcgtggcttggttcccat

SEQ ID NO: 552966 - DNA, 393 bp, Homo sapiens
  misc_feature (7)..(7): n is a, c, g, or t
  misc_feature (19)..(19): n is a, c, g, or t
  misc_feature (59)..(59): n is a, c, g, or t
  misc_feature (163)..(163): n is a, c, g, or t
  misc_feature (353)..(353): n is a, c, g, or t
  misc_feature (372)..(372): n is a, c, g, or t
  misc_feature (391)..(391): n is a, c, g, or t
aggactngggttaaacatntctattagaatgtaaatgagacactcacctattaaaaggnaaaggtaccttattagatttttaaacatcaaaaacaaaacctgcccaggtgcagtttttggattacagtggctcagacacctgtaatcccaatactctgggagncccaggcgggcgaatcgcttgaggccaggggttcaagaccagcctgggcaacatggcacaacaccatttctactaaaaatgcaaaaaactacccaggcatggtggtgtgcacctgtagtcccagccactcgggaggctgaggtgggagaatccgttgagcccgggaggcacaggttacagtgagctgagntcatgccactgcactccancctgggcgatagagccagntc

SEQ ID NO: 552967 - DNA, 117 bp, Homo sapiens
cacccccttccccctttttagtcccccaacttgagatgtatgagggctattaggtctcccatggagtgggtggaggcagaacaggtattactctgtacactgacttgcgcacaggcg

SEQ ID NO: 552968 - DNA, 793 bp, Homo sapiens
cagggtggtacatttgttagaactgatgaacctacattgacacatcgttaccactcaaagtccatcgtttacattagcattcactgtggtgttgtacatagatgcatccaccattacaatatcagatagaatcatttcatgccttaataatcccctcccctgaatccctgatcttttgctgtccccataattttgccttttccagaatggtatgaagtggaactatacactgtattaccttttcagatggcttctttcactcagcaatgtgcaatttaggttcctctgtgtcttttcatggctgatggctcatttcttttcagtgctgaataatattccatgtctgaatgtaccacagtttatttctagagcaatactttttacaaaccagaattataccccaacggtgggacaaatggggtggggaggctgtctgagagttgtgagtgtgggggaagtggaaggtctttgactgacttttcgctgtgcataaaaagcttctgtgagcatcaagaagagagtagtggtctgggggagagcccaggatgagaatcttgcaaaaatacatccttcaccacaataaaaggcgaatccctctcctcttacatttccccactttcttcccacagcaggcctgggatctgcttaagtccaaaaatgttcctataagttagcaaatatcttatgtcacatactctcgcaaacagtttatgaaacatattttagactaaacaagtgaagagaatgaagcgtttggatggtgaagtcctgatccagaatattagcaaggaac

SEQ ID NO: 552969 - DNA, 483 bp, Homo sapiens
caagatgtatgcgaaatgccaaaagaaactggcacctgactggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgacagaatgtggctcatgctctgagtaatgttcctgtacatgactgatgctaaagactggattcacagtttaactctaagaattcaaagatcttagaaattcacagaacagaacgattgcatatacatcctattcatcaatatttggatattttgatgcaaaatatccatacgttttgatttcatatttatgtcccatttatctccaacttctagaactcccagtttatacctgtgtcactctcaattttttccagtaaagtacttgatgtaaa

SEQ ID NO: 552970 - DNA, 723 bp, Homo sapiens
tggaggctgtggccgtttcgttttcttggctaaaactcggtgggagtgatggcgggccggcgcggcgcgacaccgggctccggaaccactgcacgcacggcggctgcgcactgacctacaacacaaatgtctgcgatcttctagcaggcgcttgcagcatgctcagaatgcattgactgggcgggaaacagcgcaactactacttgcttccattgctgctggatgtactactctcatttacaggctggtggacttactcactacgactgcacgctgctcacttcatccacaccactgaaccagactttccaacaccactcataccactgccgtgtgcgtgtcaataggcaaacccagtacgcctctccaaaaatgcattaactgcacgacactcgacctgcgcccacagtccgcagcgctgcatagataccacacgacgcaagggtagtctaggagctcaaaccacgggtagctcgacattccggccctatcccgcaacggactccccatcgtccggcccctaggagatcctctcggcatatgcaatctaactgccgaaatacctaacaaatgggcagcgcctcaatgaaacgcccataacagccacccaccagaaccataagctactacccactgcgacacttggccggcaaatctgacacacaataaactgtccctacaaatccttacatcctgcgagcgacacgcctctctcaaccctcg

SEQ ID NO: 552971 - DNA, 288 bp, Homo sapiens
cgaaaggcggaggacagaagtactccataaacgaaaactcgggccagaatgacacagaggttggagagggaacgggagcctcttgggagagtattagaccttgacaaaaaccaggtgggcagggtgcaccatggtcagccacatacgccagtaggttgatggccgacaggataggcacagccagatcggtggtcccaggcacacacgtagtaggcatggctagcggctagaacataacataccctcgaagcgccgagggctgggccgccataacttctacaatcgaaa

SEQ ID NO: 552972 - DNA, 569 bp, Homo sapiens
ctagtttaagaataatttttcatgtaagacaagacagggagtatttgtttctacatcatgaaatgagtccatctattcccctctgtcccttactaaaatctggaaactaaatgactgtaaaaaatgaaacaggtgttaaacacccccagacaataaaatagaagcaatggcaaagcaagattttgggaactgaaaaataaatggatcagtgttaactgactcaatagacaacagaaatgaaagtatcagtgttagatagaggtgtttcactaaaaaacccagaagtgggttgaaagaagtcaaaacacacatggcccgcagtaccttcccgtgtaaaggtaattgaccactaccccctacacgagtagtaagagaagtgttcacagactaatctccactgaaagagggatgcaactcagttcgtggagatagggggatatcctacactatatgacagggtaagaggtatttatacttgaaagactgacggaaggtctcacattattgaacacagaaaagatcttctagagtacgacgtgtccctccaaacctccaccgccaagaaaaaa

SEQ ID NO: 552973 - DNA, 750 bp, Homo sapiens
ctggtacgccccggagtatcgggatatcttggccaacaatgacctttggggctgccaaagctgcctgcctccgagagttgggcggggcgagtagttgcaatgacaaacatttaacccaatagcgaggagatttcagacgctacggccgcaataaccaatgacaagaaagaatcctttcgaataggacgtgtcaggcaacctagacggccggtgccgctgcggggcgtccggcggtcttccgttccgcacgcagggcggggctggctgtcccaaaagcggacaggtggttgtcgtccgttcccaagctggtttgaacaactatggggtcgggctcggccgtcgtcgttgttctgtcgccgcatccccgcttccgggttaggccgttcctgcaccgctcactcctctgctcccttcggacccatagatctcaggctcggctccccgacctgccgcagcccactgttgacccgggccgtacgtgcgagccccgatgtccaccagtgtccctgcacgggaaacggaaggagatctacaatgtatgaagcgaccctggacagtgtacgcgatgaactggattgtggcggccgagtaagacgcgtgcggttggcgctgggcaagcttcctcggagggagtacaagaacaaggttcaccttcgtcggtccctgatgagagagagtccagacgttaaccggcgagaaagagcccttagaccactccatatcgcgaccaccaaagctcatgtggatccc

SEQ ID NO: 552974 - DNA, 200 bp, Homo sapiens
tgcactgcttcggatacacccaccgcaactgtctgtctcatatcacgaacagcaaagagaccgaaaggtgcatagtctgagaagctctcaacacacatgggcttggccaggaaccctattaacaatggcaggcttccaccagaatttcaagaattttagggccctccttccaagctttttacccagaacgggcgatccaa

SEQ ID NO: 552975 - DNA, 950 bp, Homo sapiens
tagcaaggtcaccacaccaccgacctgtccaatagaaggccttcgagtacgggataatcctatttattacctcagaagtttttttacttcgcaggatttttcttgagccttttgaccactccgagcgctagcccccgtaccccccaactaggagggcactggcccccatgaggcatcatcccgctaaatcccctagaagtcccagtcctaagacacctccgtattactcgcatcagggagtatcaatcactcatgagctcaccatagtctaattagaacacaaccgaagccaattaattcaacgcgactgcttattgacagtctttatcctgtgagtctctattttatccctcctacagagactcctcagaggtacttcgagtctcccttcatccaatttccgcccggctttctacggactcagcacttgtgttagtagccaacaggcttccacggactgttcacgtcatccatctggtctgcaacttttcctcactatctggcgttacatccggcgcaactaagtatttacaccttgtactagtccaaatcactcacgttcgggttcgaaagcccgccgcgtgatgctggcattgtgtgagatgtggttgactatttctgtatgtctccactctatcgatgagggtcttacagaagcatcattagtacatctttggaggctgcagcaagagtagtggagcatcctactatcacctgggaaggggccctaatttcggtgacccccgtgttgcatggagggtgcccaatgtgcctatgttgaagtcagcagggccgcgcggatcctaatgcgagttgggagacttcttggcgggatcttggacaggcacctcctccggggggggcactatgggcacccgccaaatgaggcgcggagaaacataggttatggtgaccgcgcatgttcgcctaacgtgtccggtttggaattc

SEQ ID NO: 552976 - DNA, 923 bp, Homo sapiens
cgtgtggacgagggtcaacaagtttgggatcaagcggctgccgttcctccaaaagcgaccgaagcgcgagcagattacccctccgagccagtgtagtgaacacacttcagaaacgtgtaggtgccggtggtcaccgaggggatgcgcgccctccaatgaggtgccggtgggcgggggccgctcgtcgctgacgcgggctggagcggccgagtcacccggcagctctcgggacccggtcacccggctcggcaacccgtccagctggctcgacctacggcctctagcctccgttgcccggtcctttgctcccgggccgagagacaggttggccggaggggggctcgttccccttcgggttctcctcggtgacctccacctccgggcggcgccgtgcgttgtctttagcggcccgccttgacggggcgaggttccccggtgaggcagatctcctgggggccgtccgtgccgcgtcgggccgacgtggcagcactcgcagctccttggaactggcctccagggctcccggggggttaccgaaggcccctcgaaggctatgcgtcggctccaggctgttggggggccagcggtctcctcggtgggcgtcaacacccgggacttcccgccgaactagggcaccccgcccatgcttcttgccagtggtgctcgaagggcgcccggacgttttccgggtcccctgcctcggaaagtcagtctgtggccgtgtttcccccttcgtgccgcccctttgctccaggcccggtcttgagaccaatcttttttgggcaacgccgaccaggggtgtcgggtattaaagccggggagccctccttgccttggaagatttccgcgcgggagagacccacgcgcggcaccccggggttggggtgagagcgggcgcgcggggtccggcagggggccggtca

SEQ ID NO: 552977 - DNA, 125 bp, Homo sapiens
tgctgagattacagtcatgagccactgtgcccaacctgtaagcctaggtttctcctgtaaaaccaagagaagagcctcctctctctctacggaattcagcaaagatcacatgtatgtatgcacct

SEQ ID NO: 552978 - DNA, 209 bp, Homo sapiens
  misc_feature (5)..(5): n is a, c, g, or t
  misc_feature (49)..(49): n is a, c, g, or t
  misc_feature (166)..(166): n is a, c, g, or t
aatanacacagtgtgctatagttaatcagaagcctcatggttctttttnagatggggtcttgccctgttggctaagcttgtcttggactcctgggctcaagggatcctcacaccttaacatcccaagtagctgggactacaggcacacaccaccaccaccaccatncctgagtcttgttgggttttttttagtcaatgtatttctaatt

SEQ ID NO: 552979 - DNA, 114 bp, Homo sapiens
tctagcctcgccagtgtctagcctcgcccagtgtcctagcctcgccagtggtcctagcctcgccactgactcgttagcgctccttccttcttcctagcttccttcaccaaatcg

SEQ ID NO: 552980 - DNA, 316 bp, Homo sapiens
atatcaattaagttaagcgcagagcatcataaggaccttacttttcaaaatccatgctggtgaacttgacctctttgatactttaggattgatattacaatctcaagaggtatcacggaatattgaggactggtattcttaaagaagagattaggccgtaaacagagcaaagaacatatgaagagatagacaagacagccattttacaagccaaggagacagatctcagaataacaaccttgctaacaccttcatcttgaacttctagcctccagaactgtgagaaaataaatttttgttgtttaagcctcaaaaa

SEQ ID NO: 552981 - DNA, 983 bp, Homo sapiens
  misc_feature (25)..(25): n is a, c, g, or t
ggaccacttaggctagtacgagctnggtgtaatcggtcgaccttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaaaaaaaaaaaaaaaaaaaaaaaaaaaaaaagggggggggggggaaaaaaatacccccgggggggcccccaattcgcgccccccgtttttgttggaaaaaggcggccccaaaagggggaggcataaaaagagggcggcgggggcggcggtaaccacaccccgcgcggggaaaaccgctgcgcgggacctttgggggaagaactcgcctgccggcgggggcgctatagggggcacccccccccacgagaaataggagccggcgaaaaaaacctggcggttgggggcacccgggttgttgtggcgtacaatggtctcgtttataaatagtcccgctcaaaactacacacaacaggagagcagcagaacacagcagagcgcgatgcagacagcacatccaccacacaagcagcacacacagcaacaagcaagcacagcggcaagcacacagaacctacaaaac

SEQ ID NO: 552982 - DNA, 104 bp, Homo sapiens
ccgcaattcatttatgtagcatggcacatggggcatgctcctggcactgtgctttcttcatgtgcctatgcctggatgcctctgatggtgcttggatgatgctg

SEQ ID NO: 552983 - DNA, 1467 bp, Homo sapiens
cgaggagaagcatggctgacttccttggacgatgcacgatgagccgggatgagcagacgtagcccgagccactgaagatccctttcgaccggaaatgacaatacatcatcaagcctgacgtgtggatggaggtatcagagtgaagctgcgtgtgcaagattatccagtatgtagtgaagacccatgactgagtcctcagtaccgaagaacagtcacggacgaccgggggcacgtaacaaagactggtggactgcagaaactgacgtctagcggcctagctggtaacaacctgttcgctgacatctgtagccgatgatgtggcaggactctggctaagcgatgacgataagcccggattgctgtgggatgaaaggtggatgttcctgacgtcctcacgctggggagaagcatgaaagccacgatagtgtaccaggatgacgcctgtaaccgagggagggatgtcattggtgacggcgattgcagaagtatggtagcatagcggagcagactcccttagctgccgctcacatggtctaggttattggcggcatccaatatagcagccgtggcgcatcgggacaggtggtcgcatcgcgtccaatgccccccagcaaccgaaattggcactgaacccaagagaggaccccgggacgagggagcgtagcacggcaatatgcccacacaggaacccgggaggaaaaagtctgaaggccttgggggtgaaagcacaaggggggttttggaaaggccccatccaaaagacacgtgaaatagtggggagccaacgggccttgggtaaccccttgggaacgcgtgaggaatccctggggattcctcacgaggcatggagggtacctcttcttggcggaaacagccagaacgaggaactgtaatcgggaagcaaaatccttgagagggtaaagcacagggccattcccagtgcagggggatgtccggttccacacaaccctgtggtggcaggtctacccgcttttcccgccggggcgcccgggctaaacaccaaacaattggggctaatccacctggcggaaaccacaaacatgaattttcacaacccaagatgggagcgagaagaaacaaagtcccctgtgaaaaaatctggccgacgggagactcacggagcgtagtagcccacgagcaccatgatagggggcccaccacgacgttgttggcagaaacagagagggcccccgttatacaaacaaaacaaagggggccggggcggaaaaaaaccacgggggcggccaaagacccacaccccttttaaaagggcaccacgtcagcgccatacacaatgaaacgacgagcggacacaacgatagcaagcagacgcacgtcgtagaccgaccaagacttgctagcgactcgacacatcagagaacaactagaagcatctggtggcatataccaaaagagaggccagtcatcgcggccaatgacggcagc

SEQ ID NO: 552984 - DNA, 107 bp, Homo sapiens
  misc_feature (28)..(28): n is a, c, g, or t
  misc_feature (74)..(74): n is a, c, g, or t
  misc_feature (86)..(86): n is a, c, g, or t
atccttacctttttggcagctgctcttnctgccccctttaatgatgatgacaagatcgttgggggctacaactntaaggagaattntttcccctaccaggtgtccct

SEQ ID NO: 552985 - DNA, 199 bp, Homo sapiens
ccagaggtcagatcaagatcgctaatccggcgtctagtccctaccgcaattgccccaacaacgcgcctctcgcgatctgagtggatgcgccggtgataacggattcccgcgaaccacgaacacgcagacggcgataagaaggatgtatgccgatctgaccggaggcaacctctgatgagcggaagacatcagagtcgca

SEQ ID NO: 552986 - DNA, 876 bp, Homo sapiens
  misc_feature (876)..(876): n is a, c, g, or t
tcgtgccgaattcggcacgagctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaacaaaaaaaaaaaaaaaaaaaacaaaaaaaaaaaaaaaaaaaaaaaaaaaaaaaaaaaaaaaaaaaaaaaaaaaaaaggggggggggggggcaaatttattaagccgggggggacgagattaatgcacgacaacttatttttgtagaaagaggacacacattgtagaggggtgtttattataaagagcggcagggggcgtatttaaaaaaagaggtggggaggaaaaaaatcgtgtcgtggtttctttggggagacagccctcctgtggggtggaaatatgggcgcacaacacggagatatatgacgccgggggaaaaaaaatagggtttaggtgaaagcagctatgttgcggagatatgtcgggtgatataatagn

SEQ ID NO: 552987 - DNA, 980 bp, Homo sapiens
tggctaggagcgaggctgggtgtggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaaaactcgagacctagttctctctctctctactcgggatcgccggaaatacgggacccgtatggggcctccctccggaaaagggtcgaacacaatttggaaatcagccagcacgcaaagaacacttgctcttcgggggcaaacccaggatgaagagacgagctgggggatctgaccacagggttcctgatagaagacagggctctggcgggcctgacggtaaaaggtaacctaaggaaacccaaaggggcgcagagtggacacggtgatggaactctaacggcctcacaaccagggaagggggaccgaagcaatcgggggacccacagtggcatgacccactagatggacgccgggaaagacactccacggggagaaccgcgtagaataacctctctggacaaccattgaagagccagaaagtggctataacttggcgttaagcggccgcgcccatccgagaaatttagcggcccggttatccgaacctgaaaactctctctacaaacaagcacacacc

SEQ ID NO: 552988 - DNA, 524 bp, Homo sapiens
gcacgagttccgttatcatgctgtcttttacgcgaattgctatcgttcgcaatactgttattattattgttatttttcgatagagtgtaagcagcagcgacggcggccatcgccatagattgatgatcatcgtccacaccaacacccgcatctttcttattcttgtcgtcgtcgtcatccacgactatgtcagattgagaaaagtgattattactgtcattgccgttgtcagtgttattattgttttcgtcatcttcgtcgtcttgttgattatgcgctgtttgccttaaataccaatccataactgcgttatgttgttcattggagttggcatgatccacattcgaagatgattcgttcgcactcaatgcgctaatattttcagaatcatcattattatcctcgcttctattactgtcatcattgttattaacatcaacatcactactactttccacaatattctgctttttcgagtgtttgttttccagatccttcgtatgcaattgaggatcatggttctg

SEQ ID NO: 552989 - DNA, 808 bp, Homo sapiens
  misc_feature (7)..(8): n is a, c, g, or t
  misc_feature (466)..(466): n is a, c, g, or t
  misc_feature (470)..(470): n is a, c, g, or t
  misc_feature (477)..(477): n is a, c, g, or t
  misc_feature (479)..(479): n is a, c, g, or t
  misc_feature (483)..(483): n is a, c, g, or t
  misc_feature (535)..(535): n is a, c, g, or t
gcggccnnctactactactaaattcgcggccgcgtcgactcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtanaaanaaaaagncngaanataaccttcctttcttacggatcgatacttaccaaaactattcatatttttnccttgtcgggcccgcttaggcccacccgattttttacctagaccaagcttattcatgcggcccgaattggaactcactgggccaattccccttatgaagagcggtaaaccattaattggccgccgttttcaaactccgactgggaaaccctggcgttcccaactaatcgcttggagaaaatccccttttcccaacttgggaatatccggcccaaacgattggctttccaaacagttcgcaacctgaatgcaatgggaattgagcctttttttg

SEQ ID NO: 552990 - DNA, 239 bp, Homo sapiens
gtctcctaatttaaccaccgctacagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552991 - DNA, 2551 bp, Homo sapiens
gagacagagttttgctcttgttatccaggctaaagtgcaatggcacaatctcagctcactgtaatctctgcttcccgggttcaagcgattatcctgcctcagcctccgagtgaggtgggattataggcacgtaccaccacgcccagctgatttttgtattttttagtagaagacagggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttttgacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcagcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattggaagaattaggtgtttggttgtttgttttttgtttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttt

SEQ ID NO: 552992 - DNA, 273 bp, Homo sapiens
gtctcctaatttaaccaccgctacagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 552993 - DNA, 224 bp, Homo sapiens
gcggccgcctactactactactactgctcgaattcaagcttctaacgatgtacggggacatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 552994 - DNA, 368 bp, Homo sapiens
catcctctcctcctcctcctcctcttcttcctcctcctcttcttcatcttcctggaatttggcccattccactcggcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaaacttactacctgctacctgggttaggtctactgggttagtctacctgggtaccgagcca

SEQ ID NO: 552995 - DNA, 1678 bp, Homo sapiens
  misc_feature (1118)..(1118): n is a, c, g, or t
  misc_feature (1122)..(1122): n is a, c, g, or t
  misc_feature (1185)..(1185): n is a, c, g, or t
  misc_feature (1343)..(1343): n is a, c, g, or t
cgctttcttgttgtgtgtgctgctgctgttgttctgtgttgttctctgtcttcttgttgtgttgttctgctcgcttttgtgtgtgtgttgtgttctgcttcgtgtcggtagttgtgtcttctgtctgttggtgttgcttgtgtggtctcggacacgtctacgttgtcaccacacggtggcccctttggctccggcggtcccccatgttggccaaaagcgggtttttttacgcgcccccccgttttttataccggtctctttatgtgttctggcactctggggtgcccaatattgccccccgcaggtgttgaatctgtagggggtgcttcattgagacaccgggaatgcttttccttatagccttctgtgctgctgtgtccctgggcgtttgttgcgcatatatatcccgtggttttgggtgattcctcccaggtccgaaggggttttctaccttaccgccagggggccccccgggtagcacaagttgggggggcgcctgcgcaaatccccgcaacgacgttagtgtctggccagacctgccctcttgtggaggaatattaagggcgccgccaacgttgtgctggagccttatcggttctcccatgggggtaaactcccccgcccgaggggtgccccccccgctgtctggagggggccgtgggaccgccgttgtgtgttgccccagagggatcgctgaattttcccactgggatctttggtgaaatgctgtgagtttcttgtccgcgccccctgttttctggagagggaacttaactctctcggggattccacggccttctctcgggtctttcccagggtctttccgcgtctttcttcggtatcccacgggaatttctcgggggaagttggggccttctccctataccccggagatagtgggggacaccacaggagtttttcccccacccttattgtatagactccgcaaagttggagtggcctctttcccacctcggagcacaccccctcctatagggttcttctctggacccacagcgagatttttcttggcccccctccacggagcacacctcccacgcgagactctgttgggtccacacacacatcgtgagatttatagaatagagagcgagatntttntatatggtgtatatatagagacagagaggagatttttgtccccaccacccttgtagacacacncacgcggcacacatggtataggtgtatgcgcacatatattgtgtatatggtggcacccacatcggtatatatatatgagattataattcttgggacgcacacaagagattgttaatatgagaaatttttgataaccacttctgagaaataagagaagncttataagttttgaatcactcccctcttttttgtctcacatgaaatttcttataaaggagttattgctcttataatgctgtgtaatctatctttattgttctttgaaaataacctgccattttgttggtatccatagttccaacccaccatccatttatgaaattaattagattcccctggcccattaaatggcttttaagaataataataataataattttttaagttagcttgagaacaccaattggccggtaatatttcataccctaaattaagactctgaccttggattgttgaattataatgatatgcccccttttcttattaaaaccca

SEQ ID NO: 552996 - DNA, 269 bp, Homo sapiens
  misc_feature (27)..(27): n is a, c, g, or t
  misc_feature (55)..(55): n is a, c, g, or t
ccatgtaaatctattaattctaatttnatattagagacaggagagcatgctacanacacagtgcacttcctgggctttaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 552997 - DNA, 586 bp, Homo sapiens
cagctctggctgtggacgattgggacaagagcgggttcatgcgacctctatgtggtactatggctataaagactgatcttgggaggttcctaacaacggaagatagtccggtgataaatacattcgaacttagagtgcaggaaggaatgaaatggcctcatgtgtaatgtagtcttgttggttagttcgagggtgttgtacattaataaggcggttggggtactctgattacttgtgagaagactcgtaaggttaaacaatcgacattattacagattgtctgatttttacgaccagacaagaagattgaagctctaagtgcctgaaaacccttttctacagagtagttgtttacacttcccttctgagaaccctatgaaaaccaggaccttatttggctggtccacactgtacccctagtctagtactctgtgtgtgtgtgtgtgtattacatatttaagtgagggaactttcattcacatgattagaatcaaacaaaaaatacctgtttttatctaaaaggggccgtaaaaactagaggatactaattatacttctgttcaatatgactttacgggtacccgtc

SEQ ID NO: 552998 - DNA, 619 bp, Homo sapiens
  misc_feature (564)..(564): n is a, c, g, or t
tcacagggacgcgatccatctgctgatcggaagttgattgctgccgaactcgacatcgaagcgagatatctctgcgacaagttcaccttcaggagcaacgtctttggcaagcatggagatgtcccgaaccaacatcccggagcggaggctgcagcttgatatgaccgccgccagaaactttgccttcgaatggaatgcgcgaggtattgtagaaatacgccccgtctttgccatccgccacgattcttgacacccaaacatccgaggccccatcgccatatagttcatatcgtgtggatctcaatatgccggtatcatccggcgtaatcacttgtgcatccaaggtgctccattcattcgggctcccgtcagcagattccggaagaaatgtccggcagcttgtctatacaaacgacctgaacgcctgaacgagccattgaatccaaccgctttgcagtctgcggctctatgtaatccagacttggaacacctacgtgcctatatacgccaatatccgcatcatcaacgccgcagagattctcttcatcgataagctcaaacatnatcttgttattgagcaaaactctgccaagtcccgtagtgtgagagatgagttgct

SEQ ID NO: 552999 - DNA, 413 bp, Homo sapiens
ggatttgctggtgcagtacaactagggcttaatagggacttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaacaaaaacacaaacacaaaaaaaaaacgcccggggcgcatctctatattgtcccggggcgggggagcaaaagggttattcggaaagtgcgccctgggccatagcttgtttcccctggacccagctttctcttgttcccaaggggggaaattctggcgggtcccccatattagggaggcgatataatttcaataagccgggttacccggttttaagg

SEQ ID NO: 553000 - DNA, 159 bp, Homo sapiens
atgcagaatacaggagtaatctagaagctagtggaaataaagagatgatatagaagcactaaagcaatatgctatggactattcgaataacagctcttagcgaagggactgaatcctcgtgaatgcatactccggatctcgctagagattccgtggaga

SEQ ID NO: 553001 - DNA, 800 bp, Homo sapiens
atttcacccgggaaacgattagacatgattccgaatttatacgacccacttagggaaattggccctgaggcccaaaattcggcaagaggcgcctttcttgccagaggccccgtttgaactcacgggggggccatgatggtggtgggtacgggcaacccgtggcgctctcctccctcctgtccctgctgctctttgctggggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaacaaaaacacaaacacaaaaaaaaaacgcccggggcgcatctctatattgtcccggggcgggggagcaaaagggttattcggaaagtgcgccctgggccatagcttgtttcccctggacccagctttctcttgttcccaaggggggaaattctggcgggtcccccatattagggaggcgatataatttcaataagccgggttacccggttttaagg

SEQ ID NO: 553002 - DNA, 129 bp, Homo sapiens
ggccagtgtgtcctgactcccatcataactgttggaaattccgtatccgaatcccactctttgataaaccccagcttcttctagaactggacacttctgctgaaatttggaatatcttatgtgatgcca

SEQ ID NO: 553003 - DNA, 1030 bp, Homo sapiens
atttcacccgggaaacgattagacatgattccgaatttatacgacccacttagggaaattggccctgaggcccaaaattcggcaagaggcgcctttcttgccagaggccccgtttgaactcacgggggggccatgatggtggtgggtacgggcaacccgtggcgctctcctccctcctgtccctgctgctctttgctggggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctggtatgttcttgacagctgggtaaggggtgtagcattccgttttttggcattggatcttactgtgatggtgccagagtttttccttccacacctacctctctctctgttctccctccccgttttcctaaacttgaacttggattctttccttgatgctagtgtcttccctaggaggcaccaggctggcagatgcccactggtgccatgacctttctgtcttcaccatatagcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaacaaaaacacaaacacaaaaaaaaaacgcccggggcgcatctctatattgtcccggggcgggggagcaaaagggttattcggaaagtgcgccctgggccatagcttgtttcccctggacccagctttctcttgttcccaaggggggaaattctggcgggtcccccatattagggaggcgatataatttcaataagccgggttacccggttttaagg

SEQ ID NO: 553004 - DNA, 607 bp, Homo sapiens
atttcacccgggaaacgattagacatgattccgaatttatacgacccacttagggaaattggccctgaggcccaaaattcggcaagaggcgcctttcttgccagaggccccgtttgaactcacgggggggccatgatggtggtgggtacgggcaacccgtggcgctctcctccctcctgtccctgctgctctttgctggggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttctacaaagaatcaactttattgaacattcagggtcgacgcggccgcgaat

SEQ ID NO: 553005 - DNA, 296 bp, Homo sapiens
tttcgggccacgggtttttgcccattctaatatgttggctacacgggcatttattgcaacatatggggcaaagggagctaggggtttagcataaccccggggggggtcccctatttaagaccggaggggttttgggtgtgaaagggaaaatagtgtggggggaacaaaaacaacaaccccaggggtttagatacagcaacaaggccaggagagagaaaaaccaaactcaatgagagagagagggggaggcaataagttgagtgtttctctggtgtgggggggcaaatcaagggtga

SEQ ID NO: 553006 - DNA, 409 bp, Homo sapiens
aatagaccatgttggacaccattaattattattcatagtaaggaaatggtttgcctttagaataaagtatatcttttccatttttctcaacgtcttctacagttttaggccatacctgttttccatgtttttaaaatctagttaagtctactaaacactaactaacttactctttactttctcaagcactaatggaaatactggattataaccaatctaatactctctgggcatttctactagacactttgctcagtgtgatttaaggcagtttataatcactccttgtggtcttgaggccagttttcaattcatgagactcatatatcctagctagttttaattaattttgcaaggaagatgccaggagaagcaatattaaatgctttcttataatcaggttatttca

SEQ ID NO: 553007 - DNA, 1014 bp, Homo sapiens
  misc_feature (634)..(634): n is a, c, g, or t
  misc_feature (641)..(641): n is a, c, g, or t
  misc_feature (682)..(682): n is a, c, g, or t
  misc_feature (689)..(689): n is a, c, g, or t
atttcacccgggaaacgattagacatgattccgaatttatacgacccacttagggaaattggccctgaggcccaaaattcggcaagaggcgcctttcttgccagaggccccgtttgaactcacgggggggccatgatggtggtgggtacgggcaacccgtggcgctctcctccctcctgtccctgctgctctttgctggggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtccttactgccttcaataatctgggagaatcttgtctttggcaaaggattccaagcaaagatcttccctgagagtctcctgtgcctcctgttggctctctttgcatctggcctcatccaccgagtctgtgtcacnacctgcntcatcttctccatggttggtctgtactacatcaacaagatntcctccnccctgtaccaggcagcagctccagtcctcacaccagccaaggtcacaggcaagagcaagaagagaaactgaccctgaatgttcaataaagttgattctttgtaaaaaaaacaaaaacacaaacacaaaaaaaaaacgcccggggcgcatctctatattgtcccggggcgggggagcaaaagggttattcggaaagtgcgccctgggccatagcttgtttcccctggacccagctttctcttgttcccaaggggggaaattctggcgggtcccccatattagggaggcgatataatttcaataagccgggttacccggttttaagg

SEQ ID NO: 553008 - DNA, 419 bp, Homo sapiens
gcaagattagggctgctgtcacttgcatcatcatcctcaccattctcttcatcctcctcttcattttcatcatcacttccattgtcatcatcacctgaagctctaccaatacttgtaatttcatttttagattcctcatcacttcctgttttactaacactttctaaatcttcctttagagcatctttgtcaaacattttactgtctgttgagttttcataaccatcactgccacttgccgttatggatggaaccactggttgcatttctcttcttgtcttagaacacttgatcttgggagatttcacatcagaggtgcccgagtctaatgtccttcatctttctttgagagaagagttgatagtatgttgaataatgtttttttttctcttttgtacttttttgtgtaattttttgct

SEQ ID NO: 553009 - DNA, 533 bp, Homo sapiens
  misc_feature (207)..(207): n is a, c, g, or t
  misc_feature (252)..(252): n is a, c, g, or t
  misc_feature (257)..(257): n is a, c, g, or t
  misc_feature (294)..(294): n is a, c, g, or t
  misc_feature (331)..(331): n is a, c, g, or t
ctcgggcaggtgcttcagcttgtggatgaagttgatcatgtactcgcacatgggcgagcggtggatacggtacacaaagcgcccgttctccagcctggcatactcagtctccaccttctctaccacctgtttgccagaggagcacaccttggtggagacgctgatggtcatgctatcagcagagctgtactgagagctgacccatanaaggctcccgggccctcctggatggtgctgttgaggtcggcccanaactngacaaggaagaaaggcattatggggcccttctcatanaactccgtcaatcctccctttttctcggggaaatttnggtcatagatctgggcgcacatctactgggccccaggggtggggttctgaagaaacggcgggggtttcggtctgtgtgccgaatgtgcacaacaggtgtttgctggtacgtgttcaggggtctcgctggcaacctcccatgaaagggctggaaatactcccaggaagccgcaaccggggaaggaaggcaatgggtacgggtc

SEQ ID NO: 553010 - DNA, 742 bp, Homo sapiens
  misc_feature (3)..(3): n is a, c, g, or t
  misc_feature (35)..(35): n is a, c, g, or t
  misc_feature (77)..(77): n is a, c, g, or t
  misc_feature (188)..(188): n is a, c, g, or t
  misc_feature (226)..(226): n is a, c, g, or t
  misc_feature (264)..(264): n is a, c, g, or t
  misc_feature (362)..(362): n is a, c, g, or t
  misc_feature (369)..(369): n is a, c, g, or t
  misc_feature (410)..(410): n is a, c, g, or t
  misc_feature (417)..(417): n is a, c, g, or t
aanagatgggtctccctttgttgttcaggctggtntcaaactcctgggctcaaagtgatctgcccacctcagccctnccgaagtgctgggattccaggtgcaagccaccacactcaacctcctacctccatgttctgggtatcattaaggtaatcagaatcctcctgctgtagtcacgcttacccttntaagcaggttccccaggattcagagagccccggatttntcctggactccatgtgcagatgcctagtatttccattntgaccgttgccctccttgttcttcttgcctccctagttctcctgtgcctcctgttggctctctttgcatctggcctcatccaccgagtctgtgtcacnacctgcntcatcttctccatggttggtctgtactacatcaacaagatntcctccnccctgtaccaggcagcagctccagtcctcacaccagccaaggtcacaggcaagagcaagaagagaaactgaccctgaatgttcaataaagttgattctttgtaaaaaaaacaaaaacacaaacacaaaaaaaaaacgcccggggcgcatctctatattgtcccggggcgggggagcaaaagggttattcggaaagtgcgccctgggccatagcttgtttcccctggacccagctttctcttgttcccaaggggggaaattctggcgggtcccccatattagggaggcgatataatttcaataagccgggttacccggttttaagg

SEQ ID NO: 553011 - DNA, 458 bp, Homo sapiens
  misc_feature (146)..(146): n is a, c, g, or t
atctagaggatcccacactgggttcgagttccacgctatagagaggatccttgcaacagtgcaggaaaaagtatgtgaaaggggatgtgtcccttgccgatgcccccaagcctattgccaggcattgcctatggccaggttattgnatgtgctgccaccggtctcagaaaggatccctggctgtaagctggggcttcatgacaatcactgggttcctgcctgccacagttttaatcgggcaatccataagaaagcaaaagggactgaagctgaagaggaatactaaagtccatgtgagaggcaacaaaaggaccggtttctaaagctgcaaaacacctagatacacccgttcaaatgagcgtagccccctgagtcatcactctagaagaatctgtacatcatcaggactgcattgctcaggcattttctaaactctaaatttacgagctgtacaaaaa

SEQ ID NO: 553012 - DNA, 822 bp, Homo sapiens
tggaaacggggtcttactccagccggggtgacagagcgagactccatctcaagaataaaataataaaaacaaaaataacactataaaatataaacactttatgtacacaatctcacatcatctttcacagtctgggaaggcagatatttctggtaatcctcatttaacagctgacgcctatctaaggctggtataaaagtcagtcactggtccaggctcacacagccaatgctggagggctgtgtggcacccagagagcacagtggctggctgggaataacccttcaacttaatagtccggagcaggggggttctaaagctcccttaaggctttcccactagtaagcttccaggttctgggtacagtttctcagcctcggacttactggacgttgggagtcttgatgagtcttggttggagagcgctgtcctgtgcatgcgcggatgtacggagcatactgggctctatccattaggatgccagtagcacccccctccaaatttggcccagtgtgtgacagtcaaaatgtctgcggaccttttgccagatgtcccctgggggacaaaattctggcctaaatgtgagacaccagcgagttcttgggaaaccatttaaaacccctaaagccaaggaatgtacctgtgcaagattggccaagggtcaccaccttcgacaactggtcactggtgggctgggacccggtgtttacacccttgtaatctcagcacttggggaggcccagacgggctatccaccctgagtaggagttcaaacagtctgccatggggtaacccggttataaaacaaacatcaacaagaac

SEQ ID NO: 553013 - DNA, 487 bp, Homo sapiens
  misc_feature (487)..(487): n is a, c, g, or t
cttctggagtcttccaaaccaccttccctcatctttcatcaatcatgtacagttgtttacacacgtgcaattgttgtgcttctaatatttatgctttataaataaaaccagaaccaggactgcaaacccaaaaaaaaaaaaaaaaaacaaaaaaaaaaacaatgttgtggggcggcccgcggcccccaagaaaaagttttaaaacccactcgtgtgggggcgcgcgccggggggcccccaattagaggtaacatcggaacagcgcgcccaagacgctgtctcccaaaggagaaaccgcctggcccacggcacaacgcgggctgggttttccccccaaataaaaaaaaagcgccgcgggggggaacaagccggagcggttggcgcaaaccactcccaaaagagacgtccggggagggaccaacgcggaaccacaacacagggggttcacaagggaggtcgaaatcaaattagcccgcgccgggagcgn

SEQ ID NO: 553014 - DNA, 540 bp, Homo sapiens
  misc_feature (1)..(1): n is a, c, g, or t
  misc_feature (64)..(64): n is a, c, g, or t
  misc_feature (109)..(109): n is a, c, g, or t
  misc_feature (118)..(118): n is a, c, g, or t
  misc_feature (123)..(123): n is a, c, g, or t
  misc_feature (141)..(141): n is a, c, g, or t
  misc_feature (150)..(150): n is a, c, g, or t
  misc_feature (154)..(154): n is a, c, g, or t
  misc_feature (157)..(157): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (197)..(197): n is a, c, g, or t
  misc_feature (203)..(203): n is a, c, g, or t
  misc_feature (208)..(209): n is a, c, g, or t
  misc_feature (221)..(221): n is a, c, g, or t
  misc_feature (238)..(239): n is a, c, g, or t
  misc_feature (247)..(247): n is a, c, g, or t
  misc_feature (252)..(252): n is a, c, g, or t
  misc_feature (254)..(254): n is a, c, g, or t
  misc_feature (287)..(287): n is a, c, g, or t
  misc_feature (289)..(289): n is a, c, g, or t
  misc_feature (296)..(296): n is a, c, g, or t
  misc_feature (302)..(303): n is a, c, g, or t
  misc_feature (305)..(306): n is a, c, g, or t
  misc_feature (309)..(310): n is a, c, g, or t
  misc_feature (312)..(312): n is a, c, g, or t
  misc_feature (333)..(333): n is a, c, g, or t
  misc_feature (338)..(338): n is a, c, g, or t
  misc_feature (433)..(433): n is a, c, g, or t
  misc_feature (441)..(441): n is a, c, g, or t
  misc_feature (446)..(446): n is a, c, g, or t
  misc_feature (461)..(461): n is a, c, g, or t
  misc_feature (539)..(539): n is a, c, g, or t
ngggtgggttttttttatgcaataatttaaatgtaaaaaaaagttttataaatgaatctttttnagttttccgaacttccaaatatgaattcctttctttatgattttntaaaaaagnaaaanacagtagtcccaaaaaanagagtaagngagnggngcccatctaatagngngngggggggggggggggggggggngggggnggggnntttggtggtggnaggtgggaatttattgnnctggctgnacttntntaccaggatgcagagttctccaggtagctggangntggggantggttnntnnttnntnggtgggcattagggtggtggntgagngagcgggaagagccctgggggtcccaaaccgctggagattggggcgagttacacgccattgggtcgctggagctgggactgtgctccgggggcanctccccgnttttnatgatcttcttgatnttggatcttttgttttgaaacaagatttttacctgagttggggaacaaaggcacacgttaccgggacattcagaggtng

SEQ ID NO: 553015 - DNA, 383 bp, Homo sapiens
atcagaggtcatgtgtgtgacacgtcaaaggccagcttctaatggaatcattgttccccgggacagaggccctctgagtacatctggactggaggcccagattccaggtcgcggtgctgcagaccaggccgcgtccgcagtgcccgtgcaggaacagacgccgagactcacgcagtatgacccgtcacgccgatcggataatatccctgatcacttttgccgttggaggcaatatctgcttaggattcactgcacatcgaattaagagagcagaaggatgggaggaaggctcttctacagtgctatcagacttccactggaccaacatttccggatcttgcaaggacaagtgcattgaacttcgaggctggacctactggtgg

SEQ ID NO: 553016 - DNA, 108 bp, Homo sapiens
  misc_feature (36)..(36): n is a, c, g, or t
  misc_feature (61)..(61): n is a, c, g, or t
  misc_feature (93)..(93): n is a, c, g, or t
acaagagagataaggcctacttcacaaagcgccttncccccgtaaatgatatcatctcaanttagtatggaataaagtggacattttaaaaantcgacaaggcccgta

SEQ ID NO: 553017 - DNA, 429 bp, Homo sapiens
ggggaggaaatacatttttggctcataaaaaaaaaaaaaaataaaaaaaaaaaaaaaggggaaaaaaaaaaggaaaaaaaaaaaaaaaaaaaaaaaaaaaaccttgggggacgcttttttcaattcgattatggatttgaaaaggtttaaaattggggccaaattgggaattaattgggaaaatgggccttataagaattcattttccaattaattgcacgtcgtttaaaaggaaaaccatggggaaacccatgttaatccccaagtaaaacatcttgattaaaatacctgttttaaaagcggggggagtagcaaaaaggcccttaccaaacggttttccaaacagatgggcaactggaatgggaaagggaaattgtaagggtaaaatttgggtaatttgggttattggataattaacccaattgtccc

SEQ ID NO: 553018 - DNA, 150 bp, Homo sapiens
atgcttcaacgtctgccttgtccattgataagaccttgttgaccatcgttttaccttcagaatgcgccattgaaccgacattaaggtgtcttaaattgggcacaccgccttcaacagcacggaggcacgtcttgcacagtttcaaacaac

SEQ ID NO: 553019 - DNA, 226 bp, Homo sapiens
aaatgatagacgctagcaagactaataaagaaaaaaagagagaagaatcaaatagacacaataaaaaataataaaggggatatcaccaccgatcccacagaaatacaaactaccatcagagaaatgcaaatcaaaaccactatgagatatcatctcacttataactatttctaagcctacctacataaatattggctcaaaataaagcccaccaacttaagaatgt

SEQ ID NO: 553020 - DNA, 882 bp, Homo sapiens
agcagagaagatttgctgaatatctgcattgaacctgacaccatcagcaaaggagactttataagctataggaagtcgaaaggtgagaaaccccaagctgcacgtggagggcaggagtggtctccaagccagccagtgcacttggcttgatcccggaggaagcaggggctctttaagcatggacagtgaggagtatgaagcgaggcctgtggaggtgaaaggctccccaggaagctgcagtctctgtggatcctcaggaagagagaacagatgctcaaaaagccccaccccagtgagcagcagaagacaagcaagtctgagaccacacttttaggccaccgtgtggacccaacacagggaacaggtgcctcagcaatcccaacagtgtcgtcagaggggtccccaagggcaattttccatggcaagtaccctctcgtgccccccactccaggcagtgcttcccaaaggtgtgctctgtcacctgcttgggcactccgcgactccataagcgcatgtcaacatctcggcgagacggggtgccccctcctaaacaaccgggactcaccctcaggcggctccaacgacggaacacaggacttccctcgtggtctccttcccaggctgacaccaccagtgagagcccaacggggggataagctgccaaggccactacaattcgcctctatgaccgtgcagggactccaggaaggtgcatcctgcccggggaccttacaaaggccaagggccccaacgcggcggcattcgagagcccggcacagaaagcaaatcagtccaccctaaggcaaagatggaggggcccctcagccaggacaaacgaaacagatacaatacacaacgaccacaagggtggcaaccagagat

SEQ ID NO: 553021 - DNA, 582 bp, Homo sapiens
gagacagagttttgctcttgttatccaggctaaagtgcaatggcacaatctcagctcactgtaatctctgcttcccgggttcaagcgattatcctgcctcagcctccgagtgaggtgggattataggcacgtaccaccacgcccagctgatttttgtattttttagtagaagacagggtttttaccccatgttggccccaggagggtctcctatctcttgaccttaggatctgccccgcctaggcctccccaaagtgatgggattacaggtgtgagccacagcaccctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaa

SEQ ID NO: 553022 - DNA, 813 bp, Homo sapiens
gttagcggcagcgggtgctgctgtcactgttgtgctgggggcccggtcgccaggcaaagagccctcccacgttatgaggggagtcctgagccgtttcctgaatgtgttaagaagtgggctggcttatggtgtccatcatacgtgcatggggcagcacgctgcagagtttccgagacgcagcatctttgtctcatatgaaaagcctctacactggtcgcagccaaaccttgatgaagggcctccaagctcgtgaccttcgggatctggacgctgctctcatcagtgattcgctgcctctgtgccattgacattcacaacaagacgctctatcacatcaaagctctggacgcttcctccttgccctggggcatttgccctctctgagattgtttgtctatggaactgcaggtcccacgattggcggtcctggcacccctgatggtggcaagtttctccatccgtgggtatgctggtcgggctccggtatctagaagtagaaccagtatccagacagaagaagagaaacctgaggccagcatgatcacctccaggactttctcgttggccacctggccatcttcattccttcgtcggcgtctccgtcttaaatttcttttctattccatcgatctgacctttattcacgttttagcctcttttgttaatttgtgccaatttacacgataatgcatactgaaaagtatataacatgtacgtacaaatgtaaagaatactttgacacgtgatactacgtaagtccaggccagtcaaagaaatggcccagttctcggaagccaatgtgtgtccttacca

SEQ ID NO: 553023 - DNA, 1525 bp, Homo sapiens
ccggaaatgttatacaacagcgcttgttctggtcggtggagcgttcttacaggtctaaacggtattgaggaacacacggaggtggcacaacgcgcgaccaaattttgtgtggggaaaggaaaaacaatgctcaagggggtgtcccgaaagatggtcagtttgggtgtgacgccccccatatttttcatcacgacgtctgtcactccgggggagactacaaagagttcgtgaggccctcttctcaaaggggatggacactcgctctctgtgattgggagatggatgggagcccctcctgcatggttggggggaaagttttaatagggccgctttccagagacccccagagatggcgcagacattcttgggggggtgtaacaccacgcggggaagggtgtataatgccccccccccgaaaattgtgcgcaggggcgccgtgtgccgcaaagaagatccaatggcgcacaaaaagatcaccggggccccccaaaatagaggcggagagacctggggcctctgggtgtagaaaacccccgagagaggggagagcttaagcgacccaagagtaccggggggtgcttcccacacaaaaagatttgttgagagagaggagaagcccaccccccccccgcagggggggtctaccacacacaacaacaacaccagaatgctttgcgcagaaagagggtttggggaagacactgtccctgtgaagagacagagacaggccgtcctcacaccagagagactttgttgagatacagatttcacaagagtctctcacgagtctcctctctgtggaggagattctggcaccaccctgtgggactactcctcgctacttgtgagaaaaaatattctctgtgaaagagccccacacacacttgtggggagagactacacacgacgctctgtgagagagagagagagtgtgagagagcgcccccgcggttgacaacgcacgttacacaacgagatggtgtaggcgacagacgctctcacacaggggggatcatctctgtggtgcgcgacacctgtgtgagagtctcagagagagagtgggcgcacacaggagacctccgggcgctaagataggaggggcacagacgcgcgcacagagcgcccaagagggagatataagagagagaccactcttctcgtgagacaaatctcacgagaggttcaagatctcggtgagagagctcggagagatatgcgccgccactctatgccgccccgcgcctcgttctgtgtgaagaatagtggcgcgagagaaactctcttagtatcttgtggggatagacctctgggaccacaccagaccaatcccaagccgaacaccatctccataagagacccacccacccgcccgggatagatgtggaaggccaatagatggggttttgtgagagacaccaatggacaacaccaaagattttggaggccaataagcccacccagaaaaccagagggacaccctttgggggaacaaggaggccccattaaaagattccgagagttctca

SEQ ID NO: 553024 - DNA, 190 bp, Homo sapiens
gcggccgcctactactactactactgctcgaattcaagcttctaacgatgtacggggacatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 553025 - DNA, 294 bp, Homo sapiens
actgtgggacccgcgacgctcgcagaccgcactttaggtgcttctctgctcttcctgctggaggaggcggtggaggtgtacttaatggtggaactgccgcctcccacagagctgaggacacccccaatggctctgccactgctcgaacttgaagccacctccaaagccaagaccactgccctaggagtaactactacctccaaccaggcctaaaccactgccgacaccactggaaccgacatagccactggagacggtggactgcaccacagagatattgcctttcggagaaca

SEQ ID NO: 553026 - DNA, 774 bp, Homo sapiens
  misc_feature (7)..(8): n is a, c, g, or t
gcggccnnctactactactaaattcgcggccgcgtcgactcttggctcctgtggatttttttttacaagagcacaaatccacatttatttattgatttttcgttagtttaaatccttgaggggtacagcatcactcggattctgtgtccaatggccttagcaggaagattgcttcggaatttggcacgaaccatgccactgtttccatgggcccgagttacttttccccagatgactctggttttgtttggtttgccgccaggagtgactgtgttgttctttgctttatatacataagcgcatctcttaccgccatctggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 553027 - DNA, 453 bp, Homo sapiens
  misc_feature (303)..(303): n is a, c, g, or t
  misc_feature (384)..(384): n is a, c, g, or t
  misc_feature (391)..(391): n is a, c, g, or t
  misc_feature (420)..(420): n is a, c, g, or t
  misc_feature (432)..(432): n is a, c, g, or t
  misc_feature (450)..(450): n is a, c, g, or t
gattggctcttgttgcccaggctggagtatagtggtgtggtcttggctcactgcaacctctgcctcctgggttcaagcaaatctcatgcctcagcctcctgagtagctgggaccacaggtgtgcacaacacctgggctaatttttgtatttttagttagaagatggggttttgccattatggcaggctgatctcaaactcctggcctcaagtgatccacctgccttggcccccccaaaatgctgggattacaggtgtgaggcacctcgcccagccacaatttgttcttgatcctttgactttntccctatttgttcaagcgattctcctgcctcagccttcccaagtagctggggactacaggtgcgtgccaccattgcccggntaatttnttgtgaatttttagtaagtagtacagggntttcaattgttnaggccagggttggtcttngaa

SEQ ID NO: 553028 - DNA, 763 bp, Homo sapiens
  misc_feature (159)..(159): n is a, c, g, or t
  misc_feature (519)..(519): n is a, c, g, or t
taaaaaaggggcggtttttttttaatttggtaaagtttgccccggggcccccccggggggggggggggggggcccccggttttttttgggccctgaagccccccacggggttcctttttcctccccctttttcttcctgtgaaaggggaaaaatctgcnccccacggggggggttatcccgcttcggatcgtggagactcccgtcgtggggggttctgggggaggctgcttgtgtcaggatgttgagtgggccccagggctctagtatgtgcttccccccctgttgggtcgacgagccccctggtgttttttgacgcgccaacagagagaggggggtgcggccgcggcgtctcacgcagacaaccactctataaacaggtgcggggggtgtgcgttgccccctcttcctcccccctccgcaggccccgaagagaggggtttcccccacagagaacccctctgtgggggcgcccctccccacacaagaaagacgggtggcgccccagtgtgtttgggcgngagtgcaaagcgcgccctcgggacacagaagggaggggtcgtgcgtgggcgcgcacgcgcggagagcgagaacaactacgcgagaagtccgcgggtgtgctgagcgagaaaggaaatatacccccaacgtggttggtgggtcgtggtctgtcacgtcacggcgccccccaaagcggactacgcggtgcgggaaacaacaggcaggacgtccgtgggtgggcggcccacaaccaacaacacaggg

SEQ ID NO: 553029 - DNA, 538 bp, Homo sapiens
cttaggtctcgatcgttactccaaagcagagagaaagcattatagtgaggaatgacacgggctctcctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 553030 - DNA, 230 bp, Homo sapiens
aggagctggatatgtccacaggactcagtccctacccctcgacttggcctgcctggtcagtgtctctcctgagaactgcatacttagatatcacacagtgcccaatacaccaagcagaaaaaggaaagtctagtacctgagctagactccactcgctcgaggctacctagagaacaagaaggagtacaggactacctatatgataccgtacggcatgcctgctatactta

SEQ ID NO: 553031 - DNA, 499 bp, Homo sapiens
  misc_feature (7)..(8): n is a, c, g, or t
gcggccnnctactactactaaattcgcggccgcgtcgactcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 553032 - DNA, 112 bp, Homo sapiens
gctgcccaggtagggtcagaaagaggggtatacacaggaagctgcactgagatgtgttcccccagccccagcaacgtcaagtccttgcctttggctgagtttaaaactttcc

SEQ ID NO: 553033 - DNA, 1264 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatcccctgggtcatttttaacttttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcaaaaaaa

SEQ ID NO: 553034 - DNA, 629 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (602)..(602): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaagacaaaaaaaaaaaaagacaaaaaaaaaaaaaaaaaaaaaacaaaaaaaaaaaaacaaaacaaaaaaaaaaacaaaaaanaaaaaaaaaaaaaaaaaaaaaaagaag

SEQ ID NO: 553035 - DNA, 324 bp, Homo sapiens
  misc_feature (132)..(132): n is a, c, g, or t
gcggcgaggcttgggaggaaacccccccaatgggggtgttttcccccggggcaggagggggggcctgaggctttcaagggtttttttccccttcgagtaatttttaaaaccctgctttgttgtgtcctgttnccgggtttggccctcctgggaatgactgggaagtgggttttccggacgattgtttttgaaacatcgtggccccaggggccagggttttatgggcagtagccttaaaattgtggaaaaggaaccccccaagggagaagggtgagaggagaaaccaaatatgagggttttaaatacctcccccttccgtttgga

SEQ ID NO: 553036 - DNA, 1009 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (553)..(553): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaaaaaaaaaaaaaaaaaaaaaaaaaaaaaaanaaaaaaaaaaaaaaaaaaaaaaacaaaaaaaaaaacaaaaaaaaaaaaaaaaaagagaggggcgcgcgcgcgcaataaaagaatacagcagggagggcgagccaacgaccagacagcaagcagatatagaaaacaagagcggaccaaacaaaaagagggagaaaataaagaaaaagagagagagggcaagaaggaaaaaaaagcagcacagaacacgtacgacacaaaagagaagacacggacgagacaaaacagaggagaaggaaaacaaccaacaagagggaggggagaaaccaatggagaacacaacaccaacaagaaagaaaaaacacagcagggaggaaaaaaacagcacagaaggggtaaaaggagggaaaaaacaaagagagaaataagagaggagagaaagaaaagaaggagagaaggagaagagagaaagaaacaaactacaagagg

SEQ ID NO: 553037 - DNA, 724 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaagaaaaaaaaggggggggggcggcccttttgtttatttgttttagtttttttttgtttatgatatgtttgttttttattgttatgtttttattatactattgtatattagttttttatattattgtatttagttgatgagtgatgtaattagatagagtggagagaggaggagagaatgaagataaaagagaaaatttcttagagagagaacgaggagaaggag

SEQ ID NO: 553038 - DNA, 337 bp, Homo sapiens
  misc_feature (18)..(18): n is a, c, g, or t
  misc_feature (148)..(148): n is a, c, g, or t
  misc_feature (291)..(291): n is a, c, g, or t
ggcacgagtgggcctttnctgtcctgcaagggaaggactccgcccaaccagtgaaagtatctacccagaatagtagatactgaaatccctgagatttgggcatgtgggtaaaatctagtgccagtcttctcctgggtaatggcctgtnctttgttctcctgaaggagcttagtgataaggcaggggattatttctttggcacgcttcacaggccctgactgtctgcttgatagttttgaaaaggcctgactggagaccgcatttcaacatgagatttggaaggaacacatnttcaaaccgtgtcacccaccattaaatttttaatatcataggtgta

SEQ ID NO: 553039 - DNA, 926 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (547)..(547): n is a, c, g, or t
  misc_feature (592)..(592): n is a, c, g, or t
  misc_feature (622)..(622): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaaaaaactccggggggttttttgtgngggggggggaaaagaggggtttaggaaagggggccgtgggccaangggtgtttcttgggcccctttttttgtgtnacagggggggaaaatggggggggcccccccattatgaagggagacgggaaaaataaaatttcgggaaaacaaccagaggtggttcaatcgggtgtttgtatgtactcctgcccgtcgaaaaaaacctcggcaccactccgaagcagacaagcgaacacatgcatacagacaggcacggagtcatcaacaacagtgagtggacaaacaaacaagacgagggaccgacgagagaacgagatcataacgacagatcagaaagcagaaagaagcagcatgatcagacgacacagacataagaacaaga

SEQ ID NO: 553040 - DNA, 373 bp, Homo sapiens
  misc_feature (46)..(46): n is a, c, g, or t
  misc_feature (54)..(54): n is a, c, g, or t
  misc_feature (341)..(341): n is a, c, g, or t
agcccttatgtttccacccctttaacctcaaatgtattcctttgtnagaatttncccctagattccttatttaatgtcctgcagtagacctgaatgtttgtgtgccacccgagaattcctaatgttgaaatctcatttcccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgntcttggacttcccagcctccagaattgtgaga

SEQ ID NO: 553041 - DNA, 260 bp, Homo sapiens
ggccccccccccttttgtttttttctattgagggggtttttcaagaaagcccggggccccccttttttggtgggggtcccccccagagggatttttttaacccccttggttcccccaaaaaaaattttttcccccgggggggggttttttcttttttttcccccccccctttttttaagggggccaaacccgggggccccctggggtgggccttggggaaaccccccagtaaaggcccaaaaaaggttttttttgggcca

SEQ ID NO: 553042 - DNA, 330 bp, Homo sapiens
ccggtaccccttcgacggtgtctgatgctcgatgtgcatccgctgggggcatttcaactatgttgcgcatggtgtcatggtgttacaggtaggcgaggactggatggtgtcccctacccactatgcgatatggattccgcctggtgttcatcattcatcccgaaaccgtggtgcggttgcttatcgatccgcatacctttcggtcggcgcgtcggcgcagatgcccagcattccgactgcgttagcggttagctcgttgcttagggagatcttggacgaactggcccgtcgtgacatcggcgaggccgttaagccagaacaccgtcgaag

SEQ ID NO: 553043 - DNA, 223 bp, Homo sapiens
aaataccttaggtattagattccatggtatgcattaccatgaattttgtccaggacatgagaacgatgccctaaggcttcttcagcactgatctagatagagctagacctggtgcttggagaagagacatctttggaagaatcatctggcgagcaagttcaagcagtgggttatactttggcacctgcatccatagataccataggacacgattctcggcctt

SEQ ID NO: 553044 - DNA, 166 bp, Homo sapiens
ggaaaattgagaccaaaggaaggggggtttccaccccaaatttgggttggaaaacaaaccccccccatttttgggggaaaattttgtttttttgtaaaggggaattggccctggccaaaaaggtcaaatttaattatgaactgcttttaatccccctccaggttta

SEQ ID NO: 553045 - DNA, 194 bp, Homo sapiens
agagccccatgacagtcgtggaatctgtgggttgaggcttccaaacttcctgggaaggacgggacagaattggacgaaagtttcaaggagtttgggcttccaaacttcctgggaaggacgggacagaattggacgaaagtttcaaggagtttgggaaaaaccgcgaagtcatggggctctgtcgggaaggagcg

SEQ ID NO: 553046 - DNA, 937 bp, Homo sapiens
aaggccttcagtatggcattttcatattcactctatgtaaagattgaagcccaaagatgagttaaattcagtgctgtattgaaaccagtcagtgcaaaaaaaaaaaaaaaagttttaccttggtaaattttcatggttaacttcagttggtagtggttaaaacatgcaccaaattctttataatgtcctgtgtggttctcaatgtgatattcttgacatttgcttgtcctttactgctgggttctgggttttaaatttaaaaagtagatgtagctcatcatttttacttccaaaacggtggagctaaaaacggctaattgatcttgagataagaataccctttactaaggcaaagatttaatttgaaactccaaaatgatttatagaaccgaaaggcaatttcccatttgtggtcttctgccgaatttctgattggcttacaccacttgaggatactgactggttccaccggtgctatatcaggtcctctgatttccatgaccctatgtttgttcgggcaacttccccttttgtttcactgtggatcgtttttgtaccgatttactattgccatttcacattctggctgtaacacttgcttacccttgttttccaaagctatcctttgaggacgaaggtcacattgtgttgttagcctacccttccactcaggctctgctgtgtcaccttatcccggtcacgatgtgcatgcctttaacactgcgtgtctataatctgcccttccataccctgcctgtttcaaccttatttagcaagaccagcgtgcgtttgtcagtcaccctactagccccactggtccccataaataaacacccccgcgtccggatccgcttcctaaaaccgcccgcgccccgcactggttcaccactttctgcacacacgcccacgccccccctgcccctcacaccccacacgc

SEQ ID NO: 553047 - DNA, 203 bp, Homo sapiens
cgtgggttccttgcagaaagaggctttagagaattggtcatctgtgttgactgttcatgaataggactaatgcttttattttttctttatttactgatttttgagacggaattttgctcttgttgcccaggctggagtgcaatggcatgatcttggatcaccaggacctcggtctcctcagttcaagcgatgggtaccgagct

SEQ ID NO: 553048 - DNA, 313 bp, Homo sapiens
agcggagcggcgcgcctcctcccttccccgctccgccggcgctgctcctccctccgcccagcacatccccctttggacctccctcctactggtcggggggacggcggcggcggcggcggcggcggcggcggcgggaggggagggcgtgcgccggccgagaggtgtcggcggcgaggcacaaggaagtatcaagtggaaggtcgtccgatcggacggcacgtactcctgctctcctcacgcagcatcatggcggagccgagcggcgtcgcccgatgcacgtccagacatatccccacgcaggcggccccggtga

SEQ ID NO: 553049 - DNA, 393 bp, Homo sapiens
gcacgagaagctatgaaaaaccacccaacccaagcaaagaaaaaaaaaagagcaagcttttcttcagtgtattcgatcttacttttattaacttttactaattcaatgaaggaccaaatgacatctatcaagactgtggtagctagcgaacaaaggataactattttgtcggtgtaaaacaaaccctgcttccgctttgctctctacccgacattttttttttcactttctcagctcttttctttgccacgaaagcgtgtaaagcgatacagatcctaccgtgtctaatgacatcgttagcgcccctctacatggttgccttaagtacagacagaggaatgattaaacctaagacgaggatagtccttatgcattatgaaaagcaattcaggg

SEQ ID NO: 553050 - DNA, 168 bp, Homo sapiens
tcgcggtgacctgggagctggtaccacacggggactgccgaagaggcagacagacggggcgtcttggtctcgtaggtctcacgacacatcgggtgctgatgacgctggacactgagacacggcgaggaaggcagggtgggctcccgcacgggaggagggccccgaaac

SEQ ID NO: 553051 - DNA, 402 bp, Homo sapiens
tccatcggatatgcgggccatgtatattgcatgaccagtgctagggccagtgccaggccatagtgagggcatgggcagaagccatggcatggtcagggcatggtccagggcaggtccagggagcggccagcaccaagcggggccaaggcacaaccagcgcagggtaaggcaggacaatggcaccactgggccatgacagggcaaggtcagcgccaggagagggcagaacaggcagtgcccatggtgggtgccagggcagggatgggccaaagcagtggccaggacatgtccaaggccaggtcagtgccagaacaggagcaggaccatgaccattggcagggccagtgccatgacaggaccagggtcaggacaaggggcagggccagagccagggccagagcc

SEQ ID NO: 553052 - DNA, 163 bp, Homo sapiens
gctggtgcgagtcccgacgttctcctggtcatatatcactctcctacttagcaggacctcacaatactagtcacagcgctagactccctctacatataaagcgcagcaacacactgaggctcactcaccgctccacattaagcctagataatgagcctcattc

SEQ ID NO: 553053 - DNA, 170 bp, Homo sapiens
  misc_feature (162)..(162): n is a, c, g, or t
gccatagtaacctttgcacatctttctgaacgtatgagaaaaataaaatgatacataaagcacctggcaaatagcaagtcctctgcaagtgctccggaaatgtttatcacacgcctactaagaaacacagagtttcactcagtttgttcaaatttcccatanagtatgta

SEQ ID NO: 553054 - DNA, 541 bp, Homo sapiens
atgtaagattgcagaggtttttaccagtattatgaagttatatcatgaggatgtgtgcggtagtagaatttttcgacagcagagacatttgaaagccattacagttgatcttgaagaaacaaaagccatggacggtattgtattgtctggaatgtgtgtgaaatgcagttgttctaaaattctgccacactttgcccagtggatttttactatttctatccgttgcctcatttgaaagaaactttttgaaattaatagaaaagcagtttaactccaaagaaacattgacagatatgactagtaactgttgaacatgataaggattatgttcaggtcattatggatcattgacaaattgcagaacataaggcttaaaaataaactgtgctgttattcatgagtgagataaataggtggggttgtttcaaaaaatacactaatgttaaaagtgtgactccattattttgtttctcctgtgacatggattcttactgacatgattatagataaagctcggtacacattttccctgcaaaaaaaa

SEQ ID NO: 553055 - DNA, 627 bp, Homo sapiens
gtttgacacacccctcaaagacactttttttaggggccccctcctattgggagggcgcgaggtgggagcgccactagacgcccctggaggaggatctacttctaccacccctgaagaaagaggggtgggaatagaagcaacatctcttttggcgaggtgctccaacaacacaaaatgggctcctctcataacacgctcttgtccagatattctttttataagaaagaacaccccctctcttccgccactgtccccccccgagaacctccttctttccccgcggggggttctttctggcggagtctaccctgggactactaaaataagaccgcttggataattctccagaggggtgttttttaaaccctcacactacctcggggcgacagaggaccccgagaattccctcggggagaaatcattttctcccctctatctttctcaaaacaaccatctttttccaccgctgtcctctatgatgatgatgaatgcttcccccggggagaagaaacaccccccccccccccacacaataaaaaccccccccgcgggtccaaaattttggggttgagaaaatttttttttaaacacaaaaaaatttggggggagagaacaaaaaattatata

SEQ ID NO: 553056 - DNA, 130 bp, Homo sapiens
ctcacccgctctggccagagatgacttttggacacatgtgtcgtggaggccgactgtttgcaccaaccaaaacctggcgccagttggcatcagtagcagtgaacacaaccccaataacgatacgccatct

SEQ ID NO: 553057 - DNA, 454 bp, Homo sapiens
  misc_feature (443)..(443): n is a, c, g, or t
tttttatgtttttatttttttttaagacaaggtcttactctgttgcccaggttggagtgcagtgatgaattacagctcactgcagctttgaattgggctcaagtgatcctcccacctcagcttcctgagcacctgggaccacagatgtgtgccacttcgcctggctaattttgaaaaactcttttttgtagagccggagtctccctatattgcacaagctggtcttgaactcctgggctcaggcaattctcccacctcagcctcccaaagtgctgagattatagctgtgagccaccgtgcccagcctggaagctagaggctgttttcaatatgtcattattcttcatttggttagggataaggtttgaagggaggggtaggaaagttttcaaagggcggagagttttcaaagggcatcatgtttaacagggcaggcaacacgntcaagcccctt

SEQ ID NO: 553058 - DNA, 263 bp, Homo sapiens
ctggacctactcacaaacagctggctgggtacggtagctcatgctgtaatcccagcactttgggagactgaggcaggtggatcttttgaggtcaggaatttcgagaccagcctggccaacatggtgaaaccccgtccctactaaaaaaatacaaaaattagctgtgtgtggaggtggcactgtgtagcctctacagtccggagcaggatgcggtgcagcatgggatctggccgtggtttgtagaaggtcgctgagtgggatcc

SEQ ID NO: 553059 - DNA, 128 bp, Homo sapiens
gagatcacaccactgcactccagcctgagtgacagggcaagactccatctaaaaaaaaaaaagaaacgggaaatcaaatccttaagtcaactagttaaattttactgtatgcagccatggcactccgg

SEQ ID NO: 553060 - DNA, 111 bp, Homo sapiens
ctgctttccaaactcctgattttcgtaccacttgaagatcttgttttttcctcacactccgatggatgatttcatgagaggtgagagagacaacacgggatgaagactgta

SEQ ID NO: 553061 - DNA, 198 bp, Homo sapiens
tgagtcggtaccgattacgatcctagacggtttttcatggtttgatagctgatctttagcacggaataatatcccacttctggatgtaccacagtttactcatcctttcatctactgaaagacatcttggttgcttccaagttttggcaattatgaataaagctgctatgaacatccatgtgcaggtttttgtatgga

SEQ ID NO: 553062 - DNA, 229 bp, Homo sapiens
ccgggggtgggggggccttccccccctttccggttggtttggttcccccggcccttttttggtggggccccccccgtggggtgttcttttttttcccgggcccttttctttccggggtgggttccttggggggggttcggggatttgccttttccccccttcccccttgggccccttgtggggttggggtttcccctttttccccttaacctgggttttgccctttcca

SEQ ID NO: 553063 - DNA, 621 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (594)..(594): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaacaaaaaaaaaaaaaaaaaaaacaaaaaaaaaaaaaaaaaaaaaaaaaaaaaaaaaacaaaaaaaaaaaaacaaaacaaaaaaaaaaacaaaaaanaaaaaaaaaaaaaaaaaaaaaaagaag

SEQ ID NO: 553064 - DNA, 136 bp, Homo sapiens
caatgctggacgaggacgaggatgagcgtgtgagacgaggctgtcctgcggcagttcacgggagatggggcttttccggaggaccagagcccaccagggcccttcaagctgaaaccacatggtcggttgcctcaag

SEQ ID NO: 553065 - DNA, 587 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (560)..(560): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaacaaaaaaaaaaaaaaaaaaaacaaaaaaaaaaaaaaaaaaaaaaaaaaaaaaaaaacaaaaaaaaaaaaacaaaacaaaaaaaaaaacaaaaaanaaaaaaaaaaaaaaaaaaaaaaagaag

SEQ ID NO: 553066 - DNA, 593 bp, Homo sapiens
  misc_feature (5)..(5): n is a, c, g, or t
  misc_feature (11)..(11): n is a, c, g, or t
  misc_feature (55)..(55): n is a, c, g, or t
  misc_feature (104)..(104): n is a, c, g, or t
  misc_feature (175)..(175): n is a, c, g, or t
  misc_feature (217)..(217): n is a, c, g, or t
  misc_feature (232)..(232): n is a, c, g, or t
  misc_feature (257)..(257): n is a, c, g, or t
tgctntgaatnccagcccgggtgacagggccaagacttttttctcaaaaaaaaanggaaaaaaaaaatttttacccattttttagcccataattttttattggnctgttcacaattttaatccccagcaacttttggtaggccttgaggaggattgctttgagggcccagggagntttgagaaccaagccagggccaacaggacccaaggacccctnatctcttaaagtttntttcttttttttttaactacatccnaaagttaagctgaagaaaagaagcaataaaaataagtgcaagaaataaggccaatgctgtggcttcccacctgtaatcccagcactttgggaggccaaggtgggcagatcatctgaggtcaggagttcaggaccatcctggccaacacattgaaaccctatctctactagaaatataaaaactagctgggcatggtgggcgccacctgtggtcccggctactccggaggctgaggcaggagaatcacttgaacctaggaggtggaggttgcagtgagccgagatccagtaagcccactctctctagcctggccgacagagccagattctgtctcag

SEQ ID NO: 553067 - DNA, 684 bp, Homo sapiens
tcacacactattccaggttctggctactgaatgatcccacagctagaggtctatacgtcatacgctccacttctatttttagcagcactaacaatacattcccaaaaaaaactgtctctctagcttctcctacactgtagattcaccactaagaaattggcacttggaacagatcatcagagcttattcaaactttgcacccactcttcacccatgcactcacttatgctgcttgcactgtgcactatatagtctctactctacacttcgtcatcacctgctgtacgataggcatgacaaaccgccaaccataacgcaaacataacaggaggctgctaacaccgatacaatcacagagaagacatcttgtccaattgacctaactccctttatataatagggaccaatacttctatacgtacattgtcacccccaacttcttcctaaaccacccctgggaaaacgacacttacactctagatacttccagtcacagtgtgactacattctccttcttccaagggatacttcttgaccgggtaaccacctacggaaattacaacgaaaacgttaatgatagccctctccggcacgcaaaatgggcgcctgtacttccaaccatcccaaataccccccttcgccacgaattacccatatttcaacgagagaacgccatctgccaca

SEQ ID NO: 553068 - DNA, 722 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaacaaaaaaaaaaaaaaaaaaaacaaaaaaaaaaaaaaaaaaaaaaaaaaaaaaaaaaaaaaaaaaaaaaaaaaaaaaaaaaaaagaaagggggagcacacaaacgggagcaggaagaagaaaaaccacaaacaagcaagggaggggaggaagcggggaaaactgagaggcgcgcgacaaagggcgggaaaaaaaaggaaacaaagagaggagagcgcggggcatcgagggagaggggggggagacgagcgagagaggg

SEQ ID NO: 553069 - DNA, 988 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaacaaaaaaaaaaaaaaaaaaaacaaaaaaaaaaaaaaaaaaaaaaaaaaaaaaaaaacaaaaaaaaaaacaaaaaaaaaaaaaaaaaagagaggggcgcgcgcgcgcaataaaagaatacagcagggagggcgagccaacgaccagacagcaagcagatatagaaaacaagagcggaccaaacaaaaagagggagaaaataaagaaaaagagagagagggcaagaaggaaaaaaaagcagcacagaacacgtacgacacaaaagagaagacacggacgagacaaaacagaggagaaggaaaacaaccaacaagagggaggggagaaaccaatggagaacacaacaccaacaagaaagaaaaaacacagcagggaggaaaaaaacagcacagaaggggtaaaaggagggaaaaaacaaagagagaaataagagaggagagaaagaaaagaaggagagaaggagaagagagaaagaaacaaactacaagagg

SEQ ID NO: 553070 - DNA, 999 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaaaactcgagacctagttctctctctctctactcgggatcgccggaaatacgggacccgtatggggcctccctccggaaaagggtcgaacacaatttggaaatcagccagcacgcaaagaacacttgctcttcgggggcaaacccaggatgaagagacgagctgggggatctgaccacagggttcctgatagaagacagggctctggcgggcctgacggtaaaaggtaacctaaggaaacccaaaggggcgcagagtggacacggtgatggaactctaacggcctcacaaccagggaagggggaccgaagcaatcgggggacccacagtggcatgacccactagatggacgccgggaaagacactccacggggagaaccgcgtagaataacctctctggacaaccattgaagagccagaaagtggctataacttggcgttaagcggccgcgcccatccgagaaatttagcggcccggttatccgaacctgaaaactctctctacaaacaagcacacacc

SEQ ID NO: 553071 - DNA, 1106 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaactttactgacccagagaagacacacgaccatcaccatcccatacacaccacacaaacaacatttttgtggacgcactctcggacctcctcgcgagaaagctttttcagagaccttctacgtttgtgaccgccggtgaacccacaaggtattactgtgcacacacgtggcacacaacagcgtgtatccaccagcagcaacacctcgcgagcacaagcaaacacagagtgcggcagaaatatgcgcacgacacagattaaataaaagaccgccgcgggtgataaacccgcagacacagttctgaaacgacacatcccgacaaaaggagatatcaccgaaaggatccacataagacagagggggacacattcataaaaaaaacacgaggggaggtgtatcccaacaaggccgaacaaccgctagtaaatagtattaacgaaaaagatagtcaccacccgggcagcttgagttgtgtgagacacaccaagcgagccatcggaatatagcccgaaatagaacacaccacacagaaagcgacaacgcgagatgccgaccaagacaagaaccgcaccgaccacaacgcacgccacgaacgatgctaagacactcgaaagcagccgaatc

SEQ ID NO: 553072 - DNA, 1010 bp, Homo sapiens
gactgtgtcatgatacatcactctgatttgcttgcatcatttaggcgccctgttaattacctgactatggcctagtacaggtgctaccacgatgttctccggcttcgcgaaaatgcctctgcggtgctatcagtatttacctttgtcttgacggtcttccgccccgacgggtgggtgtgtctcctccgtccacgggctgcgcgcctgttgctacatctcacgaggcgacgccggcttcgagcgtggtgtccgcaacagcccatgttgccgagggcggggtcgccctgtgataaatgacgggcaccgcttcgtcccagatgggttgtcctccgggaccgcctccctgttcttgcagttcggtcccgtgtggattcccacgcgaaccggtcggtgtgtcgcgttagataatccgaacaagagggccgccggccctcgaagtgagtccacagggcggtctgcccacccttagatgggtcgacgccaacgatgcgtgcgaaccgtccgcagcgtgccccgccccgggggtgaccacccctccggcgaggaagtctgaggaagcgcctcagtgggggccccctccgctccgccgccgagagagatagatcgttcagttgccgacacttctggtgccacgtcacggtgcagccaccacgtcggcggcgtcatcaacactcgtcgctttggccacaaaaggtgtggatctcgctccccctcgcccctctgcgggttttctgagcaggaacagcgcgtgcagcccattacgattcatgtgtcccccaaacgcccccctattagtggacaatctcaggtgaccggctccgcgtaaactgggccacacgcttctggcacatacctggcccaccctcggttgtcaccccctactcattgctgcccctttgcccccccgcgctaagacaattcgccgtcgtactctggaacccccagggctcaagacgtggggcacctttgtgccagccaaaaacacaaaaattttttcagccaacaaaaca

SEQ ID NO: 553073 - DNA, 796 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (536)..(536): n is a, c, g, or t
  misc_feature (538)..(538): n is a, c, g, or t
  misc_feature (542)..(542): n is a, c, g, or t
  misc_feature (546)..(546): n is a, c, g, or t
  misc_feature (549)..(549): n is a, c, g, or t
  misc_feature (552)..(552): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaaaaaaaaaaaaatttttggggggccttgggccctggagaaagttttttaacccantngttngggngcnggngccccataaggatcagtgaccacgggccaaaagggggccccaaggaggacccgggctcagcaaaggtgtgggatttcaccaataaaaaggccggggacacccgcgtttgacaatccacgggagtcgaggacatagggccaacacaggggccacggcgtcgaataaatacgccggtggacacagggagcacagcgcgacgcgaacgttacaccaccagatacacacgcacaagcaggaacaacac

SEQ ID NO: 553074 - DNA, 536 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (509)..(509): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaacaaaaaaaaaaaaacaaaacaaaaaaaaaaacaaaaaanaaaaaaaaaaaaaaaaaaaaaaagaag

SEQ ID NO: 553075 - DNA, 230 bp, Homo sapiens
  misc_feature (52)..(52): n is a, c, g, or t
  misc_feature (62)..(62): n is a, c, g, or t
  misc_feature (72)..(72): n is a, c, g, or t
  misc_feature (80)..(80): n is a, c, g, or t
  misc_feature (82)..(83): n is a, c, g, or t
  misc_feature (92)..(92): n is a, c, g, or t
  misc_feature (99)..(99): n is a, c, g, or t
gtcatctctggtctgtagctgtttcctgtaccctgtgggttcctagcttcanactcgtacangacttgcatntcagggcngnntgggaggtntggggcnggagggcctggagttggggtccccaggctgagggtcatggttgtgtgtcttctcctgaggaaagtgtgaggtgctccctaacctatgacttccccgccgaagggaaacagggtcctggtatcctaagggta

SEQ ID NO: 553076 - DNA, 1705 bp, Homo sapiens
ggggagggtgggaggtgggatttagacaggaaaggggtgagagtgattgtgttgtgggcgaggaagcgtttccgatcaccctggatgccgtatcagggacagggatgaccttactcctccattgttctggaagatctcacaggctgatgagcaggatggagacgagagacgtcatgggaagtgaagtcatgagtgcccgattcctcattagagcaaagagtccatgtagcatactggtaggtatctgtcattggggccagcttggagtctgacaggactggacccgttagacgtctctgggcgtagccgttcagaagtcttggatgctctctgaaatttctctaactaatacgagtgttttatataaaacgttgtgccaaagaggtccactttcgagcttgtacaactgtataagcactaagatctcgcagttcaacccacggcgatgtaagggtggcttcaggaatctaccttggactttattcatgctcgtggctctcgtagtcgacacagaggcccacaagagtgaacatgtgcctcttaaagcccgaggaagtcaagaattcacccttacgaatggacgggccaatcccacacttgctattctctacacaggctcgtgcacaagagtaagatagacagcttacgcacgtaatcgcttacgcacagtagagaagcaaaacacaaaatcgaaccaaaatacaaacagtaagaaagtcgcgatatgacacaatacagagcaagcccatgagaacgtctatgtgccaggcacttcagcaaatggcaatctccaaaaaaccccacagtggaactgtgcgctagagatacaatgacaccttgttgcctctggcgcactaacatgcatgaaagtctccacagggggatcaccacttagggtcatgacatacacatcgatgtaaatcacagaaaggcatatacagagagacatgcagcaagacagtgtcacgaacccaccttaaaaggacagttgcagaacagagggcacacgggcacatcctagacgaccacgagaagcacaagaacagcataaggacgagcgctgacaatacaacaaacagaacaacccacagagacacaggaaacacgaggacgaccaaaggaccgccaactgacacgcatcccgcgacccacagacacaagacagaacgagaagcagaacaaacgcgacaaaccacaagccatccaacagacacgccagcggacggcaccaacgatgacgccccacgagcgccacacagagcgacagaagtgcacgcgaacggcggccaaacggaacagcagacatacgacacaggggcccgcccacaaaaaacagcacgaacccaacgcgctcggatacgcaagaccaccaacagcggccgctccaggaaaaaggcgacgacaagacgacccaccatcgaacagagcacagaggacacagccacagcagtcaaccagagtcgcaagacgacaacaaatacagaacgaaccaccatatacagggaagcacacaagacaaagacacacagaacaaacaccacgacgacgaaaccaagagaaaggcaacaccaagcccagacgacgcaagacagaacacacggccgaacaaacacatagaaggaagagaacccacagcgcgcagaagccaaacggcgcgccacacactcaagcacacaatacacacaacgcagacgaacacaacaca

SEQ ID NO: 553077 - DNA, 515 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (472)..(472): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaangtggattaaaaaacttactacctgggttaggtctacctgagga

SEQ ID NO: 553078 - DNA, 452 bp, Homo sapiens
  misc_feature (395)..(395): n is a, c, g, or t
ttggggctccattcagtgtgatatgaagcaccgccaggtcctttgagtttaaagcgggggctcgtagtgtcgggcgagcagtttggtgattaactggtggaggttgagggctaagcataggggggtatctaatcccagttggggtctaagctatggggtgtccagatatgttaaagccactttcgtagtctatggggggtcaaggggagtttttaacaagtcaggtgagttttagcttgatgggggagggggtgatctaaaacactctttaggcgggcttctatggagtggggtaaatcgtgtgaccgggggggttggcacgaaattgaccaagccgggggttagtatagcttagttaaactttcgtttatggctaaaggttaatcacggctgtntcccgggggggtgtggctaggcaaagcgtatggagctgcatggctgcgtgcttgatg

SEQ ID NO: 553079 - DNA, 473 bp, Homo sapiens
cgggtccgggggtaaatagcacttgccgttacataggcatgtgatttcaggtatttcgtacgtgatgaacattgagatgtcagttggaagacaccctgaaatcttatgagtcgcataccccaagcaccctctaatagctagctagtaaagtaacgcaaagaatgcattcatctctccattttagatggctagatgttttgtggaagatcttagaattgcctgcctcatttgctgggaaaaatcagataggaagtggccttaaggggatacttttacttggaaagttacaacactagtacaagtcttaacacatttaacatttgcttgttgaaaagcaatgcgaaagtcaaataaaattaaacatgttttacttttttcctcacaagaacataaaaattatggaggggaacttaacagggaatttaaaaaaagtaacacaatttttccttttagtagtccttgggtcgttatga

SEQ ID NO: 553080 - DNA, 725 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaaaaaaaaaaaaaaaaaaaaaaaaaaaaaaaaaaaaaaagacaaaaaaaaaaaaagacaaaaaaaaaaaaaaaacaagaagagaaagcaaaaacacaaaaaaagaaataaaacacaagaacgagaaaaacacaactaaacacaacacgagggaaaacgggacatcaggcgccacccacatagcgcgcgcgcaagcaggcgcaaaaccgcacgcgcacacgaaaacagagacagcgcggcggcact

SEQ ID NO: 553081 - DNA, 251 bp, Homo sapiens
  misc_feature (74)..(74): n is a, c, g, or t
  misc_feature (111)..(111): n is a, c, g, or t
  misc_feature (189)..(189): n is a, c, g, or t
  misc_feature (235)..(235): n is a, c, g, or t
gcagacgctgcggtcgctctagacggatccccaggacacgactgggaccggggaccgacactatttgctacttngtactaaaacactggaacacttttaaccacgcttagncctctagacgacgttactgacacgtggttaccttgggacatgtaaactagacacctgcaaacttaaaactgacctggnccaccttcacacctgggtaacgggacaacacgctgcaactaaacgncttccgtgacaaacga

SEQ ID NO: 553082 - DNA, 836 bp, Homo sapiens
ggagggtgaggcacgagaatcacttgacttgggaggcagaggttgcagtgagccgagatcctgccactgcactccccagcctgggtgacagagtgagactccaaaaaaaaaaaaagaagggcaagtaaaacggtttatattccagttataatttaccacctccttgtggaacattcagatgtgtaatgtgaatgtgacctcgggtggactctttttagacacggtaagaagaatacggatttataaggtcgaaaaattattcacgtacattattctttaaaattctattaccaagagaagaaaaatatgcttggaatccggtgggtaatgataaagccgggaggagatagatttacagagaagtgatttcaatttcaggtccaggttaaattcaaggttcaaagaacccaggaaaacactttgtgtggccttgttgtaatttccctgtgttttaacattcccgttaggtgtacaaggggtcaaacagaagagactggacaaattgtggaaacccctatttaaggaacatttcttaaaatcggtttcttttcctattaagcatacatttttgctttttaaaattctatttacaccttttatggtttgtgggattccaaagcaatcatataaaatatattagtggtttgctaaaaacaaggtttttccaggagaatttttttgctacctgagaagttttagtactaagtttcgttggaaggacacttgaaaatttgctaaaggggtggggatgatggttgtggacacaataacggtcattttataactaaatagcacttaggtatgaagcccttggtgggtgttgggacaaacaaaga

SEQ ID NO: 553083 - DNA, 307 bp, Homo sapiens
aatgcacaagtcactaacataccacaggtcctaaactaccaaacctgcattcaaaatttcggctggggcgacctcggagctgaacccaacctaccgagcagtacatgctcagactccaccagtccacgcgaactactatactcaatagatccaataacttgaccaacggaccacgttaccctagggataccagcgcaatcctatactagagtccatatcaacaaaagggtatacgaactcaatataggatcagggcatcccgatggtgcagccgctattacaggttcgtttgtccgccgattaccgt

SEQ ID NO: 553084 - DNA, 265 bp, Homo sapiens
taggtaccacattaagccattctcttgtaagcactcaaatgtatttgcaatttttcttttagctgcaacaacaaaaacaagcaaacaaacaacaaataccttgaaactaggcttgtccaatgatgtacatccatcctttcccagggcaagccagcaaggtagcacctcaccacaaagcaaaagcatgcttcatacacaggcaggtcaacatttcaccaatcacagttcaaattccaggctcaaactcttgacaatcccgttttca

SEQ ID NO: 553085 - DNA, 261 bp, Homo sapiens
ggtcgaccatgactgtcatagtcatttggttagcacttatttgtggacagacaatccactggggtgtagaaagattagtgcttctgcttctagttctattaacttttcatgtcactccttttttttgtttttttttttatataaaatggggtctggctcggaaccccgggtgggattacgggggcgctttccaagctcagggcaccccccaccaacggggagggggggacaacccaggtggggccccccaaaagccccccg

SEQ ID NO: 553086 - DNA, 306 bp, Homo sapiens
agaggacaacttctcagatacgggaacacttaggtctcgggatccaggaacacatcgatctgggtatcaaatatgacccaagcattggtatctacggccatggactacatataatggatgcagggtaggccaggataacagcatcagacagacaagaagcgcaggacaggctgcatagaggccaaacacagaatcagccaaggaggaggccaatgcgctggattccagcagaagtatgatgggatcatccttcctggcaaataaattcccgatactatccaaaagagcaataacaagtatacagtg

SEQ ID NO: 553087 - DNA, 182 bp, Homo sapiens
atgttgctagccacatggtggaaccccgtatctacaagaaactagcccatgtggtggcacgtagctgtaatcccagctacttgggaggctagaggcaggagaatggcttgaacccaggaggcggaggttggagcgagccaagacctgcagcattgcactctcagcctggcgtagacaacagc

SEQ ID NO: 553088 - DNA, 157 bp, Homo sapiens
ccaccctgttttatgcatttgcactcgctaagaaacgatgacgattcagcatgctgaagatagtatcctcccttatacaggggctaacacagagggcagatactgttcgtgcttctgagatcttgatcacaagtacattgctttaggcaagttacaa

SEQ ID NO: 553089 - DNA, 570 bp, Homo sapiens
cccggcccatcccacagtggtggactaaggacggaagtgggacccgtccagggccatttctcgagggagcacatcatcgctctaagacttctcccaggacccagagcagtacgtgtgcggctgaatggagtgatagtgaaactcactctgtcaaaaagcaccttttgttcgaactcctggaggacgagcgtcggatgagcggcgtcccaccccacagcttctcggtaagtcgtggctcgacgtctgatcgtactcgctgactggagttaactgcggcgaaagacctggacagcaattgaccaggagattcggtgctgaggactcaggacagctggacaagcaagagcacgggagaaggagtgcacagtggtcgtgagaagacgtttcgctgctgtgaggtcttgaaacggatgacctacgacaaagggtgctcttaaagaaattttggggattccagattcaaggtccggcaacttaggccccaaattagtttagaagctatgagatctctctaaagtattagatattagtgtggattgtgaacacacttcgagaggactctcactgtgt

SEQ ID NO: 553090 - DNA, 701 bp, Homo sapiens
gggtttcactttattgcccagactggagtgcagtggtgtgatctcggctcactgcaacctgtgccttccaggctcaagcgattctcctacctcagcctcccgagtagctgggattacaggcttataggcgtgtgccactaccgcctcactaattctttttttgtatttttagtagagatgggatttcaccatgttggccaggctggtctcgaactcctgacctcaaatgattcccctgcttcagcttcccaaaatgctgggattacagatgtgagccaccgtgcccagccttttttttttttttttttaagatggagtctcactggtgtcacccaggctggagtgcaggggtgccatctcggctcactgcaatctccacctcccaggttcaagcgattctccggcctcagcctcgggagtagctaggattacgggtgcccgccaccatgcctggctaatttggggattttaagtagagacagagtttcactatgtgggccagccgggtctcgaactccgtgacttcaagtgattcacccacctcggtctcccaaagtgctgggattacaggtgtgagccattgtgccaggcctatgtaaggcttgggattagcttaggggattctaaattaatagcacctcatacttggagtggttaatagatatatatgtatgtagtgggtaataagttaattgagatct

SEQ ID NO: 553091 - DNA, 268 bp, Homo sapiens
ggggggggggggcccccccccggggaaaattttggggggggggggcccccccggggacccccccccccggaaaaaaaaaggggggcccttttagggggttcccccctttcggggggggggggggtaaaaacccccaaaggccccccccccgggggggggggtggggggccgggaaaatttcccaattggggggggggggggggggtttttttttttttgggaaacccccccaaaattgggaaaaaaaaaaccccccctttttttttta

SEQ ID NO: 553092 - DNA, 174 bp, Homo sapiens
tgatcagaggatccgagaaatatccaaagatgcttatcatattcgatatatatacaaaagtacttatgagattgagtcaggaataaagaagaaatcatcctgaataaaattttgtgggagagattggttctgtgagagaagtctttaagcattggatgatatatttagatcaat

SEQ ID NO: 553093 - DNA, 166 bp, Homo sapiens
  misc_feature (46)..(46): n is a, c, g, or t
  misc_feature (61)..(61): n is a, c, g, or t
  misc_feature (110)..(110): n is a, c, g, or t
  misc_feature (121)..(121): n is a, c, g, or t
  misc_feature (141)..(141): n is a, c, g, or t
ttgccacagcacacagcttagggccccttttctgtgggtatgaggnagagacaaagtttgnagttgcaaagggctcccccagaccttttcaaggcatgttctaaggtagncgagtccggcnccatacaccagcccagaaanatctgccttgctgcctaagaaccaa

SEQ ID NO: 553094 - DNA, 229 bp, Homo sapiens
ccgttgtctatggctgtgtatacagactctctttgtcctgtttttcctgttacggttcatcacaggatagtgaatgtagctgcgctgtgctgtgccggtaggatcttcctgtacatccattctccctgtaacagcttgatctgctcaccccaaactccaaatccatccgtacccctccccccgataaccgcaagtctgttattgtgtagttctaaatgttggtctgatt

SEQ ID NO: 553095 - DNA, 949 bp, Homo sapiens
tactcatgttgtagtctcagcaatttgggaaggcctgcaggcgggtgtatcatgaaggtcggagtattgacgtaccatccttggtctacatcatgggtcgagaaccccggtggattacttagatagatagaacaaaatttagccggactgtggtttggcatgcgcacgctggtagtccgcagctattctgtagagggctagagcgcgagggagaatggtcttgaggtccccatgggatggcagtatgcttatgcagtagatgcccgaagataggtaccattgcatcttctcatcctgggtctgaatagtagaaaagaactctcatccttcaaataaatactataattgggaaatttgtttgcaagtggaattctaaataaaaaatacttatattgaggaagagggggaccctaatttttttgggaaaaaaccattctttagggtccttagaggtttctatttgaacacttggaaatggattgcactctcaatattttcttaggtttgtgtagaaccagtgtagtacgtagatgtaccttgtttggcatgggtacgagagaaggggagtgcgccaaataaaagtgctcgagggagggtggggcacgtattcgttgagagaattggtaaatagactataggaggagaggggagggtttaccagcgtcttaagtgagttgccgatgatttcattctaaaggaaagttcgaataggcctagggagagggtaattagaaagtggaagcgttaaggaaggttattgggtaggcaatctaatcaccagagaatgcatgcgcggaaatggctggattagtgtacaatgtcgagtccaatttagtctggagagagggtttgtttgaccctgatttgagggacgcagacagtttacaaagtgcatgacaatgttgggagttgggaaaaatttataaaattgggggcgcggccataggaa

SEQ ID NO: 553096 - DNA, 154 bp, Homo sapiens
gaggatttcctggcaggtggaaatcaggaggtggaggttgcagtgagccaagaacatgccattgcactccagactgggcaacgagagtgaaactgcttctcaaaaaaaaagatacaaaaacaaaaacctactagtcctgatttccaccttgcca

SEQ ID NO: 553097 - DNA, 120 bp, Homo sapiens
tgctctcgaggatctccaggcaaagctctacactgttacagtgtagggaaaatagagtgtgtatcagcagagaccaccgaagactgcatcgccaagatcattgaattggagaagctgatg

SEQ ID NO: 553098 - DNA, 402 bp, Homo sapiens
acaatggatctgctttccttccagtcttcccaggtgccttggcgaaactcaaaccataaataaaaggaacagagacaccaggcatggtggcttctgctgcaataccaacaccttgtgaggccgaggaggaaggattgcttaaggctaggaattcgagaccagcctggcaacatagtgagaccctgtctctacacaaaatgtaaaaattaccctggtgctgtggcacggacctatagtcccagctattcgggatgatgaggcaggaggattgattgagcccgggagatcaaggctacagtgagccgtgttcatgccactgcaactgcagcctaggcgacagagcaagaccctgtcccatgggggaaaacaaaaaggatagaacatctgcaagtcccaaacagt

SEQ ID NO: 553099 - DNA, 587 bp, Homo sapiens
gctgcgcaagtgggtcgacaggacgctacttcccctatcatagaagagcttatcacctttcatgatcacgccctgataatcattttccttatctgcttcctagtcctgtatgcccttttcctaacactcacaacctatcctgcccgccatcatcctagaccttatagcccttccatccctacgcatcctttacataacagacgaggtcaacaatccctcccttaccatcaaatgaattggccaccaatggtactgaacctacgagtacaccgactacggcggactaattcttcaactcctacatacttgcccgatttttcctagaaccaggcgacctgctacttcttgacgtttacaatccagtagtactcccgatagaaggccccattcttataagtattacatcacaagtcgcccagcactaatgagctgaaccaatatttggcttaacaacagattcatttaccgggccttttaactaatcccctttaactcgtacatcaccgattgttatactttgggcaaagctctctatttcttttctgctctctctcttttatctcaccctcccctagataatatataaa

SEQ ID NO: 553100 - DNA, 173 bp, Homo sapiens
ctttgttcgatttttcagtgcttttctctggagctttgtcgacaaatttttcaactacttttacttcaggctctttctttgatgctgcagtagcttttgctactttatcgctggcggctgatttctcttctgcttgttcagcagtttcttcttgtgccttttctctctggtat

SEQ ID NO: 553101 - DNA, 543 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaaacttactacctgctacctgggttaggtctactgggttagtctacctgggtaccgagcca

SEQ ID NO: 553102 - DNA, 147 bp, Homo sapiens
ctactggcagagctggggcgagatgcagaacatcacctaccacgcgggacgcggtgtggagctgcggggcatggcaaaagttcaccaactacagcgtccagagtgctggccatacacccaagactgggtaacggcgctacgcagaca

SEQ ID NO: 553103 - DNA, 783 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (517)..(517): n is a, c, g, or t
  misc_feature (530)..(530): n is a, c, g, or t
  misc_feature (563)..(563): n is a, c, g, or t
  misc_feature (584)..(584): n is a, c, g, or t
  misc_feature (602)..(602): n is a, c, g, or t
  misc_feature (621)..(621): n is a, c, g, or t
  misc_feature (657)..(657): n is a, c, g, or t
  misc_feature (690)..(690): n is a, c, g, or t
  misc_feature (695)..(695): n is a, c, g, or t
  misc_feature (721)..(721): n is a, c, g, or t
  misc_feature (725)..(725): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaatgctcaaaatggcagcgctggaggaaaaattcacnttgtcttcggtantcctgagcgccgggcctgaaggactcctaggcntggagcaaagcgacaaaacanaccattttctattgacanacagcggcaggacagtcancctctataaggtttctgatcaaaaacccttgggganctggtcagtgaaacaaggtcaaattataacatntccanctgtgtgcaactttcaaactggggantatntttttgtacccaataataaggttttaaaaatatggaataatgaaaatgttaacctgga

SEQ ID NO: 553104 - DNA, 322 bp, Homo sapiens
gctgactccgcacttttccactgtatgatcttgggcaagtcacttcacctctctgtgccttggtttcctcatttataaaatgtggataacaggccgggcgcagtggctcgcgcctgtggtcccagccctttgggaggccgaggcaggtggatcacaagatcaggggattgagaccatcctggctaacatggtgaaaccccatctctgctgaaaatacaaaaagttagccgggtgtggtggtgggcacctgcgtcccgtattgggaggtggaagatggtatggagaagggagtgaccggataggatgatcagctggaaaagga

SEQ ID NO: 553105 - DNA, 169 bp, Homo sapiens
aaaatggattaaaaactttttttccctttgtttggcccttccccccatttttttttaacctgttaaactttaaagccatagcttttgttttatattggggcatataatgggttaacttagttccccaataaatcaatcctgtttttccccttttcgatgttggttatta

SEQ ID NO: 553106 - DNA, 691 bp, Homo sapiens
ggctagaggttcccccagaatcacactcaaagcgcaggctggtctccttacagcatgctctgttgtgacagggttcagagaggcaggcgtgcatcagcgtgcaaaaaccaggaaggcagatcagagagggatgcctgacagcggtacctccccacacccacctccaaccgaatcccacaccacagccactagtgcaagcatatttcaaaaaccaaaagcaagcgtgtgatagaaccctgctgtgtctaggaaagaaaggaagtcatctttctcgctgagctgtctctaaccacattccaagacatctcagagctggggtcatttcatctcccgctgcctcctatacgaatcagcatcacccaaaaaactttagagacttgaaagttacaaaggcttatagaatggttgggataaggcctatcttgggaagctattttcacttttttttccttaaacaagtccttaagtatatataataaaagctgagtacagaaaacattagacaaagggctctcattcatctaggaccacttaccaatttcacagttgggtcctgcatacccctcagggcaggaccactgatattggtcagggcctgtgtagctacacgttccccgttgagacaggctgatgcgtcccacagtattgagactgccaagatctggagtcacagagagctgtgaaatgcgac

SEQ ID NO: 553107 - DNA, 494 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (433)..(433): n is a, c, g, or t
  misc_feature (441)..(441): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaancaataaanatgtggatgcggcagaaaacacctgtaaaacgacggggggtggaaatttgagg

SEQ ID NO: 553108 - DNA, 216 bp, Homo sapiens
ctgctggggcttggcactgaacatgtctcttcctaactccatgttcagtaacttttttgaaagggtagctggaagtcagctaccgtggaagtatttacaccacagaaattggcaacaacggcaattcaggactcctcagccctagattgcgaggccaggccccagccccactgagaagtctgtacagcccggggccctcctgccaagccccagctg

SEQ ID NO: 553109 - DNA, 1125 bp, Homo sapiens
aggcacagacaccaaggacagagactgctgtgcttaggccgacctccgccacggtgttaccaacatgaagcgtgctcgcagtcaaactgtgctactcctcaccatctgcagtcttgaaggagctttggttcggaacacaggcaaaggagccattgtgtgtgagagcctggttttctcagtacttccagacctgtgactcgatctatggcaaggcacctgatggacgacaggtcatagagtcccagatgcttcaggccgaggtccaagtcttactttgaaaagtcgaaaggagcagttgatacccctgatcaagaaggctggaacggaactggttcaacttcttagaggctatttctgttggaacttggaacacatgactgccatccagtgaagtagtccgagacgcattgtcttccaacgcgccagctggccgtctagaaaaccatactggccagtcctagagctccgtgtccctatccaagttctttgctaacaataagatggcatgaatgaagtacgaataaaaagcacaaagaaagccatgaaaagcttgtgttattggcccattgtgaggacccttgcgaatagaagctatgggacacaacctgtgatctttggatgccccgtgggcccccatggagcttaaggtggaccctgtcggtcctaatagtgaggtatcccctgaggagaaactccagtgtggccttagcactgaagtgcacggggaaatgtctctacccccagtataagaaatgcggcgcacgcgggcggtgaaccaagaaagcgttgatatcagggacagaatttgcgaacagtggaggccctggggagggcgccctacggtggtcttcttcgtcaaagggggaggcagctcacgacgagagagccgggcgagataaatcaggaagtttccgcccgggcagcgggggaggactgcatggaagcggacacccctgtgcggagcgtgaataaggggcaacaggaccaaaaggcggcgacccccgacaggagcaagagggcagagaggcggtcagaggtagccaaacaaaggcagtgggaccaaaatgagaagacaggggtgccggcatcgcagacaagcaaacagggacagagaagaagaacaaa

SEQ ID NO: 553110 - DNA, 501 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
  misc_feature (436)..(436): n is a, c, g, or t
  misc_feature (442)..(442): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactagttaaaccccantaggancaagaggcttcgcccgaaactcctccctctttttgtcaaagcgtgaataaaatagagca

SEQ ID NO: 553111 - DNA, 265 bp, Homo sapiens
agaggggcgggtgcccgccccagaaaacaagccagggaagaggtggagatcctggcacggcccagacgccgtggctcagccttgagtgcggccacagacacatcgtaacaggagcacccaacgtcatttttccatcaagaagaagaaggcgatatcaccgtattggggaagggagtgtttgagtggggagatgttgagctgtgacgtaagcctgttatttggaaacacggaggtaaatacaaaaaccaaacacgcccagcaaaac

SEQ ID NO: 553112 - DNA, 764 bp, Homo sapiens
cttaggtctcgatcgttactccaaagcagagagaaagcattatagtgaggaatgacacgggctctcctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaagaaaaaaaaggggggggggcggcccttttgtttatttgttttagtttttttttgtttatgatatgtttgttttttattgttatgtttttattatactattgtatattagttttttatattattgtatttagttgatgagtgatgtaattagatagagtggagagaggaggagagaatgaagataaaagagaaaatttcttagagagagaacgaggagaaggag

SEQ ID NO: 553113 - DNA, 328 bp, Homo sapiens
agcctcataagttacacgtcattccctactaaggccagacctcctggtatctgcccgggctccctcatcccacctccatccggagttgcccccgatgcatgtccagaataagcaggaatgctcggtggtgagaagagttaagtccggctcagactgaataagaagagattaaatttgccttaaaaattaactggcagtggctttgctgaccggtctgaaaacaactgttcccatcctcttgaccgcaatttccttgtgacacagagaagggcaaaagtctgcacccagcattgacggagggagtatttcaggattcacttcaggggct

SEQ ID NO: 553114 - DNA, 1305 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattggaagaattaggtgtttggttgtttgttttttgtttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttt

SEQ ID NO: 553115 - DNA, 880 bp, Homo sapiens
ggttagccaagatggcggtagcgatcgctgcagcgagggtctggcggtaaaccgtggtttgagccaggctgccctcctgctgctgcggcaggcctggggctcggggactgatagatcttcacccccccaaggcaagcagcaagccagttttcatctctgggatgacaagccccagttcccaggggcctcggcggagttaaatacgataccgtgggcaattcatccagccccaacgtcatctctggaatccccatctaccgcgtcatgaaccgggaatggccaggatcatccaaccccaagcgaggaaccccaacttgcgaaggcagaaggtgctgaagctcctacaatgagcttgacattgtttaaccaaccatggaccgcatcctctatgagtctcagccggcaggcccggaatctccttcatagatgaccaactatggtgaggagggcaccgcacgtgggagatttgccgccgccttgacacaccacggcactggtgtttcgacaagtaccgggcagccaaggttgtgctgatgtatccggggacttaccccccgtggcacttatttcaagtggcccagtgctatgggacaccttcatgtgtctttggcgcaagggggcgccagattgcctgtcccctacggttgcgagggaaaccgccactttcgtcactattcctctccattgccacgcagtctcctcagggggggggcggattacgcagacaagcggtgcactgccagcggtcacgtcatggtacctcggacagggggcgccattaggggacccccatgccggttacatttcgtgccacttgttggccattctttttttggcggaaaggatacggttccggcactttacggtttcggatcgcttc

SEQ ID NO: 553116 - DNA, 450 bp, Homo sapiens
  misc_feature (11)..(11): n is a, c, g, or t
  misc_feature (13)..(13): n is a, c, g, or t
  misc_feature (15)..(15): n is a, c, g, or t
  misc_feature (17)..(18): n is a, c, g, or t
aattcgcggcngngncnncggtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgattctaagcccgcaagattgggggtcctctagagtgacctcagcacaaggtgcc

SEQ ID NO: 553117 - DNA, 913 bp, Homo sapiens
  misc_feature (7)..(8): n is a, c, g, or t
gcggccnnctactactactaaattcgcggccgcgtcgactcttggctcctgtggatttttttttacaagagcacaaatccacatttatttattgatttttcgttagtttaaatccttgaggggtacagcatcactcggattctgtgtccaatggccttagcaggaagattgcttcggaatttggcacgaaccatgccactgtttccatgggcccgagttacttttccccagatgactctggttttgtttggtttgccgccaggagtgactgtgttgttctttgctttatatacataagcgcatctcttaccgccatctggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaactgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 553118 - DNA, 1258 bp, Homo sapiens
  misc_feature (7)..(8): n is a, c, g, or t
gcggccnnctactactactaaattcgcggccgcgtcgactcttggctcctgtggatttttttttacaagagcacaaatccacatttatttattgatttttcgttagtttaaatccttgaggggtacagcatcactcggattctgtgtccaatggccttagcaggaagattgcttcggaatttggcacgaaccatgccactgtttccatgggcccgagttacttttccccagatgactctggttttgtttggtttgccgccaggagtgactgtgttgttctttgctttatatacataagcgcatctcttaccgccatctggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaactgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcagcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 553119 - DNA, 214 bp, Homo sapiens
gtatcgatgggcagtggggcgcatatgcatcctaggctatatatcggagtatacgtagcggtaagtaacaaccggacctctagaactatagctagcatgcgcaaattaaagcgctgatatcgatcgcgcgcagatctgtcatgatgatcattgcaattggatccatatatagggccggggttataattacctcaggtcgacgtcccttggccat

SEQ ID NO: 553120 - DNA, 1292 bp, Homo sapiens
  misc_feature (7)..(8): n is a, c, g, or t
gcggccnnctactactactaaattcgcggccgcgtcgactcttggctcctgtggatttttttttacaagagcacaaatccacatttatttattgatttttcgttagtttaaatccttgaggggtacagcatcactcggattctgtgtccaatggccttagcaggaagattgcttcggaatttggcacgaaccatgccactgtttccatgggcccgagttacttttccccagatgactctggttttgtttggtttgccgccaggagtgactgtgttgttctttgctttatatacataagcgcatctcttaccgccatctggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaactgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcagcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 553121 - DNA, 810 bp, Homo sapiens
  misc_feature (449)..(449): n is a, c, g, or t
agcggacggcattgcactgagccatccggacgaggattctctcagtctagctccagactctcgcctgcgccccactccccgcgtccgcgtcctagccgatccatggccgggccgccgtgcggcgctccgctgcgtccgtgctggccagtccgtggccgtggtcccttgtgcctgtgatgccgcctgtgggacggctctcagtcccctggtcgagccgctctgcggccgtgtgtgggatggccccctagtgtgacgctcgagtcgctgggacgtgaggcgacgggatgtagcgagtcggttgcaatctggagcatttgcacgtcgagcagaaagtagcaagcgaaagaccacgtcaaacgagctgtgtaaccagaagtccgcggcgctgcaaggtggtgacgcgcccgtaagcaagatcgtagactggggggtggatactgactttgctntgggagcgtgtggatgacttgggggcgcgatagacgagcgattggttacccaaaagaagcccaagtccccaaatctttggggagctagaaactggacaccgctttaacccatggaatcccaggcccaactatcttgcagaaacggcgagattgcgagttctggccttctttgccccagggaatcagtactgcctttgtggcccttttgggcaaagagggcaacaaagtagacccctgtggtccagagaatattccgaaaccttagtgtcacagggagctgccctaagggggcgtcctggttactcatgaaggcctgcgcccttgttgcccttattcaaggcttctataattcaccaaccag

SEQ ID NO: 553122 - DNA, 207 bp, Homo sapiens
tcctgtatagggcacagaaatgacaaaagcaaaatatattagttacatatatattagaagataaatctgttaagaaataaggtaacggctgggcgcggtggctcacgcctgtaatcctagcactttgggaggccgaggcaggtggattgcctgagctcaggagttcaagaccagcctgggcaacatagaccttatctctatagaatt

SEQ ID NO: 553123 - DNA, 625 bp, Homo sapiens
gtttacacaacaccaccccatcatactctttcacccacagcaccaatcctacctccatcgctaaccccacgccagcccggaccgccggcgggtggtgtccgcgcccacgggcccctggacccagcctcagccgccgatggctcccgcggcctggagcccgccccgacgggcagcctgaggaggccactgggcccccacgcccctccggccgcaccctgcgccgaacccacacgttcaacagcggcgaggccggcctggggaccgacaacgaggatgcacgcccgggcgggcacagacttggaccaactcctcccctatgggggggcggacaggactgcgcccccacgtgccctaggccagggggcccacccgatgcccttggcagtgccagcccaccgggaaccaggagcgagagacggtgccagaacgccaggggcccgagggcaacctccgagtgggtgcatcaagtcaccccactcgagatcaacccgcggagttggaggggggacaccacatacacgacacaaaggaaagcacacacaacagaatcgacatacacaccatatccatggagccgcaagacagctgacaacgggttaggggagtggagtgggcgggagcgact

SEQ ID NO: 553124 - DNA, 309 bp, Homo sapiens
  misc_feature (240)..(240): n is a, c, g, or t
cccccccccccccccccgggttttttttaaaaaaaaaaacccccgggggggggggggccccccccccccctttttttttttaaaagggcggggcccctaaaaaaaaaaaaaaaaaggggggttttggggaaaaacccacgaaaaaaaatgttttaaaccctttttcccccccaccacaggggggattcccccctttggggcctttctccccttaaaaagaaaaattttaaaaatgttccnttttttaagttcccctggaaagcttaaaattttgcctttgaaaaataaaatgaagccctacttgtgggc

SEQ ID NO: 553125 - DNA, 168 bp, Homo sapiens
ctcgcggactcagtgtcatgttacgaagagatataactaagcactgacacttgttgatacagtgaaaaaacactgcaattcccttttaccatttgagctaattacgtttatctacctggatcaaatatgatcagctgaatttcatgggaacaaacatcccagacccag

SEQ ID NO: 553126 - DNA, 426 bp, Homo sapiens
  misc_feature (41)..(41): n is a, c, g, or t
tcccaaaccgtcataaggtaaaaaatgtttgtggttcaaancattgccctttggagcaaaaactgaccccggatcggaaatttactttgcccacccaaatggcctatgttcaccgagcattttaagttcctctgagctggccgggtgtggtggctcacaactgtgatccccaacattttgggaggctgaggtgggaacattgcttgagccccaggggttctagaccagactgagtagcatggtgagaccctgtctctgctgggaatgtaaatattagccaggcatggtggcacatacctgtagtcccagctattgggaggctgttgggaggacagtttgagagcctgggaggtcagggctgcattgagccgtgattacaccactgcactccatcctgggtgacaaagtgagaccctgttttataaa

SEQ ID NO: 553127 - DNA, 669 bp, Homo sapiens
gcccaacttgggaaacccaagttgcgcagctccgttgcgcattgactgtccacggctcgcccggctcgtccgtactcgccctccgccagtccagatagatagcagcgcagagcagctagcttgccgtgttctccctgtatgttcggatacattagtatgaccatttaggtgttgctgtctccactactccattgttctatgagaaaatcatagggcggagtcgaggcgcatgatatccagtggcaggctttgacagaaattgggatcacctttaaagtaacgcttgatcttggatgcctcagctgtgagaccttacaaagccggattccggtatagttgcctctatctcgtcttgttcgctgacttaaagggtgcccctggtctccagattttctctccactctcctgggactgttgcctgaaatcacgtatcctggttcgggttcaaggccccagatgttccccctatgtgccactgtgaagtttctaggggcttggcacagctggcctgcatcgcatatctcatcacctttcctctgaatacttgctaaagtccggttacagtatcctaaggcagaaatgtcaggggccagtgcgcgctacagccagcgcccagtaccgcggtgtgatgggcaccattctgaccatggtgcgtactgagggcccccg

SEQ ID NO: 553128 - DNA, 299 bp, Homo sapiens
  misc_feature (94)..(94): n is a, c, g, or t
acgtgactcggactaccccgatgcatacaccacatgaaacatcctatcatctgtaggctcgttcgttacatggtccatcatagaattctcactngtgatatataaactcgagacccaacacattaatacagttcttcaatatatctactcagtcttcctcaattaccactactatatcttatgttaccgtctaacaatcctattccacactgttcatcgcgctcgagagggcgtagagaattatatcctctcttgctcatacagttgatagatacgcccgagcgcagttccactatagg

SEQ ID NO: 553129 - DNA, 194 bp, Homo sapiens
ctccttccaccagccctgctagagctacctgtggagcaacctgctcatgatacatcaaacatgtgagacagcactccaaagtagaattataaagaagatcatgtccctgttaacattattataaccctacattttgtgcattaagtgtaagtgtataagcctatcaatattaaaaagcgagcgagcagattttg

SEQ ID NO: 553130 - DNA, 376 bp, Homo sapiens
taaaaaaaaaaaaaaaaaaacccggttggggccggggccccttttacgggtccctggggattttgggcccttttttttgggctttaaattttttcccccccttgggggaccaaaggacccttttccccccgaagggggtttaactggggggggccaagggggggggaaccccccaaaccccggtttttttttttggccggcccccctgggaacccctttaaacccccctagggtttgggttttgggcccccaccccttttttcccccccaaaaggggccccgggttttttccaaaagggtttgcccggttgcccccccctttttttttgggttttttttaacccctgggcccaaaaaaagggccccccttttttta

SEQ ID NO: 553131 - DNA, 163 bp, Homo sapiens
cgttaccgggtgagagtacggaatagtgagtcatgagtgctgatggttgggtctgagatgaaaccatagggaaatgaagctgtcctcttgccctgagtcagttcctgagtggaggccacaagatcagataagccagtttatcaatctgtgtggtgccggctga

SEQ ID NO: 553132 - DNA, 940 bp, Homo sapiens
  misc_feature (263)..(263): n is a, c, g, or t
  misc_feature (397)..(397): n is a, c, g, or t
  misc_feature (413)..(414): n is a, c, g, or t
  misc_feature (419)..(421): n is a, c, g, or t
  misc_feature (428)..(429): n is a, c, g, or t
  misc_feature (445)..(445): n is a, c, g, or t
  misc_feature (480)..(480): n is a, c, g, or t
  misc_feature (483)..(483): n is a, c, g, or t
  misc_feature (486)..(486): n is a, c, g, or t
agcgtcggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgaagataattgccaatgatcagggtaaaccgaaccacatccaagctatgtcgcctttacggacactgaacggttgatcggtgatgccgcaaagaatcnagttgcaatgaaccccaccaacacagtttttgatgccaaacgtctgattggacgcagatttgatgatgctgttgtccagtctgatatgaaacattggccctttatggtggtgaatgatgctggcaggcccaagntccaagtagaatacanngggannnagaccannagcttctatccagagnaggtgtcttctatggttctgactaagatgaatganatngcngaagcctaccttgggaacgactgtctaccaatgctgtggtcacagtgccagcttactttaatgactctcagcgtcaggctaccaagagatgctggaactattgctggtctccatgtacttagcacattattagtgagccaactgctgctgctattgcttacggcttagacggaaaaggtttggagcagaaagaaacgtgctcatctttgacctggggaggtgggcactttttgatgttgtcaatcctcactattgagggatggaaatcctttgagggtccaaggtcttacagcttgtgaaacaccccaacttggggtgagaagaaagaatttgaacaaccgaaatgtccaacaatttattgctgaatttaagccccaagcataagaaggaacctcagtggaaaccaagaactgtaaaacgcctccctatgctgtgaacgtggaacgtacctctc

SEQ ID NO: 553133 - DNA, 122 bp, Homo sapiens
cttctagctggatactccgaacgccaacctcaggcagccctggctgtggtcctgagtgaaatgacatggtgcctggcccccgtctctgccctagtgtttacttactacagcattctcagtgg

SEQ ID NO: 553134 - DNA, 195 bp, Homo sapiens
  misc_feature (142)..(143): n is a, c, g, or t
agcgtcggtctcattgaactcgcctgcagctcttgggttttttgtggcttccttcgttattggagccaggcctacaccccagcaaccatgtccaagggacctgcagttggtattgatcttggcaccacctactcttgtgttnngatcagggaaccgaaccactccaagctatgtcgccttaagaccgggttaatc

SEQ ID NO: 553135 - DNA, 856 bp, Homo sapiens
gaggaggcttggataccggagcgcgagcagtatgctgggtgggcaccatggctggtatcaccaccatcgaggcgtgtgaagctgcaagatccagtgttctgcaggcaggaggtagatgatgcagaggagctgagctgagcgctctccagcgagaagtcgtagggagaaaggcgggccgggaacacgctgagtgctgacggtggctcgttgaaccgtaggatccacgctggttgagagaagagctggcaccgtgctcaggagctcctggtcattgcccctgtgtaaagcgtggaatgaacgctgaataaagctgctgatgagagtgagagaggtatgaaggttattgatatccgggcctttgtcgatgagcgaacagatggtacctccaggaaatccaactcgaaagatgctaagcacattgcaggaagaggcagatcggaaatgtatgaatgaggtggtctggtaagtatggtgatcatttgagggatgaccttggaacagctgagagtgaacgatgctgagtctggcagtagtcacgtttgctagagattggatgagcagattagactgatggaccatgaaactgaagtgttgagtgctgctgaagagaagtatctcatccgacggataggtattagggaagaactccagattcttagtgatgaactccaggaggctgagacccgtgctgagttaggctgaaagatccggaggcagctggacagacacttgtgacctggacgattactgaatgcgccaaggggccctctgcccaggtctgggcaacctgtgctataagttaggccccccctctggggccccttacgaccggtgggcctgggcctcggggcacgcc

SEQ ID NO: 553136 - DNA, 385 bp, Homo sapiens
gacagtcagtactggttgataaaaagggctctgaaacgaagcttttaagtagatttacggaatcgctctcacatctgctcatctgcaaatcattgtattctcttgtatatggtcttgcattgcctcagacatcaatgagcatattctgatgtactctctggatctgaactcatcttcacaggtaggactcactgtggcgtcactatcttattcgatagcgctgattgcttcgcactgaccttgctcaggttcgcatgtagttaatcgtggcagtctactgttcagatggagctcagtattcagtgcgagacgaaaggcaggcatatagctaccaatatgcatgttacattgaatgtatacctagtgagttcagtagggcgtgcct

SEQ ID NO: 553137 - DNA, 197 bp, Homo sapiens
tacaactcttcatcatgctgcacagatatacattgtgtggactctgatgggaagcacagcacctcgatctgcatatactgcacagtaacttgagttttagaatcaggcgtaaccaggcaaagtgccattacggcgtagttactgccagattatggcagtttagcattgtgtgccaagacaatggttaaaggcataca

SEQ ID NO: 553138 - DNA, 175 bp, Homo sapiens
cccccccactattaaccttatgcctgaagccaatttccttttttcccttcccaaatggaaaaatatcactctcctacttacaggactcaacatactagtggacagtcttatactccctctacatatttaccacaccacattgatgaatacctgattagggaagtaagtacactga

SEQ ID NO: 553139 - DNA, 570 bp, Homo sapiens
cggccctggaatagatactcgcccttattgtccctctcgtagtagttatgcgcatcgccatattccacttcaccggcggccttctgagtacgttttctgcctcagctcgatctcgattgtgggctgctcgtagtgcacggccgccactaacttgtggtgcagccgatagcgcttgcggaagagtcgcctcagttcggcgtccaggtctgattcgttgaaggctccgtcggttgggcgctggcgcagttcattgaggatgttgtgggtgctcaccaggtcatcgcagcgtaggctcaggtcgcccttgtcgtgtcgctcacgcccactgagttcacgcacttgcacaccgacgtctggttgtactggcgcgcttcgtagcgtccctcggggtcgcagccgggttcgtagagttcatcgttgttccacgagcgcgtgctcattttgtgcacccagcgtgcggtcgttcttgggcgctcatgtgcgccttgagcagcagacacttggaggtcagcgtggagtattcgacctccatgcccgagcccagcttgcggcatctggtcagcggtccta

SEQ ID NO: 553140 - DNA, 856 bp, Homo sapiens
gctgtgtcacgtaggcgtagagctacatccatatgggaattggagccgggaacttggattgccgccgaaacgagagcagtgaaaatctttaatataagcagatgaatgctgcgaatttgaatgaggcactcctctgttatgctggctcagcttgtgcctgtcgctagtgagagatatgtgtgatgtcaggagtcaaaactactggtaaaggtttggcaaggtgtgatgatagaagatggggatttaagaggcacatgcctggtatggtcaatggtcataaggagagaaaaccatgaggagcactggagctgttgggaatctggtgatagtctggacagaggtctgggactgtgcaactaggagactgccttggagaaacactgggaataggatatacagggacagaatatggacctgaagaggtgtggtggaatagaaggacagaagcgaggaatgatagatcgtatgtagaactggctcgtgtatcctggtggataagaaaattggcttagtagaggtcggagacttctagaactgggctggaatataaggatctcggttgataaatcgtatcatttccctacatatttactctgatggagatgaagaggaacggccagaagatttgtggtgagtgaaaacgtgtgttcaggaccgggtggggccttcttattaacatttgggctgaagtaatgtttcgggggtgggcaaaaagcgttagatatttctggggagcttcgattggaaggcccgaagtggttgtttttaaccccagaaaatattaactcctcgtgtttttggtcacacaaaaaaagctcccgggtgttgactttgtggacggggaaggaattatgcc

SEQ ID NO: 553141 - DNA, 130 bp, Homo sapiens
cacacacaatgagatcctgtcacacacacacacatacacacacacacacacacacacacatatcacagttgtgttccttatgagttgaaaagtcacgaatacatgtgttgaaacatatctggggattcaa

SEQ ID NO: 553142 - DNA, 528 bp, Homo sapiens
  misc_feature (501)..(501): n is a, c, g, or t
ttccagacatagttccttttagaagtcccgttcccagcaggcctccacaggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaacaaaaaaaaaaaaaaaaaaaacaaaaaaaaaaaaaaaaaaaaaaaaaaaaaaaaaacaaaaaaaaaaaaacaaaacaaaaaaaaaaacaaaaaanaaaaaaaaaaaaaaaaaaaaaaagaag

SEQ ID NO: 553143 - DNA, 1398 bp, Homo sapiens
tctttctcttgtggtgtcctgcacaatgtcgtggtgctatctgttatttatttctgtctccgtctcttgatcttctgctcatgactgtcgggtgtgcaccaatttactagtcgctcctgggtcttctcttagtgtggggtcttttttcttactcccaggtttggtgcacgcaaactgtacacccttgcggttgccacgcgaaaattcttttttgcggactttcctgtccccggtgtgtatcccttcccttctctcgaaccccccctgggctccgtaagtctttttctcagtggccccatcttttgttccctcaccaccggttttttttgtttgtggcccctgtctggttttttctttcggggattttccccgtttcttgggcgttgtctttttcctcgagtgggtagatagcaccaaggggggttcgcctctgcataggcgcccccctttggtagtcgtccctcttggattttctttgtaggaggctccgcaggtgttacccctccccgggggtctggctccacattgccacgctttttgtgccacgggtgcaaccggagagttttattttcccactgctttggggggtgaatgtcccctttgcccaccgtcgcccgcttgatttaataatttgtatatggttggtcccccgcggcgtcgcccgggtttttatagtccccacgcggtgttctccctctgtttttctgtcccccacgcccacttttgtcccccatgtttctcttctgtgggcccctgaactctctctctctctctttggggtccgcttccccgggagtatccgcggattcgctggagagggggtgtttgcgcctcttggcaccccacataggccctcttgtggtgttctccgcgcttgttttttgtttctctctttctctttttttcttcttgttttgtgtttctgaggcacccgagagtgttgcacactctctttgtttgtgctctcaaggccttgggggtgtcgccacttgaaccgccgttatcttccggtcttcccacacgcacaccctctctcgccctcctctctggggtgttccaagcgagtttgctcttctgccctcacagagactcgccacaagttggctcgcgagttacacacaggttgcccacccacccacacgcccaccctgagtttttttgtttgtagtttttatgtaccacagagtggggtttctacccacataattcacccacggctggtttcgaacttctgagcctcacggtgatccaccctgcctcggcctccccaagtgttgggattaccacggtgtgaggccaccacgcgccggcctaaattttaaataatttatattaaatcccaatgtggctaacatattacttccaaccttaattaacattaaatttttgaccagatta

SEQ ID NO: 553144 - DNA, 443 bp, Homo sapiens
acaattacttttacccagggaaaaatccctgtcccacagctatgggttgtcagttcccatctatccagccactgtgatgggctctctgtggagtggatgatgaggctctgtgcagaacccgaagtgactggtgagtctaatgaaggcccagagctcagcaaggtccctgtccagagctgacgggtggcggagtgagacccgctctgctcttaagcgctcacagcagccaagaaaccatccagcatgcatgtgatcagtcctgtgtgcaaatggctctgaggacacacatgatatgagggacactctgtgacaacccacttgtccaattatcctgttcaattttaagccacaaggttatggactttaccaaattggtagaaagcaaaggtgcctccaatcttagaacttaaagaaatcccctaaccatgctcttgaataagcca

SEQ ID NO: 553145 - DNA, 821 bp, Homo sapiens
  misc_feature (2)..(2): n is a, c, g, or t
  misc_feature (63)..(63): n is a, c, g, or t
  misc_feature (73)..(73): n is a, c, g, or t
  misc_feature (94)..(94): n is a, c, g, or t
  misc_feature (120)..(121): n is a, c, g, or t
  misc_feature (137)..(137): n is a, c, g, or t
  misc_feature (140)..(140): n is a, c, g, or t
  misc_feature (195)..(200): n is a, c, g, or t
  misc_feature (202)..(202): n is a, c, g, or t
  misc_feature (204)..(204): n is a, c, g, or t
  misc_feature (216)..(216): n is a, c, g, or t
  misc_feature (275)..(275): n is a, c, g, or t
  misc_feature (280)..(280): n is a, c, g, or t
  misc_feature (283)..(283): n is a, c, g, or t
  misc_feature (291)..(291): n is a, c, g, or t
  misc_feature (297)..(297): n is a, c, g, or t
  misc_feature (301)..(301): n is a, c, g, or t
  misc_feature (353)..(353): n is a, c, g, or t
  misc_feature (372)..(372): n is a, c, g, or t
  misc_feature (382)..(382): n is a, c, g, or t
  misc_feature (496)..(496): n is a, c, g, or t
  misc_feature (530)..(530): n is a, c, g, or t
  misc_feature (563)..(563): n is a, c, g, or t
  misc_feature (597)..(597): n is a, c, g, or t
  misc_feature (600)..(600): n is a, c, g, or t
  misc_feature (666)..(666): n is a, c, g, or t
  misc_feature (671)..(671): n is a, c, g, or t
  misc_feature (701)..(701): n is a, c, g, or t
  misc_feature (748)..(748): n is a, c, g, or t
  misc_feature (806)..(806): n is a, c, g, or t
gnatcaccacaggcggcacgatgaacgaggaccacatatgctaagcacggcacaaaaggaggncacgtcagtnacagacacagacaccacagcnaaggtggggaagcggagaccattggnnttccgtgtgcaaaggnttntgggaagatgggtggagtttgtatatttaaagacagctgttagaagcaggatttnnnnnntntntttttttttttnaattatgtgtctttttttttttttttgtttccaaggttttgaatgattttttttttttntggtnaanggaaatcntatttngggntaggtgttgggtggcatttgaagatgtggatcttcagagggatggaaaatcnattttaaggggctcaacantaggggtttnttaaggatttggaaaattattatgggaaatagaatatgctggagatatttgggaccaaaaatagggttttccaagaacttcagggctccataaagggattcttcaataggttanctaggtatttgggcacttcacaggaaggaaaacnccctctggggaaaccaggggcggaggtcttcangaatgtggaggttctaaaacagaagtagatcctnaantgaccacgagtggggttctaaaaggacttggggattccacatgtgagaaccggatttagggccagnaggantcaggtttctcaaggtactcggggatcttnaggaatgagaggtggaatcttggagaaccgggagatgggttctcaanggatttggagactccaaaagtgagaaatggattcagggcccaaaaaagagtttcccanggattttggggttct

SEQ ID NO: 553146 - DNA, 703 bp, Homo sapiens
ttagtcgttttcttggcttcctttttagggtactgattggagaacggtcacgtgtacatgaagatatctgtgaatgagtgttccaagggcataaaatgcctgtaaatgttcgtgttgtacaagaaaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaacaaaaaaaaaaaaaaaaaaaacaaaaaaaaaaaaaaaaaaaaaaaaaaaaaaaaaaaaaaaaaaaaaaaaaaaaaaaaaaaaagaaagggggagcacacaaacgggagcaggaagaagaaaaaccacaaacaagcaagggaggggaggaagcggggaaaactgagaggcgcgcgacaaagggcgggaaaaaaaaggaaacaaagagaggagagcgcggggcatcgagggagaggggggggagacgagcgagagaggg

SEQ ID NO: 553147 - DNA, 236 bp, Homo sapiens
  misc_feature (2)..(2): n is a, c, g, or t
  misc_feature (18)..(18): n is a, c, g, or t
  misc_feature (23)..(23): n is a, c, g, or t
  misc_feature (29)..(29): n is a, c, g, or t
  misc_feature (31)..(31): n is a, c, g, or t
  misc_feature (52)..(52): n is a, c, g, or t
  misc_feature (69)..(69): n is a, c, g, or t
  misc_feature (75)..(75): n is a, c, g, or t
  misc_feature (86)..(86): n is a, c, g, or t
  misc_feature (89)..(89): n is a, c, g, or t
  misc_feature (91)..(92): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (142)..(142): n is a, c, g, or t
  misc_feature (146)..(146): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (159)..(159): n is a, c, g, or t
  misc_feature (176)..(176): n is a, c, g, or t
  misc_feature (193)..(193): n is a, c, g, or t
  misc_feature (199)..(199): n is a, c, g, or t
  misc_feature (213)..(213): n is a, c, g, or t
  misc_feature (230)..(230): n is a, c, g, or t
cnaggtcgcacgcgtganactgncttccngncgcctcccgccgcagacgccnccgcgattgcgctacgncgcctnccaaccctgtnggntnngcccttagggggnaantncctcccccagctgccaaggacatccaagaagntctntnggacancngtngggtatcgaggcggacngacgatccgcgctcaanaaggtntatcagtgcagctnaatggaaaaaacattgnaagacg

SEQ ID NO: 553148 - DNA, 162 bp, Homo sapiens
ttttttttttcagtctgatgtagctttattgagaaaggaaaaagggaacagtctcgctagatatcagatggccagtgacagaggcgcaaatgatcccttccgtactgcggatgtgtgaatcgcatccatgcacactggcacgcgatgcagtcgtacgagagg

SEQ ID NO: 553149 - DNA, 631 bp, Homo sapiens
acacagaatccgagtgatgctgtacccctcaaggatttaagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaacaaaaaaaaaaaaaaaaaaaacaaaaaaaaaaaaaaaaaaaaaaaaaaaaaaaaaaaaaaaaaaaaaaaaaaaaaaaaaaaaagaaagggggagcacacaaacgggagcaggaagaagaaaaaccacaaacaagcaagggaggggaggaagcggggaaaactgagaggcgcgcgacaaagggcgggaaaaaaaaggaaacaaagagaggagagcgcggggcatcgagggagaggggggggagacgagcgagagaggg

SEQ ID NO: 553150 - DNA, 1348 bp, Homo sapiens
gagacagagttttgctcttgttatccaggctaaagtgcaatggcacaatctcagctcactgtaatctctgcttcccgggttcaagcgattatcctgcctcagcctccgagtgaggtgggattataggcacgtaccaccacgcccagctgatttttgtattttttagtagaagacagggtttttaccccatgttggccccaggagggtctcctatctcttgaccttaggatctgccccgcctaggcctccccaaagtgatgggattacaggtgtgagccacagcaccctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatcccctgggtcatttttaacttttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcaaaaaaa

SEQ ID NO: 553151 - DNA, 648 bp, Homo sapiens
actggtcactatcgggacttccgcatcctgtgatgttttgttgcttaggatatgaatggctgagcggagggtgtaaaaccctggcactctgctatgggtactgaggttcttccgtgccatccgtgcccatcactttgtttcatttgtgtttgtgtcgtgccaaaatgtgacgcttgacggaacctctgggatgctcatggaatggaatggatgcgcccatgaagcatgggacagtggagcttggtttggggatggaccaggaaatacaggttttgtgaagggtcccatgagaggaccttgtctattgggacggagtgtgggagacctgagactgggggaggggtcatttggaaatgatgctgggcgctacttggcatttgtccattgttgaggcactgtccatttgtgacggcaccaccgtgggtcatcaggggatctggtgcagagggagtataaagccccagggttggtcaggggagggccagaccgaagaaggtttggtggataagcagaacctttttgtctccctctgattgctcctaagcctcatgctcccttgccctgggtgtccctgttgctccctgatcttctccgtgacctgtagttaaaacttccaacagcgctttggaccttaatttgaccggatcc

SEQ ID NO: 553152 - DNA, 116 bp, Homo sapiens
gcggccgcctactactactactgcacgaattcaagcttctaacgatgtacggggacatggcaaattacagaaaaccaaagacaaggagaaaaatctaaaaaaaaaaagttgtactg

SEQ ID NO: 553153 - DNA, 705 bp, Homo sapiens
  misc_feature (530)..(530): n is a, c, g, or t
ctccggaccttcgtggaagaatccatctacaatgagtttctcgagagaaccgtggatgaaagcaaagcgagaggaaagtggggaacccgctttgagcctggacacctcagtgagggtgcctcaggtgggaccaaggagcatgtttgaacgaaggtcctaggtctacatccagtcttggccagagggagggcgcgataactcctctgtggcggagagcgtttggcgcgcgagcgtgggtttcattcatcaagcctactgtctttggtggggtgcaggatgacattgagaattgccaaatgaggagatctttgggcctgtgcagtccccctgtggcaagttcaacgaagattgaggaggtggttgagagggccaactaacaccatggtatggcctggcttgcgtgtgtggttcaccgcgggatctggcacaatgccatggtacttacacccaggcactccagcgtcgcgtgacccgtgtgcgtgtaaacgagcctacgagacatccgtcacctgccacaccgccatttggangggtttatgggaatctgggaaactgggagggagctgaggttgatggattgggcttaaaggcctacaacaagaggtcaagacggtcaccatcaaggttcctcagaagaactcgtacagagccgttgtcagtgagggccacttcacagtcctatcaaattccacaaccacttgaaca

SEQ ID NO: 553154 - DNA, 341 bp, Homo sapiens
gcacgagcggcacgagcttttttgtttttgcccccagttctgtccacaccccttccctttcctgtcctgtcctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgcctcgggctcccaaagggatgggattac

SEQ ID NO: 553155 - DNA, 1019 bp, Homo sapiens
gctgtggctgtaagcgaggaggctccacagcggacgtagcagctaccgctagccagtgatctggcgcatccagcgcatggcccgtgacccctccgcaggcatcattctgggtgtgcgctgctggttagcaatgatacccgtaaggcggttaactgatgagtgacatgctggctgcgcctgatttgcggagcgcacaacgataccatgggacctgctgtcgcgagatcgttcctacgagcaggcacacgctagggtgacacttgtcgttgttgaacaacactgatggcgatccctgaacgtgagtgtccgaagcgtcagtctagcacggatgccactgagggcgttcgcagaataccgcgcatccctaggtctcatgaggacaagaagacttgcccattccgtgggcagaggtatccacgggccaccattctatgacttggaacgtagggataccagagtaggcagacgggggaaacgcgaggtgaccctcacctaggagctccgaacttgcacatggtacaccctgcgtggcctgcgactcgacacgcacgcgaaacttgcaatggtcaccagagaagtaagaccggctagggtagtggttctaggcagcgcaaatagaagaaccaaggaagcaactccatcagccgcttggaaccttcgtccagcggaagactcctcgagacggacctctttgagcccaagaatctatatgaacaagcacagacggaggcatgcggaccctgtccactcgagcgtgacatgtagcagggcagaggcacgcccctggagcttctcgtggcacacacgggtcaatccctgactggccaaacctgggacggcccaaggccctgtggcaaggcagccggggcagacaagtgtcacccatgagctgtggcatagctgagctgctgtgcccagtggctcagggaaccttctcagcgtacttctactcccgaaaggattgaccatcaccctgtcagtcagtcaagtgcttccacaagactggcctctagctatgg

SEQ ID NO: 553156 - DNA, 238 bp, Homo sapiens
ctggtgtacatgaatttgactatcatgttggacatggccgacagggaaggggtcgtagacatctacaactgcgtcaggagctgcggtcacggagggtgaacatggtgcaatacagaggagcagatatgtgtttatccacgaatgcgatcctaggaagcctgtctttgtgcgggacaccgtctggtgcgctgcttcccaatgttagcgtctctggtattatgacattgtaacaaacgtg

SEQ ID NO: 553157 - DNA, 206 bp, Homo sapiens
  misc_feature (22)..(22): n is a, c, g, or t
tggccgtaagcagcgtgctgtnatcctccctactccatactaccaatttgacaattctcaccaatagcttcctttcctcccacccacccctcccattttacccagaggaagcccatcactgacaccacctccaccaaccaccgaaacctactcgcttagtatccgcagaaacgactgccacggagattccatatccccagataatg

SEQ ID NO: 553158 - DNA, 266 bp, Homo sapiens
  misc_feature (39)..(39): n is a, c, g, or t
tgatgagaaattataaccaagcacacatatagcataggnactaaccccatataccttctgcatatgaatgaattagaattaactttgcaaggagagcgaaagctaagacccccgtaatccagacgagctacctaagaacagcttagagagcagatcccgtctatgttgcacaatagctgggatagattcataggtagaggcgacgaacctaccgagcctggtcatagcttgttcgctgtgctttagattctaagtttcaactttaa

SEQ ID NO: 553159 - DNA, 320 bp, Homo sapiens
  misc_feature (5)..(5): n is a, c, g, or t
cctgntctcgcccaacacctcaatacctgttagtgtttttttgttttaatttttttgagatgggtcttactctgtcgcccaggctgaagttcaatggtgcgatcttggctcactgtaacctccgcctcctgggttcaagcagttttcctgactcagcctcccaagaggctgggtctacaggtgtgtgccactacccccggctcatttttgtattttttgggtagagacagggtttcaccatgttggccaggctggtcttgaactcctgacctcaagtgatccacctgcctcagccttccaaagtgttggggataacatca

SEQ ID NO: 553160 - DNA, 650 bp, Homo sapiens
cgaccgcgtggtaggctaaaggcttgccgttgttcctgcacggctaagtgcccaggttcatcctaattgagctgaacactagtcactgggttccacggttctcttccatgacccatggcttctaatagagctataacactcaccgcacggcccaagattccattccttggaatccgtgaggccaagaaccccaggtcagagaacacgaggctagccaccatcttggaagtggcctaccaccatcttggaagtggcctaccaccatcttggaagtggctcgccgccatctgaggagctctgtgagcaaggacccccgggagaaagcatttatggtgaggagaaaagcagctggtatcacactctacccaagtcccaaaagcaggttcacataactcctgtcttcattatctgatatccgggactttttccctttcaccttccattataggatgatgcagcaagaaggccctcaccagataccagtcctttgatcttggactacccaggcttcagaactataagaaataaatctccgttctttgaggattacccagtttgtgctattctgttatggcagcacaaaatggactaagacataggtccaatctaaggcctttctcccagaggacacctcatagctgtgaatgaat

SEQ ID NO: 553161 - DNA, 143 bp, Homo sapiens
agtcctcacctgcacggtgggtgttggggttggtgtcaccgtggtggtggtggtgatgggtgtcaggtttgtactctgtgtgccggtgggtgttggggttggggtcaccgtgggggtggtgatgatgggtgtcgtggttgggg

SEQ ID NO: 553162 - DNA, 919 bp, Homo sapiens
taatagtcactttaacattgagacctctgactcattgaattcaggttttttaagtacttgaaactcttcagtattctccttgattttagtttctttatatacatttatgaagtagaaagcattgtttggtaaactgtggttgagaataaatagcctagtctcttatcctctttagcgtggcattaaaggtgaagttctgcaaatgggagagtgttcacagtagatagctcagattgattgaacacattgaggcaagagcactcctgcatgagataccagcattttcacaaatacttgatatgtacagttcttgtatttagtcattgtgtcaacccatcatccccaagcacagtcttctttccttttacatatgtctatgtacgggaaaaaaacaaaacaaaaaattgcagcttacgattacactcccaaaatgtgggtaatccgtgtcttacaaaaaacatttctgaacacagcacaagtacaaggatcagaccatagcataagtgacaagtaaggagtgcattgtggacacgtatgatatgaagcgggaggggcgactgagacattgactgctccttcaatagcgctgtccacaagtcaattaaccatgctaaagtaaaacagggcaaaatagaatcagatgccaaacgtcatacatacaagacacttaagaaaaacaaaagctgagcaatcacgagacaatactagccagaccacaagaagacaacgccaaccacatcagacacaaacaacaggaatcccaacatacccacagaaacagagaccaaaaaccacaataagacgagaacgtgagcgacaaacaggaaaccaaacaaaggtaatacaaggacagacatgacgcgaccaatacagagcaatagacaaacaagagcaaacaaaggaaaaaatacgaaaacaa

SEQ ID NO: 553163 - DNA, 1180 bp, Homo sapiens
ctgcagtaactctacggttctaagtgtagcgatgggcctggtgttgctgcagaaatgccatgttggtgactcgtgcgccagtgcccaagcgctaaccctgctgaaagtttctcagcgaaatctcatgtggacgatctggaccccgctgagagtgaactgcttttgagtgagatggtcccagagtgcctggaggagctggactgcaagcccctgcccaacactggactggctgtttctctcaggcccagagaccctggcaccagctggctcccaaaatggcgatgacgacctggacacctgtgcccaacaagcagtttgacacatgagatgctgcaagccatgctcttggcggtcctgccagtgaacgcatgctgatggcgagctccagccctgtgtgagtgggtgttgccggcaccactgggacttgagctgcccgctaccggtgaaccccaggttacaccgctgcagaggcacgtgcccgagtacctgcaagaattgtctataagtccccagtgcagcaattggccacgaacttgaggcacagcgccaggcattggcacagactggtgattggcacaagggcccccaggccggggtgtgcaactggggagacaaggaaagaacgtctgggccacacgaagcgacgccagaacgtaccgattggaggtgccagtgcgcgcacgaagccatacaagtgtgcagggcacttagtttcccgcagtagacaaggacaccagccatatcgtcgcgttaccatttgacccccgagtagccgtcaggaagttatccaggtgtggctaaagcccgaccagaaaataaggttggtagagtgtgggcccagaggggcccaattgcgtccccagcgattggggacacactagaggaaaaacgaaggattggcacaagtgacaggagaagagatagcagccagtattcgcgccccgcagggggagggtattgcacagcacttgtggaacatgcgcagggaaaccaggggtgggggaaaacgcccagcggcagcgaaagtcaagagctgggtggagtagccaaggtggggagaaacgctggggaagaggagcgtgtaagacaaagcggggagaaggcgagtgagggcaggaaggcacagctgaagcaatggacgaggaggaggcggcgcgtgcagaggaggacggagaaatcg

SEQ ID NO: 553164 - DNA, 167 bp, Homo sapiens
cattagatgtttcagttccccacgtttgctcatgcatagcatgtattatgctgttaaacctactgggtttgccccattcggaaatctgtggatcacgtcgtatgtgccaatccccacagcttatcgcatcttgtcacgtccttcatcgcctcttagagccaaggcat

SEQ ID NO: 553165 - DNA, 705 bp, Homo sapiens
gccgagactggagctgggtgattggctcccctgagatattacggaagcggctgtcggctgtcgtgagtcgtctccacacagagagtgactcaatgccctccaatgacagtgcgacgccgactgctcaggccgtacctggatgcagcctcggttcccgggagggccctgagcgaggccaagcaggcaccctcgatgtgaggcaagctacaggagggtatatgggtcctgacaaaccccatcttggacgagggtggtatcttgggcctgtcactgaatcactcagtgggatcgagctggccatcatgctggatgacggacacgcttgttgtgtccgcgcacgcagttggttccagtccagctatggagatccgaggccgtggtgacctctacagctggctgagggatgccacagccaaggcctatcagtgacctggctgttgcgtagtggcccgccagcggctgctctctggggactcaacagagaagcgcactggtcgccctgtcaacaaagtgatcaagtccgtctcagccacaggcctctcagtcctcattccttcggaacaccagacctgactccccgtttggcccagccccatgtccccacattctcagtcgtccaacccatcatcccgggactcttctccaagcagggacttcttgccaagcccttggcagcatgaaggctcccatcatcatcaccgagca

SEQ ID NO: 553166 - DNA, 419 bp, Homo sapiens
ccgggagtcgctcaatgaagcggctatacaggccatcctgtaccttgccgtggttgcgcatccactcgaccgcagcgttaggattggtgagcatcacataatgaaattcgccggatgcacctggcttgctcatgatgaagttcagctcctggagcttcttcatccggcgacgccaggtgtccacggcacgttccccgagaaaccccgcttcagccgcaaacgtgctggggttctcgatagatatgacgggatgatcgggcatacgcgcccatagacaaaacagcacgtgccctgcaggttgtcccttcgaatcagcgtcaataatctgcatggcaatgggcagtgtccgaggaatcgtgctgaagccgtcgtgggtttttcgtgtccatttcaacgcttcgggaatgtcggggaagtgg

SEQ ID NO: 553167 - DNA, 146 bp, Homo sapiens
gtgtcgctatatcatataccctcaacaattattgcctccttcatcgacaatgtgcggttcctgcgtagcagctagaagctaaggatcttgggacaccgaatgtggtaccctgccagaaggagcaagggtaccaagactgtgagtgc

SEQ ID NO: 553168 - DNA, 128 bp, Homo sapiens
gcgaccatgtccgtcgcttccgcactccgcctgcagcccttttgccacagttgccgggccgctggctgctggctgcctctagtggttcagaggagaatattcacagtggtgcctgggccttgggtggg

SEQ ID NO: 553169 - DNA, 105 bp, Homo sapiens
tccctgcagctacacagcagcacttgtgcacaattgatacacgaggaaagtcgttcttataaatatgtctattgacagaggatacccatatcatcatggcatcta

SEQ ID NO: 553170 - DNA, 108 bp, Homo sapiens
tggatttgctggtgcagtacaactaggcttaatagggacatgggaggattgcttgaagctaggagttcaagaccagcctgggcaacgtagcgagacccatctctacca

SEQ ID NO: 553171 - DNA, 463 bp, Homo sapiens
atggcgttctagaggtccctgcatttactccatggctcaccttacacatctcctcaactatatcctttgcaatatcctttatagtaaatcagtaaacataagtgtttccctgagttctgtgagccgctccagcaaattaattgaaccaaaagagggggttgtggtaactcccaacttgaaggcagttagtgagaagttccagaagcctggacttgcaactggtggggatgagggcagtctggggccagagccctcccactgtgggatctgaggctatctccaggtagacagtgtgggaactgaatgggaggatactagctggtgtccgctgcttgccatgtggggaaaacctccacatgtgttcatagaaggcttcctcggtgttgatgatggctgttgcggtgtaaaggcagaggaaaaacccagtttgagagttttctggaaacaacctccattttacaaa

SEQ ID NO: 553172 - DNA, 117 bp, Homo sapiens
cagggtctatgcttgatttcagtccatcatgaatcaccttctctgattactagaaaaaggaaggagaaatgggatcatcaagttgaaaatataatggctgtgaaaacaaatacaaag

SEQ ID NO: 553173 - DNA, 352 bp, Homo sapiens
tctccctcaaaggggcgcccaaaaggggggttttaaagccccccttgtgttgggaaaaacttttgggcccttttttaaaaaaaagggggtaaatgttttcatcccgggcccccaccaacaaaatacttgttttatcaccacgttataaataaagatgtctacatcagagctgagaatgtatccacacttcatttttactcaccgaagaggaggaaagcatcagatcaataagtggggcggcgaccctcatctatataattagagctgtggtcgcacactgtgtattctacagcggagtgatgttcaacacccacctcatattgtgggacgccttagtgcaggtatctcagca

SEQ ID NO: 553174 - DNA, 395 bp, Homo sapiens
agcagagtaagaagcagacagtctcactgtgtcgcccaggctggagtgcaagttgcatgatcttggctcacaactgcaacctccgtctcccgggttcaaacgattctcctacctcagcctcccgaatatctgggattacaggtgcccaccaccatgcctggataatttttaaaaatatttttagtagagacagggtttcaccaactaggccaggctgctcttgaactcctgacctcaggtaatccacccgccttggctcccaaaatgctgggattacaggtgtgagccaccgcgcctgaccactttagcttttcaaatctgtcttcgtagacgataatggaatatctaccaagctaaatattcacctccccatgaccagcaattttacttctagg

SEQ ID NO: 553175 - DNA, 317 bp, Homo sapiens
  misc_feature (46)..(46): n is a, c, g, or t
  misc_feature (295)..(295): n is a, c, g, or t
aaaaacaaaaaacaaaaaaactctgctccagcttgggcccattggntcgcatctgtaatcctagcactttggaaggctgaggggggtggagcacctgaggtcaggagtttgcaaccagcctggccagcatggtcaaaccccgtctctactaaaaatacaaaagttaggcgggcttggtggcgggcgctataaatcccagctactcgggaggctggagcatgagaatcgcttgaacccggggatggaggttgcagtgagccaagatcgcgtcactttcattccagcccagggcganaagagttgaaaatccatcttca

SEQ ID NO: 553176 - DNA, 219 bp, Homo sapiens
  misc_feature (48)..(48): n is a, c, g, or t
tataattttaccgtccaagagggcgagcctcttcgatactccctttgntttcgttcgtcaaaaaggcctttcgaaaaaacaagagaggaacaacagctaccaccaccgagcattctacaaagccccgtcctcgcgtccagccctcacaggcttcgcagtgaaataaaaagtgccccgcccaaaaaaaaaacacccccaaacacacacacaaaaaaaccc

SEQ ID NO: 553177 - DNA, 661 bp, Homo sapiens
cccagacgtggaggaggaggagggaggaggccaggtggaggaagaggaggaggaagaggaggatgaagagtgcctgaggagtgagcgcctggctctggaatgggccctgtgtgcgctggacgatgtgacttcctgctgtgagcacatccgcatcctcaaggtgctgtgtgtgcttcctgatccatgtgcatgggcatgtatcctgccatgttctgcctgctctgcgcttgttgctacacctgatcttctgtgctatctgcatgtcttctgatgatccctgtcacctaggatgtctctgtgggcatgcatgccatgctacattccttttctctcctctgctgctcttgtcttttttgtcttccctgcattgtgctgactctcacctgatgttttgtgctttcctcattgcctgtgatgctgtgtcttgtgtgctcaatggtacgtgcatcagtgatgaactactgctcttctattatctctggactgcctgccaatccttgcatgagttccacgctggacctgcgctcatgctttgcaccccatgcacatggccatgcttgtgtagccccatcctctacgtgcagccacaaccatgcctgcaggagttcctgcgccagctgctcaccttctacaatggtggctggctggctgcaggagctga

SEQ ID NO: 553178 - DNA, 116 bp, Homo sapiens
ggtcgaagaagcagctgatcaaatccaatgcaactctttgagggatagtgatatgtgaatagcagtgtcagtctaggatatagcacatgataactggctgagaattaccactagta

SEQ ID NO: 553179 - DNA, 526 bp, Homo sapiens
  misc_feature (16)..(16): n is a, c, g, or t
  misc_feature (36)..(36): n is a, c, g, or t
  misc_feature (47)..(47): n is a, c, g, or t
  misc_feature (53)..(53): n is a, c, g, or t
  misc_feature (64)..(64): n is a, c, g, or t
  misc_feature (69)..(69): n is a, c, g, or t
  misc_feature (73)..(73): n is a, c, g, or t
cagcgaagcttggggnctagtctccaacagaggccnctacatgaaanccgttnttaggtagccncttcnctcnctagattttctggataactgctgcagctctctatcagccttgctgcttcacttgcacttttatgttatggagacagcttctttccttaacctcatgaaccaactcctgctagcttccaacttttcttctgcggatcatcactctctcacctaacagaattgaaagagttgcgctcttgctctgaataggctttggcttagggatgttctagctggtttgctcttctatccagaccactcagactttctccacattagcagtaaggctgtttcactttcttatcattgatgtgttcactggagtagcatttttaatttccttcaagaacttttcctttggctgggtgtggtgtctcaggcctgtattctcagcgctttgggaggctgaggcaggaggattccttgagcccaggagttcaagaccagactgggcaacgtggtgagaccctgttgc

SEQ ID NO: 553180 - DNA, 155 bp, Homo sapiens
tctactcaagaaatcacaacataattacatcttgctgtgcttgcggttagacagggaatacttttacactgctggtggtacaactactatggaacacagtgtggagtgtcccttacaaaactaaaagtgcaactaccatttgtgagcagcgttgg

SEQ ID NO: 553181 - DNA, 463 bp, Homo sapiens
cgcacgtttccacttaattacttacgcatgtgaccagataccacctgttccccaaacacctatggaaataattttgtttttttttttaaaaaagggatgagatcatgtgctttgcagggacatggatgaagctgtgaagccattattctcaggaaacttacagaggagcaggaaaccaaacaccacatgtgtctcacttgtaagcggaagctggacacatgagaacacacggacacagggatgagatcaacacacactggggcctgatgcacgggccgtagcggggagagcattaggataacttgctaatgcatgtggggcttaatacctatgtgataggttgataggtgcagcaaaccaccatgggacacgtttacctatgtgacaaacccgcacattctgtacttgtattcagaacttaaaatattttaaaaatctttagagaatacacaaaaaaaaaaaa

SEQ ID NO: 553182 - DNA, 469 bp, Homo sapiens
aggagatatagaacagagaaggagcagatcccacgaagtgactgcagatctggaataatcagataaaggggtagatcatgaccatagagctcacttaaaaccggcctatacacctacaaggaattggggtaggatcttctcctcagccttgccacaatagaatggacaatgcccttctagtatgtttggtgaaggtcttgaaggcaccatttcccccatccaccctggggagaaattgagtccctaacgtcaacgacaaggcttattgaggctgagtttgcaacagatccgatctgggaggtagaaacaaaaatgactgaacatctttttatcccccaatcgttacaaagcctaaataactctaaacgggatgggagggcaaatttcaggtcagttgacatcctggagaagatatcctaggtcctgtctcattccctagaccgcatacactccaaccgtgtaatctcag

SEQ ID NO: 553183 - DNA, 760 bp, Homo sapiens
ggagcaaattcacaaacgcctgtttggtggaacccaagaggcaacttgaagaattaatcaggtgtctgccacggggtattcactagttaccccccgccgcgtgtatactctgtggagggtgcatataaaagaggtgggaataacggggagcccaccgtggcggcagaacaagatggtcgtgtgcaaccgcccccccgctcattgtcacgcgagcaagattgtgtcccaaacacaaaactgtgtcgcacgcaccgctgtcggtttgttctcacacaagaggcgctcgtgcgataattttgtggcagatgggtccgcattgcccccgtccataactttttcgtgaacaccaccccggccccccgatgttgtaggagctgtgcaaagcagcacccgaagtcattgagtgggtggcatctggtccaccgcccgggtataagctgtgcacccacggacaaactgagagaagtagtgtaacacaacagcgaggaacagtaacatagtggtttcttctcgccgccccatgagaggtaggcgtgcacttgctcctcgaacgacaggtcacatgagtcgcggcctcacctcctggcaaataaatggctttagatgaaggattgtcgctatatgatgacacgccgacgtcttttcgacgctagcggctaggttccctccttagcgtactattagcgagttctgggccgtcagtcttacgcaggacgaggctgacgtcgcaagcaaggaaattaccagcccaaaaaaaaca

SEQ ID NO: 553184 - DNA, 205 bp, Homo sapiens
gaactagaggacccacggagagagaggccagcccaagcctcagctacatgtctgtcccattccaatagcatccgcacgcaggtggtatgtattataggacttgtattttctccttatattttaccccctggcctattcctgtctccccgtctgggcattcaaggattatgaagactgtcgtcgtatgggcctcggtgtctccagt

SEQ ID NO: 553185 - DNA, 282 bp, Homo sapiens
gctcgactcttagcttgccggggacggtacccgagacccggtgtctgctcctgtcgtccttcgcctcctcaatccctagccactatgcgtgagtgcatctccatccacgttggtccaggctgtgtgtcgagattggcaatgcctgctgggagctctactgcctaggaacacggccgatccagacccgtatggacagatgccaatgtgacaagaccattgggggaggagatgagtccttcaagaccttcttcagttgaggacgggcgctggcaaagcacgtgc

SEQ ID NO: 553186 - DNA, 232 bp, Homo sapiens
aggatccggtggcgaggagcgtcggattattgggacctggaacacacagatttcaagaccaacacacagacttaccgagagaacctgcggatcgcgctccgctactacaaccagagcgaggccgggtctcacacttcggcagacgatgtactggctgcgacagtggggcccggacgaggcgccctcctcctgcgtggcataaccatgtacgcctactgacggcacaagatta

SEQ ID NO: 553187 - DNA, 433 bp, Homo sapiens
  misc_feature (4)..(4): n is a, c, g, or t
  misc_feature (11)..(13): n is a, c, g, or t
  misc_feature (15)..(16): n is a, c, g, or t
  misc_feature (47)..(47): n is a, c, g, or t
  misc_feature (121)..(121): n is a, c, g, or t
  misc_feature (186)..(187): n is a, c, g, or t
  misc_feature (325)..(325): n is a, c, g, or t
  misc_feature (363)..(363): n is a, c, g, or t
  misc_feature (417)..(417): n is a, c, g, or t
atcnggctgannncnnaagcaacatgcatcataaaaaagacacaatntaaaggaagacaatctgctgagtattaaaaaccatctaaatatcaattctttgcaaccagcacagaactaattngctatcaaatccaaaccccaccaaggttaagtttggctgatgtaggccaggagtcaatgtagggnnaaaaatttcctcagtgcaagagagctgagtagtgttttggatctttctctggctggtacaagcagtattagaaaatctttttggcaagggagaaaaataaatacaaatggaatgctacatttttaaattagcaaactntctcaggaatgataaaggtatcagtaaagtagcaaggngataactttaaaacattatttgtctggggctcaaaaaacactcaaaacaatttntttaaaggttgcacaa

SEQ ID NO: 553188 - DNA, 698 bp, Homo sapiens
gatgccgcagacctcattttggcaaggcctgcgagaatcagcctatcaccgccagcaagcgggaccgcttgcacaaggtcatgtggatcacgttactgttcgctaactggatctggtgcgtgcctatcaatgaatcaacgtgcattggtatctttgtactaccctctgtacaagcttagccgacgtgggatcatgccagagcatgagtcgagcccgatatgatgggcgaaccagcttcatggcacacgttgatatcagattcaacagtgttcacgtggatccgggtaccaatggcacgtacgctgtgtacgtctacatatcgctaatacatgatcttgggcacgcggtatattatcctgctcgcattggatactagggcatccagagtcgataacctgacgctaggcctttgaagctgacgtgattcttccggtactacgctgctcagatcagccattacatgcattgtagcagcaataggtcacagattttgacgaagatgctcatcagacagtcctaactgacaagtgatttaaccatcactgtatatactgtgaatagggagccctgcacgctcacgtgtatcttgtctgacgattttaccagcccctagcctttcagccacatcgatttagcaactgtgcacgctagtacatcaatcccctcttgttccataccgttgcgtccgtcttcgctcg

SEQ ID NO: 553189 - DNA, 1138 bp, Homo sapiens
gtggaagcgtcagtggccggtatgctggctcaaatgcagatagccgatgaacatccagatgaagtgcaggcactggtgcttaagtctggagtaatcactatgctggtgggggcagaacagatctttggtagaggccattgtggtgcgccatagtgtccatgggaaccatgagacgttgcacgtcgtgcgcatgcgtggataagcggcatggtcgcatactatggcatgttgaggcatgtggttcttgggtcggtggatgctgggcggcgggccatggtgtgcctcgtcacacatgttcctgaaggtttgtgcagggactttccattggacctgctgatgatggcagtgagggctgctaggtgtgtgtacgactggacaggctcgcacggggctgcgctgtgtggcctgaggtacaaccttgtcccggcttaatccctggtcgcatttggagaagagcattgccctgctgtgggtccgggaccggccagagaatcatacacattgttgcttcgcgcaagccaaagcaacatggggcacagcgcggttcctcgagacgtgcgtaaagggcagaggattcgaagcaatcggactggtcgcgcgacgttgggtggttgcggggcattgctcgcggggaggggcgtctagtccgcactaaattgccatttggggacgacaaggctgccctattgatgcccttggggggcgttcatcgcatgggatccggatgggccgcggggaccacaacggagttgaaccattagttcggagtcgagaagaatgtttgatacactaccgcgctagttgaatcttcggggaccatggccatcaagcgatacggtgaacgaagccttcggacggagaagtccttcgctttcccgaggacgctaatacggatggcactagagagtcttcctcgcccccgagttccatgtgataggtccgaacagtggatcctcgggaagagcgtggtccttttgcggggaagaaccccctaggggacgaatcgctcaatgggctacccggctcggtgtggcaggacacttcttggaagggaacggtcacgggttgttaaacccttcgaaaagaatgtccaacagggttcgcgcggagagacgcatgttggacacacggaggtaca

SEQ ID NO: 553190 - DNA, 245 bp, Homo sapiens
  misc_feature (4)..(4): n is a, c, g, or t
ccanagttctcgtcgatactagacgattatgcaccaccaccacagagattatacttacacgtgattactggtcattcccagttcactgtgatgactatccatcaaagaggatatatgcgatagagtatggatatcggtcgtgatctgtgactattcagtctcatccaatgtggaggttcctacagacgattcatattgagcgttatggtaactcacgtagtgctccacctacacgagaaccaggt

SEQ ID NO: 553191 - DNA, 510 bp, Homo sapiens
  misc_feature (225)..(225): n is a, c, g, or t
  misc_feature (227)..(227): n is a, c, g, or t
  misc_feature (413)..(413): n is a, c, g, or t
cgagcgtttgcacagcgctcacgacgctgataaaaacggcgccggtcagagcgtaggatgctttgcctatctgcctgctgtcgcgccgtcattggtcaatctgcacaccggctagcgccaacctgtcgaccacttcccggtaggtcagcaggtgcatgcggtggccggcatcggaaacccggaacgtttcttcgataccctcgagactgctacactgacgcccantncctcatgcttttgccgaccacgcgccctacagcgccgaggtcttgaatttcacaccggcgctgccgttggtcatgactgaaaaggacgcggtgaagtgccgcgcctttgccaggcccgactggtggtaccttgcggtggacgcggcaccgtcaccggcgtttatcgcctggttcgacacgcagttnatgcgtttgctgcccgctcgccttttgccttaaaacgctgctctccaggacatactcatggacaccaaactgctcgatatcctcgcttgcccgatct

SEQ ID NO: 553192 - DNA, 360 bp, Homo sapiens
ccgctgctgatgataatgataaaaagaaactagtgagggcgtttaagaaaaagttggccggcaagggtactggtaatggagcatccggaatatcggagaagtaattcagctacagggtgaccaacgcaagaacatatgccagtccctcgtagagatgggacgggctaaggacgatcagctgaaggttcaggggttttaagtgctggtggctcactgaagcttaagtgaggatttcctggcaaggagtagaatttcccttctctcccttgtcacaggtttaaaaacctcacagctggtataatgtaaccattgggggtccgcttttaactgggactagtgtaactccttcaggcgggtacc

SEQ ID NO: 553193 - DNA, 305 bp, Homo sapiens
attagtgatctggagggtacttggtctaaccagtagttgtcttttcacgaacatggtacctgggaacttgaggtaatgagtttggacagagggagtaggcaaggaacagagagcttaaaattgaaaggttaatatcctaagaggaacctgtagctgaatgactacagtgttataccctccaatctttgcaggtgggcatggaacactgcttgtatcaccctgtgcacggtataaatccatatatccacaaaaacacacatccatccatcatcatatacatggtttgggatgagcaggtgaaatgg

SEQ ID NO: 553194 - DNA, 576 bp, Homo sapiens
  misc_feature (479)..(479): n is a, c, g, or t
agcggacatttgtcaatctgcgagaccggttcgccaatgtagtcggccgtaccgtgccgttcgtacaggccgaagacttctgcgattgcctgttcagtattcatcacgcactcccccacagctcagtgatattgcgctcggccatcgccggcccgacgctcatgcccacaccggtgtgcatcaacgccgcattcacccccggcgccgcccgcaggaacgaaaacggccctgggccacgggaaccatagacgccctgccagcgctccacgacctggatcttgcagcccaaggtgtgttcggccagttcgatcatccaggtgtccacttgttcggcattgaacggtgatggatcgctgccgttggtcatgactgaaaaggacgcggtgaagtgccgcgcctttgccaggcccgactggtggtaccttgcggtggacgcggcaccgtcaccggcgtttatcgcctggttcgacacgcagttnatgcgtttgctgcccgctcgccttttgccttaaaacgctgctctccaggacatactcatggacaccaaactgctcgatatcctcgcttgcccgatct

SEQ ID NO: 553195 - DNA, 226 bp, Homo sapiens
gaccggtatgagcggctgtggctctagcgtaggcttgcagctgtagctccgattagacctctagtctgggaacctccatgtgctgtgagtgcggccctcaaaaagacaaaagacaaaaaattttttttttttactttcatggcttttgtgatggacctgggttactttcatatggaaaaaaataacctctgttaaaaaaaatcagtctcagagttctcttgtggtg

SEQ ID NO: 553196 - DNA, 387 bp, Homo sapiens
  misc_feature (169)..(169): n is a, c, g, or t
gctgttgtcaggtgttggtaggaacaaacactaaatgattttgacggccttgagctttttcagacaggaactcaaagggtggccaggtggtcccagggatgccgctttgggctgccagaagccatgctagggttggtccagtctcttggtgcaggggtttggacgcagnactatgtacccaacttctgttagagttatcagtttcaaaccccacccgtgcccccaacaccatccccagtgtggggaggcacatcagtaaatatcagcctcttgacacagatgctcacggacctacacggtggcaaaaaagctcttaaaaatggggccgtgactttaggagcaggggcagcccttgaaccattacccaagttgggcagagcagggaag

SEQ ID NO: 553197 - DNA, 198 bp, Homo sapiens
agatggccgaataggaacagctccggtctacagctccagcgtgagaacggcagaagaccgggtgatttcctgcaatttccatctgaggtacccggtccatctacttaggaagtgcgaacacagtggcgcacagtcacagtgggttcgcgcacaccatcgcgcagcccgagcgcaggcgcgaggctacttcttctacac

SEQ ID NO: 553198 - DNA, 139 bp, Homo sapiens
acaggcagtcgtttaattacaggcacagagccacgacagccggcctcaccttcatgctcgaaggatgtatactctggatatagaattctggatatacagttgttttttctttttttttaactttttatttattttttcc

SEQ ID NO: 553199 - DNA, 320 bp, Homo sapiens
agcgaggccttgaagatggcgcagccgctgagctcgtgagccacttgatccgcgcgccgttgcggcagatctccgccttggcgccgctggtcgcattctgggcacccgaaatcgcgtaccggaagtccgttgccgtggtcgtaggtcagcacgtccttgtggtcgtcgctgatccagtcgtgcggcccagccagcagatccacgttctccttgcggcgcaggcccttgtcggaggcgttgagcgtcagcgcgcacagcggtgagatctcctcgccctcctcgttcttgtccacgcccatgccgtgctccaggctcgtggg

SEQ ID NO: 553200 - DNA, 619 bp, Homo sapiens
tctatgatctgctctggggacgctgatcttttgtgtgtgtgtgtgtgtgtgtgtgtgtgtgtgtgtgtttgcaagtggcgggtggtgcaggagacacagggtttcgctttgtcccctaggctggagtgcagtgacgtgcacatggctcactgcacccttgctctctttggctcaagaaatcctctgcctcagcttcctgtgtagctgggaccgcaggtgcacgtcaccacacccagctaattcttttttatatttttcacgtagagatgggctcttgctgtgtagcctagggtggtctcgaactcctgacctcaagcaatacactcgctttggcctcccaaagtgctgggattacaggcatgagccactatgtccagcctgacagatatttttgtgcatatttaggacaactcaaatatcgctgtctgcttgggaggcagatagtatgcatggagagaaggataggtaaaatgcagaggcctacacagaacattcactcctatgttggaaaacaacgcggttaagatgatggcagatgtcctttcgatctaacgcagtgtgaagatgtatcttgcatgaagcatgattactctgctccgcactctcatactcacccaga

SEQ ID NO: 553201 - DNA, 296 bp, Homo sapiens
gctcatgttatttcattaatttaaaggctaaaatttgtgtccttagctaggcacatacattcattgtttttcacttaatgcactcgtcatttgcatacgacagtggcattctgaccacacttgtacgttgtaacctcatctacttctgatgtttttaaaaaatgacttttaacaaggagagggaaagaaaccccctaaattttgctttgtttccttgaggatgtggcgacatgttttgtgattttatttgtgcgggtctgcccacgttttgttaagggcgtgacagtattggggct

SEQ ID NO: 553202 - DNA, 337 bp, Homo sapiens
atggagttttgctcttgttgcccaggctggagcacaatggtgcgatcttggctccctgcaacctgcgcaccatgagttcaagtgattctccagcgccctctcctaagtagctgcgattacaggtatccaccaccatgcctggccaattttttgtatttttagtagagacagggtttcaccatgttggccaagttggtctcgaacacctgacctcaagtgatccacccgcctcagcctgccaaagtgctaggattacaggcatgggccaccaaacccggccaggtctgtcttcttagctcacaggttgtacaggtctcctgctttctgcctctggaag

SEQ ID NO: 553203 - DNA, 734 bp, Homo sapiens
ggctgcccagaggccgggatccggagccgcccgaagccggtgccgtatgcgccctcgtgtgcccccggatgcccccgtacgtgtccttccggcaaagtggtccggactcgagcaaaattccggcgatgtgttcgggcatgcggtccaagaacgactcagtgctatgaggacattcagcagtgatcccgtgttacacagtgggacagcaccttcgtgcgaccgatgagagcaccacaagttcctgtgacgtgtgattgtggagagatcagtggagggggtggcttctctggctgctccccctaagcaatacgggccgtgttgcctaaggcactatccgtgaaggctggtgtgaggcagaacggtggacctgtgtacctgcgagatcgagctggctggtcactccacagacgagcggaatgatcagtaggcccaagacggcttgccgcgtacggggaaaccttggacccaccagggggcttccccaactataggcgcacttggctcgcgcgcaacgcaatttcacccaagggaaagagacccagggcatggacccttctcaccgggcgtagatcaaagacgcacggagatggtgggaacggtcgcctaggggctatgaaccaaaatgctgacggtggtgcagtctattcagccattgagcaacccgccactgcgcaccggaacaacgcgagcctagctcgattatgcactgggtgctaccacactgtggtaaccta

SEQ ID NO: 553204 - DNA, 457 bp, Homo sapiens
agggaaaggcaggataatgggggagagaatggagagagagaagtggagagtggaaggagagaggaaatagatgcacgagagacaggcaaataggagaggtggggaagaggaggaagatagtgagagcacatgagaagtgaagtggagaataagggtgatggagcagacagaggctgtagggctaaaggtggacaaggggagatcagggatggaatcagtagggagacagcaagagacatgtgcaggagaatgtgaattagagaagagagaggcaaatagaagtgacgaaagttaaaaagggcatgaacagtgagagaaggaggaagggacagaaagtgacaagaatggaggagatagtgaagcgaggtagcgcagaatgctctctctctctctctcgctctctctctctctctctctctctctctctctctctctctctctctctctctctctctct

SEQ ID NO: 553205 - DNA, 249 bp, Homo sapiens
agctgctcttgaggatcccctctggatgcaagtgtactaagccagctagggaagaacacacctttgatcttcagaagtgagcttatgtgcaaacactgggacagcccgctggctccccacaatacacacatggcacacagacacacacaaacacacacacacagacatggacacaggtacacacaagcagacacatacacacacagacacagacacacacacacacatacagagacacagacacacacg

SEQ ID NO: 553206 - DNA, 1530 bp, Homo sapiens
  misc_feature (285)..(285): n is a, c, g, or t
  misc_feature (838)..(838): n is a, c, g, or t
cttgttagctcgcctcgttgtgactcaacgagtcaacgcgctgcgtgcgttgtcctcgtcgtgtcgcccacctacggtgcgtggggaggtagttcgccccccccccccggccgggtgggtgtgggcagtctcctcggcccgctctcttttctccccccataaggagtgtatttccttttctcgatagggcgtcccacaatagtttatttaatatggtctccactagtggcccgccgtgttttctttggcgcctattgagaggcaccacatgttgttgcgccccanagagtttgttcccaaaaagcccacgcttttggacaaaaatggttgtcagaaggcgccacaccccctgtggagggggaatttttgtgcccccgcgcggagacacccatgccccacggggagtgattcccccggtagagaacgtcccctgtgaggtgttgtccccgtgtggcgaccacaggtgtgcacacaggagaacaacataagatggggcgcccaaaacacgcaacactatttgggcgggtgggaaattcccccgccgttgggccccactttgttgggacaaaaaaggggaattttttttgggttcttcgggagaaatactcttgggcgccccttcggggggggaacactttcttttatatctacgcgggacacatttagagtggctccccccgaaattattattctggataagattggtccgccacacttggtgcgcgcctttgtgataagctcattctcgcgcgatattgtgggcagatgatcctttgggattaaaaacacctttttgtgcgagagggatacagtcaacacatcctcaacacaacagagntgtttttgtgaaagagggaaaagagggcgcccaaagagtttctcgcctctccaggaggatgtctcccagatcccacagaagatgtcgacccctgtgactctcagagagacccctacttctcatcagataacacctttatataagcgcacacatttgggcacacttgtgtgtttctgcgcacatcactatccccctgtgtgggccgcgcacaccttatcgcctcacattcacagtctgtgttgtccacagcgtgagagcgctcacaatatatggagatcacacacccgcgtgggtgcgtgcacacctcggccacgaagaaagagaatgggctaaacgctgagactgtccacggtgaggagatccacaaggccacactttttataaatggggaggaaccgcaggcgaggcccgcgccacacatgctggagaacacaccgcggctgaaaggaaagggtttgcgctggctggaacttaacacggccccacggggagggcccacactaactggctgccacgcttttttcacctgaacctttatcttccccaggagagaattaacacgctcgaaggagggccacagagagaaagccctcccccctgagctgcaagtggaagggcaccccgcacgccggcccgggaggaggcggaggtggccaaaaaaacctgggccaatttgtttaaacccaaaaata

SEQ ID NO: 553207 - DNA, 211 bp, Homo sapiens
tacttgagattttgtgtcatatcaatttcaaaacatttgcgatcttggttgagctgcattatctttcctattgtatcccaaaccaaatcttataatcacttcatttaaaatactgagcggtattgaatacttcgaatcttaacaggcaatgtgcagtcctcatttggtgatgtaaagaccctcaggtatgactcccagggttgcatgcttg

SEQ ID NO: 553208 - DNA, 89 bp, Homo sapiens
gcggccgcctactactactactgctcgaattcaagcttctaacgatgtacggggacatgaaataaaattacaacatagctacctggggt

SEQ ID NO: 553209 - DNA, 529 bp, Homo sapiens
  misc_feature (8)..(8): n is a, c, g, or t
  misc_feature (10)..(10): n is a, c, g, or t
  misc_feature (86)..(86): n is a, c, g, or t
  misc_feature (91)..(91): n is a, c, g, or t
gacctcgngncccattgtttttgcctatcccagcaaaacacacacacacgactcttacacacacaaaataaagacacacaaggacnttttngcaacaagaaaagaatctcagttgccaagcagattgatatcacacagactcaaagcaaaagcatttggaacttctttatttcaaaacagaagtgtctccttgcacttagcctttgcagacccttgactccaggggagatgaccttggggaggaagtgtgtcaactatttctttaggcctgtttgcctccgaacctatatgtcccttgatctcttcctcggtttaaattttcaagtaaaaatgaggttttcattgcctcagctattctttctggcttttccttaaaaattcaacctttgctttaaaaactacaactttttgaaaaaaaagaacaaacaaggttccctttgcccatcttaacccaacccattatttttaaatacctttgccctaacctttttttgtctaaaaaaaaattttttcatatttaaaaattaga

SEQ ID NO: 553210 - DNA, 926 bp, Homo sapiens
ggatggtaacggggcagagaggctgtcgcagagtggggaagatgactgccagcaggatgtggatctagagtaaaggacagtattccagtgactgaacttcaacaagtggaccttttgaaagtcatgcatctgtcttcggaacgggtccaacttgttgtgaaaaatgagcttttgcctagatcatccccttgacttttcagcaaatgaaaatttccaggttcagccaagataaaatgaattgggagccacactgagaaagcattcagggtctattttgctccgctaagaattaccgatggcattcagaggcagtgccagcaggtacagggtcgtgccattttcttttcaaggctcaaatgttttcactggatgtaggagaggggtaatgatgagagtattgaatgtgaggatatgcatgatgatccatcaaaaagcgaaagttatgggagagccacacttgagtggtggaaatataaacgtcgggtgtactgtaatagtgtgctgttcatggaaacggaggggctgaatgcttgtgaatagtcatcttcgtactgtaatttgctgtcccacgacatagagtactgagagaaaaaaataatggaatgaagacaagaagccggtggggcccatcggccatgcaaatatgccaaaaccagtttggttgggaacacggccccgacgtcatgcagggcacagcggtgccagaggcaccggacaaaaccagcgagttcccacgaaaaaaatgacgggaccacgcgtatacccacaaagtggtgggctaggggacacaaagtagccaagtaatatgcaaccccgcgggagaaagaagaccaaccacacacagcggacagcgggaagcacccaaaccagagacaagagtagaagaacagaaacaaggagaagattaatcctctgcctagcaaagt

SEQ ID NO: 553211 - DNA, 131 bp, Homo sapiens
  misc_feature (98)..(98): n is a, c, g, or t
ggggacttcctctctcccactcagctcctgagtagcgtgactacaggtctgtgcccccacacctacctaattttctgtattttttttataggaacagntctcactatgtgcccaggctgctctttaactcc

SEQ ID NO: 553212 - DNA, 481 bp, Homo sapiens
ggtattcggcatacatactccgcgtgtagtgagccagttttttctgtagccattatactagagctgatgggatgcaagattgcagtcggcgtcccatcaggatcctttaagtacttctctgcattggttattccagatagccattcgtctaatcttttttcaaggtttttaacttctttgcgatgggttcgaacttcctcctttagctcagagaagtttgatcttctgaagccttcttctctcaactcgtcaaagtcattctccatccagctttgttccgttgctggtgaggagctgcattcctttgtaggaggagaggcactctgatttttagaattttcagtttttctgctctgttttttccccatctttgtggttttatctacctttggtctctgatgggagcaagatgtattgcccccatcagacacgtcttggactctgtttttgataaccaacaaaggtcaatgtatagaaatcc

SEQ ID NO: 553213 - DNA, 183 bp, Homo sapiens
gcttgatatcgaattcggcacgagctgacattctgattcgaatgacactgaccaggaatcggaatcctgtcgattatactggacagcttgtggcaagtgaatttgcctgtgacaagccacattttttaaaatttatattgtaaatattgtgtgtgtgtgtgcgtgtgcatatatatatatatg

SEQ ID NO: 553214 - DNA, 765 bp, Homo sapiens
cggacgcgtgggcgtgcacgcagttcccaacacttctcgtcatcctctctttggtctcttgattctgctgagcggtgctgtgaggatttcttttttattttattgatgcccctgaaccaagtgcgaaatgcttggtgggaaacggtctactacatttttaactgggaaagtactataatccatgttgaaatttgtggctttggaaggggtccatccgtgtttccctatgacagtcttctgggaaggagctgcctctgaaatactcttcttctggcttacatgaagatctctaaatgctatccagcaggaggtgctacagcaagataagggaaattttggaatttggagggtctggctaccttattacagctcgtgctaagcttcagcttaagcaacaggattaacaccttaaagttccagaaagatttggaggggctaaaaaagctgaaggagagccagtttccccaaaattgctgcagtgagaagaggagttggtaactttaaacagaggctgaaaaacttatagaattagcagagaacgtggaaaaggtagaggatggagtggcaggactctacaggaggctcttaaaggtggaatatcaggttcaccagaaaatgggtgtgctcaattgaagcaggatccaaagaatgctgatttaaagaaaacagcttcatgaactccaagccaaaaatcaaagctttgagtgagaaaccagaaagagtagttgaacaagctagggaagaacctgaatagtaaagcaagac

SEQ ID NO: 553215 - DNA, 100 bp, Homo sapiens
gtactgttcatcagtatgtatgacttcatagtaatcccatcataatcggaggttttggcaactgactagttcccctaataatctggtgcccccgtgtggt

SEQ ID NO: 553216 - DNA, 335 bp, Homo sapiens
  misc_feature (154)..(154): n is a, c, g, or t
  misc_feature (294)..(294): n is a, c, g, or t
  misc_feature (300)..(300): n is a, c, g, or t
gatagcagggtctcactgttgctgaggctggagtgcagtggagtggtctccgctcattgcatcctccgcctcccaggctcaagcgatcctctcacctcaaactcctgagtagctgagactacaggcacgttccaccacgccggctaattttttnaattttttggtagagatagggtttcgccatgttgcccaggctggtctcaaactcttgagctcaagcgatctacctgccttgggctcccaaagtgctaggattacaggtgtgagccactgcacccagcctatatatctaanaatggnattttttttttccctgcaaaaaaggtttaaaaaca

SEQ ID NO: 553217 - DNA, 842 bp, Homo sapiens
tcgatggaccctgccccgggggctggagctgtccccgtgagtgagtggacccccatacatgacccgagttcttcagctggctgggagccgcctggtcacttgaccctgcagatgcctgcgcctgggagtgacccagttgagaaacatgctacatgcactgatgcgggagggctgcctggcaaggcaaaagctgccccccaggtgtcggcttgtcaactgtgtcacctggatgactttgtgatgcccatgagatcttggagcctcaggcttggagtcaggaggacatgccaggaacaattggggtccttggtgtaattattgactttcccatgtggccctgcaaacatgcaggttgaggcttgtcggggtcaaatgccatggctgggtggacggtacttggaatggtcctttgggaattgacatggtctgtaagggttggttgcgcaatcgtgttctgtgtagaccccaaggctgggaggcaagggagggtggcatattgttgccccttaacaacaatcctttgaacacgccttaaccccctggaacccccctggctttgcgaccgactatgcccaatagagccgcttgcctctgtcaaggcccttgagacaagtcaacttcccttccttctcagcccaacaccaaggcccccaggccccccctgtggccccgaagcctccgaggcatcgttgtgccttcgtggccccgcgtcttgggggaccaggtgcccccggctttggtgaccaggcttgcggaattatgcctatcaaacgggactttgggacccccaagcgaagaaagtgtaggaaagtttctcccgaagatgctcattcgtcaacgta

SEQ ID NO: 553218 - DNA, 455 bp, Homo sapiens
aggccaacaatcaacgttattatttagcatttctggaagttctggcaaatatgttaagccaagcaaaagaaacaaagacaaaaaattgaggaaagaagacattgtttttatgtgtggtatgattattacatcaaaaccccaagaaaataattattacaatttataattcaaggctgggcacggtggcccacacctgtagtcccagcactttgggaggctgaggcgggcggatcatttgaggtcaggagttcgagaccatcctgatcaagatggtgaaaccccatctctgctaaaaatacaaaaaaattagtcaggcgtggtggtgggtgcctgtggtcccagctacttgggaggctgaggcaggagaattgtttgaaccctagagcagaggttgcaatgaactaagatcatgcccctgcactccagcctgggtgacagagtgagactaggtctca

SEQ ID NO: 553219 - DNA, 1315 bp, Homo sapiens
  misc_feature (522)..(522): n is a, c, g, or t
cgccgtcagaaggggtcctggtgacagagtcccgcgttctctccttgaatccacttcgccagcccgccgtcctctgccgtcggaaccctgttaacactcggccctcaccgtgatgtcaggaacttgtctgactacctgcatcatagtctctatccaatattcgagtagctgatccccggagtcacaaaataggacgcatgacttgacgattctgctcacgcgctatctgttgagcgaaccgtgggcacaagggccaatccgtagagtctgacgaggatgaggtccacgtagcgtgatcaattgccctatggcagggatagacagacctaattgagcaaccgttaccaatatcgaggtgtaccgaacctgggtcgtcatctctgtaccgccaatgcgtgcaatgcgagatcgacgatgacctgaacctgtcgtatggaacctcacccatgcgagttgggggtgggatgtccagtcgcattcaattcaccaaattgaggaccaagcgtcgtaactcaagaaacnacgcgggaattggacatggggggctgatcccccttttttggcacgcccaaagggcgtccaatcgaacacttcgccgagagggaagtccgaggatggttgtagctttgcgaaggcaactcaaaagtggctaacgtaacgactatggggtacggattgtggtacactctctcattggagccccatgggaggaagcccaaacaattggcgtcagcaaagcaccctgagcgcctgaatcgcacccaagggcggatttgggcgactccgagttggccgtacggattcgtcggcaagggcaggcttttggctagacccacccaatggtttacaacgaacattgcaataatggggaaaccagaagtaccgtccgtagcggatcctattagcatgagaccccaagaaagacttgggccgcaccgataatgggaaatggctacggcactttggaacacagccaattaacgggcgctgtgtaataaacagtaggacaaggatgcacccaacacctaattccctaagaggggccacacgtaacatgccccgacaaggtagcgaacttggggggaccattgactaaggttgggccccgtggagatttggtggatccattgtgtgggcacacacagaatgataaaatatgtggccccacgcgacatttagtatccaatgggaccgtgaataaccaaagtaagacgtatggtgggagaagatataagcattgggcccacaatggataccagaagtaggcggaacgtgatcgccattggtataagggaacttccagcatttcgccaca

SEQ ID NO: 553220 - DNA, 198 bp, Homo sapiens
aagccgtatgttaaaataaacagggcacttccaacaggcagtagagaaataagcaaaataaattacagcagtgtaatgggttaatgtgttagagaataactaggactgggacatgcatctttgactaggtggtcagtggaggcctctcagaggcagtaacacttcgcacttgcgggagacccagcacgaagcagatgg

SEQ ID NO: 553221 - DNA, 989 bp, Homo sapiens
  misc_feature (610)..(610): n is a, c, g, or t
agcggaagatgatgaagatgcccctatgataactggatcttcaggatgacgtccccatggtgatagcctgaacgagctttcctcactagaaaccaaatggtgtaaatatattaatttgcataagagatagtatgatggtttattttgataaaggatgcacttatgaagattggcaatatgtgattgtatctatatgggccaaacagacgagaaagaacgaagaaaagaaaaaaaagggaagaaaagggaaatgaataagacttggtgaggtaatctagagcgtgttgaaacttgtagaaaccaagggttgtggatctttgagtaatacccaattgtggtctttcggcatgtggacacgatgtacagtggtagttctgttcacaggggtctggtgactatgtgcagtgcggccgagtgctttaaaacgtttcgtggtaacacagatcaatgtcacgggctgtccgacggtaacactactcggggccaaaaaacgttctgtcatatatattttgcatataggcagcgaacagacaaagggtgttattcttgactgtaaattacaacccatgctaacgacagaaagttgaacgtcgggagtgggaataccccngccattttcgtccagtgtgaagaaacgttgtggtgtttacccagtacatttttaccagttttctggagtttcgggaaacctaattaggtttatgaaaggggtacatagtgtggttgctgtgaagttgctattttagagacggcgggaaagaggaggatacccagaatgagcgtgagttgaattcacgggggtaacactccttctaccaatggggggaaaacacatcccggggggacaagaggggcacaagggtgcataaacgaggttggggcgcatccatgttaagaaaacaccacaaacatggggttgtaatagaaggaaccgccccattatacggcccaataagggggttggggggagggtggcgacaaaccgcaca

SEQ ID NO: 553222 - DNA, 584 bp, Homo sapiens
cgtggtggttcacgcctataatcccagcactttgggagcggatcacgaggtcacgagatcgagatcagcctgaccaacatggtgaaaccccgtctctactgaaaatacaaaaattagctgggtgtggtggcacgtcgcctgtaatcccagctaattcttgtattctttagtagagacggggtttcagcacattggacaggctggtctccaactcctgacctcgtgatccacctgacctaagcctcccaaagtgctgggattacaggcatgagccaccgtacctggtcgatggtaaaattttaagctgactcttttaaaatgagtagaatctatgtataaaacaagaaaaatgactagcattctccagcatatactaaggacaataatacaatacgtgggcaaaatacaacctggcacaatgacctacatcagtctggcaacagccagagtaaaccaagattgctgaacgcgcgactgacctagttactggtgatgctatcacttcagcttgaaacacatgactctagtgtcccagctgctccgtcgggaataggcccatactcataggaataaacaccctcctg

SEQ ID NO: 553223 - DNA, 540 bp, Homo sapiens
  misc_feature (351)..(351): n is a, c, g, or t
ctgcggggctgccctggcccccggcccctcctgggcgccctggtcccgctcctggccctgctccctgtgttctgctagacgcgtggatgtggagggaggcgcgggctccgtcctctcggcttccccatgtgtgggctgggaccgcccacggggtgcagatctcctggcgtgtccaccatggccccgcagaacgccaggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaancatcccctcaggctgaagccgcgcgccgagcgcgcccaccgaggatgacacactcgggaagccgtcaggatgtcagcgtcgtttccgccgcgtcgacaatggcactagaaagggcaccggcccgtactgcgtgctcgcatgatccagctggggcccacctgtagccctagccacacagcacagcgacag

SEQ ID NO: 553224 - DNA, 506 bp, Homo sapiens
ccatgcaagaaatcactaactgccctacaccaggacaggaaggaatggcaggatggcgctagaaagctcagagctgggccagagcaagaggtgtgacactagccaaagacgggctctgactctgatccccaccaggagcctcgacagccacccactccaaccaccaagaccatggtacaggacacaagcgacacaagagcacaacacacaaccaaaggaccaggcgccaacccaagcaaacacagccaagggacggaataaaaccaataacacgcacgacacgggccacgaactgtaacggcaagacagcaaccaaacggagacgcccccccacaggaacacagcagccccgcaccacacgaaccacgaaagaggacccacaagagcccacaaccacacaaacacgcccacatacaatacacacccaagaaaccagagagaagagacacccaccaagcagaaacacacggacaaacaacacaagacacctgactggccccccacca

SEQ ID NO: 553225 - DNA, 302 bp, Homo sapiens
ataatgcttgtggacttcaggtccaatggtctccagaggatgaaagctggagtctgtacactgtcctactagagacagcacagccaacctagctagcaccatttgtattagactgaacaatatatactaatagaattcagtcaaagatacacaatctgaaacagctacatggggtgtactctaacagtggttgcaatgtattagaatgagcattacttctctgctcatctagatctgcactcctaggcctactttattcagtcaagccccaggctaaggcaaagccagtacacataaaagtt

SEQ ID NO: 553226 - DNA, 863 bp, Homo sapiens
  misc_feature (610)..(610): n is a, c, g, or t
  misc_feature (623)..(623): n is a, c, g, or t
  misc_feature (746)..(748): n is a, c, g, or t
  misc_feature (765)..(765): n is a, c, g, or t
  misc_feature (809)..(809): n is a, c, g, or t
  misc_feature (818)..(818): n is a, c, g, or t
  misc_feature (820)..(820): n is a, c, g, or t
  misc_feature (823)..(823): n is a, c, g, or t
  misc_feature (831)..(831): n is a, c, g, or t
caccatggcattcctttggcttgtgtcctgctttgcccttgtgggcgccacctttggctgtggggtccctgccatccaacccgtgctgaccggtctgtccaggatcgtcaacggagaggatgaatcccctggctcctggccctggcaggtgtccctgcaggacagaactggctttcatttctgcgggggctccctcatcagcgaaaactgggtggtcactgctgcccactgcggggtcaagacaaccgatgtggtggtagctggagagtttgatcagggctccgatgaagagaatgtccaggtcctgaaaatcgctcaggtttttaagaaccccaagttcaactccttcaccgtgcgtaatgacatcaccctgctgaagctggccactcctgcccagttctctgagactgtgtctgccgtgtgtctgcccactgttgacgatgacttccctgctgggacactgtgtgccaccactggctggggcaagaccaaatacaatgccctcaagacccctgacaagctgcagcaggctgccctgcccatcgtgtccgaggctaagtgcaaggagtcctggggttccaagatcaccgatgtgatgatctgcgcaggnccagtggcgtctnttcctgcatgggtgactctggtggccccctcgtctgccagaaggacggagtctggaccctggcaggcattgtgtcctggggcagtggtttctgctccacttccacccctgccgtgtatgcccnnntcactgccctcatgccntgggttcaggagatcttggaagccaactaagtacacggtccttncctcttccntnttnctcccccnccgtgcatctacaataaaaatcatctaattag

SEQ ID NO: 553227 - DNA, 491 bp, Homo sapiens
  misc_feature (161)..(161): n is a, c, g, or t
tcttgaggatctccattggatatgcggatagggcgaggggtacatctaagagcaacaccattccaggcagtaggaaaggaaagcagcaggctgtctcttcaaagagggcaatatcaagatcttgttcttcatcccctgctgaaagaccgaatttctcctgntcttacagatgaccaagtcgtgccactgcaccaccacgatactgacgaagaaggctgtgtggcaggtgaactccacgattttcctctgctcataggtccactgctgcccgtagctgtcttccacatcgttgatccagcggtcatcccagtccactcggaggcccaacaggtgaattgggaggaagccgttctcagccagaatcacaaagtaagtaaagaagcctcccaggggctggatcattccaatctggccataggccatgctgatcagccgctcattcacaagtttgtctgttttgggatttctaggctgtctcttcatgatgtcac

SEQ ID NO: 553228 - DNA, 626 bp, Homo sapiens
agctgtatctgcacccacagcgagaaagtccctagggagtattctgaccaaagtcttggtccttgaaggagaggcatagtcttctaattgctttgatgaatcacagaccaaacagtgattcagctctgaaaaaaaccttagagatgggcattccaaggtctcatggggttagtagcagaagcaggactggaacccagaacccaagttggaccactagactggtgcctctccctaagcccactctgcctcttccatgtctgtgaatgagcttaccactcctagctatgcaaaactgcatagaaccatttcagcaagaggctcaggtagcattaaagaagttcccacctcaacgatgtcaattttttgttactgttgtcttgaggaagcatgtttgcttttaaacgctcccaaattaaaagccattctcagccttcctacaattgtatgtgcgctgggcgcagtggctcacttctataatcccagaactttggcaggccgagccaggccagatatcttaaggccaggagttcgagaccagcctgcacaacacggtgaaaccccacctctactaaaaatacaaaaattagccgggcgtgttgacgggcacctgtaagctacccaggagg

SEQ ID NO: 553229 - DNA, 651 bp, Homo sapiens
ttatccaccttgttttgtcctaaagaagatgacctcaaaggcttcaatggtgatggggtcagcacgtacaagcggcattttggtgtagtatttgaagagaaaatgcctagcacagacactatcttgtcatgaacagtatggtgttgatattcaaacagtggtgcagagtggctctgttgacaatcaatggtagcatcccccgctctcagtatggagaaattggcaatggtccctacagctcatgtggtgcattcacctggatgcaatatatgacactttccaaaagaaatgcaagtcagcatttgccacatattatatttcatgatcgctgtcaaagttcaagtactagcacctttggatgctgcgttatcacgcagcttggtatataacctgggcaaggctacagctttctaaccggtgtcccacactatgggcatgttccttgttgccacaagtcaatgttgccttaggcttatgtcatcacatttatgagcatttcagcttctcataatattcagagataccttatgaatatagaccgctccttcttccgtggttcacttgcgctggtgtaaaagccccccgctctctaaggtgccttcccttcttgaatcaagctgcctatcttgggtgtgcgagtgttaattaaaa

SEQ ID NO: 553230 - DNA, 108 bp, Homo sapiens
  misc_feature (32)..(33): n is a, c, g, or t
cggctcatgggggcgcatcacatcttctcagnncacaaactcattctcagcagctgtgcggcggttaatttcatcttcgtacttattcttgaagtcctccacaaagcg

SEQ ID NO: 553231 - DNA, 652 bp, Homo sapiens
  misc_feature (15)..(15): n is a, c, g, or t
  misc_feature (61)..(61): n is a, c, g, or t
  misc_feature (80)..(80): n is a, c, g, or t
  misc_feature (165)..(165): n is a, c, g, or t
  misc_feature (211)..(211): n is a, c, g, or t
  misc_feature (293)..(293): n is a, c, g, or t
  misc_feature (321)..(321): n is a, c, g, or t
  misc_feature (330)..(330): n is a, c, g, or t
  misc_feature (340)..(340): n is a, c, g, or t
  misc_feature (348)..(348): n is a, c, g, or t
  misc_feature (350)..(350): n is a, c, g, or t
  misc_feature (354)..(354): n is a, c, g, or t
  misc_feature (356)..(356): n is a, c, g, or t
  misc_feature (361)..(361): n is a, c, g, or t
  misc_feature (366)..(366): n is a, c, g, or t
  misc_feature (392)..(392): n is a, c, g, or t
  misc_feature (399)..(399): n is a, c, g, or t
  misc_feature (403)..(403): n is a, c, g, or t
  misc_feature (422)..(422): n is a, c, g, or t
  misc_feature (434)..(434): n is a, c, g, or t
  misc_feature (449)..(451): n is a, c, g, or t
  misc_feature (496)..(496): n is a, c, g, or t
  misc_feature (502)..(503): n is a, c, g, or t
  misc_feature (506)..(506): n is a, c, g, or t
  misc_feature (508)..(508): n is a, c, g, or t
  misc_feature (515)..(515): n is a, c, g, or t
  misc_feature (525)..(525): n is a, c, g, or t
  misc_feature (571)..(571): n is a, c, g, or t
  misc_feature (630)..(630): n is a, c, g, or t
tgtccttactagtgncacattcttgctgaagaacaagttctctggaagtgaaactcaaatnggggagaacaagagatacnggtaggtatcagttctgctagggtcttcagggagcccgggggccccaaaacagtgctactcaaagatgatctgcagacttgtgcnggtcagtgaacacctttttttttttttccccagtctgtgacgtggngatttagaaattgggggtgtttaaaaactttttagcatttcaatgttgctgtgatatccaagtacatgatcaatggccttancctacagaacagtctggccagtttgggngctgtcaancttgccgggncggcagcncncagngngaacnccatncctgtcatcggcaataggaatgcatnttgatangtgnggggctggaaaacaaaaancctggtcctttnccatacatagtttgnnncagcctgccctagggtcccataactcccccacaagtcctggaatncttccnnaantntttggcncccagtctgncctggggtcaacctgctcactttcaatcaaaatcaaaataaaaatnagtgccttgggaacaaagataaagtggactagggcatctatttagattcctggagtaanccctggctaggctagcagaagt

SEQ ID NO: 553232 - DNA, 241 bp, Homo sapiens
gcgatagacattgtatcccagagcgaaacacatacatattaaagttcacgtataacacttcttcatcatattatacagttgctcagaattcattttctgacatattgtaaatatagactttttcaaataaaactgttacattgttttttgaaatgtatcaagtggtatgtaacatacccttactgaattgatcattaccacgcccaggtaattttttggcttttttttttttttaattgct

SEQ ID NO: 553233 - DNA, 159 bp, Homo sapiens
accgatttgcttaaccgggctcctcacgcccgtaatcaatatagagggagggcatgtgcgggctgtgtgtgtctgtgttagggcggtctggacttggcagtttcttgctcccagcacccggcccctcctcacctcttccttattccatagctgagagag

SEQ ID NO: 553234 - DNA, 941 bp, Homo sapiens
  misc_feature (12)..(12): n is a, c, g, or t
  misc_feature (522)..(522): n is a, c, g, or t
  misc_feature (563)..(563): n is a, c, g, or t
  misc_feature (941)..(941): n is a, c, g, or t
taaagaaagaantttaagagctgtgagacagaagcaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggtgcttagctatctattttgttatctattgttgttgctcaaactgttcaagctttggccattgggagctctttcacattggctcttgtgtacttttggcatgccctcatccactttgtttggagcacttcttctttctggcaccacaggatgctccaggctcatcttgtgttttcttctctgcattggccctagacttagtcatttctcctaggagccctggttcttttttttttttttttttttttttgatgaatggccttagaaccaagatcttggtgatgggtgtgctcattgctactgtgatgacactgcttctcccattctanatgaacagaactaggaaatatatgtatgtgactaccactgnatatacatatccttttatgtcctattgcatattattaactaacattagttcctgacttaaatgatgaggtctgagcccacatttatctgcttatttcccaactctatatgtctatttcacaaacattgcttataacacgatcacaccaaagccactatatttactgatcaactgtcatttctaccttgctcccttgtattgaaactattggcaggactaactaattctcctttgccaccgaacggaacatggagctccgatacgaaaacctcactgcgcgcgttgcttctctgaatataccctccaacaaaaactccccctgcgttgcgtctgggacatccccagcacgtttcttcgtaccattattttatcacttan

SEQ ID NO: 553235 - DNA, 201 bp, Homo sapiens
tttgcatcagttgcgggagaagcccgggtggctctacaagtgagagcaggtacacagacagaggctgacagagccctgctccctctgctctagggggtagtctagggagccccagctcagaccctcccaatgcttatatgctgaagctcacagaatgggctatcttgcctgacagcaagtccaagaatgagtttaatatca

SEQ ID NO: 553236 - DNA, 140 bp, Homo sapiens
gaccaagtatagcaagcctctaaaaggactactgagaaacagaatcagaaactctagattccagttgtatttgtcacctgggttgacatgaccagacaggcttttccaggcctgggtatccagggaggctctgcagccct

SEQ ID NO: 553237 - DNA, 1375 bp, Homo sapiens
gggcaaatggcggacttcgagagctacgacgatcgggcctacgaggagcttcggcgtgcggtagagggtcccggcggctagtgcgtggtggcctagtggttcccgatagccctagaaggatgttggcccacatgagccccccgtacacagcatacgtacggaaatctacctttcaatacggttcagggcgacactgagcatgcgtatctttgaaggcagtctcagccactaacgcgagtgttacgggctaggtcagagtagcaatagaacgcagataaatgttaaaggacttctgctaatgatagaacttcgactgaaggtggcattccgcgttaacggaaggccttgcacagtagcagatggtgcactggttggggcgactcggtctactatcgatggtggacgagttgcacgataggcgaggaaaatcatagcactacaacggtgcgcttctgcgagttcacgaaacaggtgagacccacgatcgcacagaaggagatcgcggtaggactcctcggacgaattctacggacgcgtggactcgtggcactctccccagtgggatcgcacttacaagcttcttggccgttcacgagcgcattagcaccctaccctgcaccggacgcgcggcacacggcgcgaaggtctaaagatacggcgccaatcgccgcatgccgcagcggaaaacacaaggagcgccccccccaacgagcgcaacgccggccctcccaccgcacagcaatccggcccacactccccgctcccaggtaggccgacatccccacaccaactgcgacttcccaccgacggaacaccccaaaacgacgacagagagggacacacacgaaggcccccaaggaacgacgcgaccgacacacccacacggctcacacaccccccgcaaacaagtccggcggaacgccccccatcaaacccaacgagtaccacacagcaaccccaacatccgaggcacacatcagcccggggcggtcgctccaccgggccataccacccagggaaccaccccgggcaccaaccacacggaccgcaccagaacaatgaccgcccccgtcccggctaaggacgcccgcgcaacatggagacccaggcggcgcgcacaaccaaagccaagcaccccacacaacaccacggaagcacaatcacagcgcgccagacggaaccaggacccaccgacgcaactacgcagccccccccgcacagcccaacaacagaccaggaaccaaccgcataagacaaaatagcaagaacggctacacccacgcagcccagccacacatagaaacgaaggcacaaacaaaagacgcgagacacgaaccgacagccacacacaccccaccacccaacagcacactgg

SEQ ID NO: 553238 - DNA, 200 bp, Homo sapiens
tcactgaggctgaagtacagtggcgtgatcatggcgcactgcagtctcaacctccggggctcaagtgatcttcccatctcagccttccaagtagctggggaacccaggtgcacaccactacgcctggctaatttttgtattctttgtagagatggggtctctcccatgggcacagtctcattgtttctatagtttattac

SEQ ID NO: 553239 - DNA, 1143 bp, Homo sapiens
gtctgaagtgcggggtgtcattcgccctaccgcccgacggctgcttgtagactcccgtgcaccgctgctcatgtaggagtcagcgccccgtaggcttgtcgccaaggtatgcagcggctgattactcaggagaccaagctgtgcctgagtgtaaactacaactgtctagcctagccgtgtccggagaagccgtgatgcgtggatggtagcaagaccgaagcctgcacaacgaaatagtgatactctcagacacaccgagaccagactcggcagtgaatcctgctgttaccgcaagtcgcgttgcctatcgacactgtgaactagaggcgattggaactgagattgcgcttggccttctgcctaacgcgatgtatggggctagaaagtctcgtggtgctagttcgggtggactctcatatgcgagggagcacgagcggggctcaatatgattcgtacctgttcgacccgtgttggaacatcgagagctaaacggggaagtgtgacgtgtcttggagaaagctagctggcagtgcatgtagccacgcctggggacgtcgagagtcgtacatgagcgtatttgagtgcctgagcgtgggttaatccctatagacctgatcagagcccgtaggcaatctgagcagtgccgtttagacgctttcgtgttgtgccgctggaaggctcctggtgtcgactggccttttgcgtgccctcacagtcccgttacctccctagatcggctagtattgtgcttagcatccgtgagtgctgcatgttggccatgactggatagctttagtgtaactctaccagtcagacgacttggtcaccaggagcgtggaaccgtaccaacgcggcatattccctgaagccacatgctgtcactgaggtccaggaggcgttatgtgcccaaaaaggtttggtggtcggctaacaccattttcccaggaaggctttagaaaccgaagcacggcataatagggggataaaggagtcagagatgataagccaatagtagttgtgtggtggagaaaaacacatcgaggttgagtgcacaacaacgcgctgtgatatagcagcacatatacgactgacgagtcaaacacaaagatgacgcgtagcgacagacacagatcacagcagata

SEQ ID NO: 553240 - DNA, 269 bp, Homo sapiens
ggtggatacggatgggagggggatcgctgatgtggcctggggtcggctagggagtgtggtccctacccacaattctctcacccgagtaccctctctgtatctaccaggggtggtagccatgtggctgccccatttatccacctccatcttctttgcagcctgggtggctatgggtacttcgtgggcgcacatcctacagttggaaatccatccagaggtcatgttccaataaacaggaggtcgtgtatttggtcacgacatttctctga

SEQ ID NO: 553241 - DNA, 168 bp, Homo sapiens
ttcagtagtcgtcagctcatttccctcaagcgggtggtgacgtcgtagaaatggcaaggctcaaacttccaagcacttgttatacacttgtaacccagcttgggtaatgggacacgcatcaaaatcagatgaacaagggacggctgttttgcagtcagcagtggggtt

SEQ ID NO: 553242 - DNA, 362 bp, Homo sapiens
  misc_feature (24)..(24): n is a, c, g, or t
  misc_feature (73)..(73): n is a, c, g, or t
  misc_feature (98)..(98): n is a, c, g, or t
  misc_feature (106)..(106): n is a, c, g, or t
  misc_feature (134)..(135): n is a, c, g, or t
  misc_feature (148)..(148): n is a, c, g, or t
  misc_feature (151)..(151): n is a, c, g, or t
  misc_feature (170)..(170): n is a, c, g, or t
  misc_feature (175)..(176): n is a, c, g, or t
  misc_feature (218)..(218): n is a, c, g, or t
  misc_feature (247)..(247): n is a, c, g, or t
  misc_feature (294)..(294): n is a, c, g, or t
  misc_feature (324)..(324): n is a, c, g, or t
  misc_feature (348)..(348): n is a, c, g, or t
ggtgcacggaggcgctggcccttntgtggctagaccgagcctgtgggatataccacggcagaggagcccatanccatgaggagcctctgggccctgcncttgctgntgagcgcctggctgtgggtgagcgctgnncctgtgccaacgncgnccgacaacattcaagtgcnggctnnaatatctctcggatctatgggaagtggtacaacctgtgcatngggttcacctggccctggctgaagaagancatggacaggatgacagtgagcacgctggtgctgggagaaggcgctncaggcggagatcagcatgaccaggacttgntggcggggtgtctgtgaggagacntctggagcttatgg

SEQ ID NO: 553243 - DNA, 421 bp, Homo sapiens
  misc_feature (18)..(18): n is a, c, g, or t
  misc_feature (60)..(60): n is a, c, g, or t
  misc_feature (85)..(85): n is a, c, g, or t
  misc_feature (174)..(174): n is a, c, g, or t
  misc_feature (200)..(200): n is a, c, g, or t
  misc_feature (383)..(383): n is a, c, g, or t
  misc_feature (394)..(394): n is a, c, g, or t
aagggtatgcggacgagncaccccagtctgagatggctcctgcggttgtgagcctgaggncaccatcctctgcctcctggctggntggctggctgcaggtgaccgggtgtacatacacccttccacctcgtcatccacaatgagagtacctgtgagcagctggcaaaggcaatnccgggaaggccaaagaacccaccttnataactgcttcaattcagggcaagacattccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtncatggggccancgtcctcttcccaacggctgtctttgg

SEQ ID NO: 553244 - DNA, 675 bp, Homo sapiens
ccaccccactcttaatcagtggtggaagaacggtctcagggataatattcatttagccttctgagcatacagggcagacaagaagatgcaagcaaagaaaaaacggagccaagcaaagaccgcaaaagactagagaacaagcacaacacaaccaccaaagcaccacagcagcagcgcaacgaacagagagagccaggagcgccgggcgacaacaacgaaaaggaaaagacagcagaagaaaacaaaaaaggacacaaagacaagacgaaaaaaagcgcagacaggaaaaaaagaagacaaaacacacaagacagcaaaaaagaccagaacaagagaagaaagagaaggacaacgaaaggaacagacaaggcagacagagcacaaaaaacagagaagacaacgaaagaaaaaaatgaacaagaacaaaagaaaacaaacgaataagacacgaaggaatagagacaagaacacaaagaacagagagacaacagaagaaaagaaaacggaacaagaacgacaacaccaaaaacaagaagaaagaagaaaaagacaaagtaagaagacaaaagacaacaaaaacgaaaacacagagagagaagagagaaacagaacagagaacggagacaaacagacgaagaaacagagagaagagagagagaagagagacaagagcaa

SEQ ID NO: 553245 - DNA, 476 bp, Homo sapiens
agcttacccttactggatctcagacgtccagtcctccagggctgtgggagaatcaatgtgtttggtctctaagccgtccagcctctggtattctgtgacagcagcctgagatggactaagccgtctcataagaagagacgatgacatgtacacagacatagggaggatcctgtgaggacactaggagaagagggtcgtctccaagcccaggagaggggcctcaggaggaaccagcactgcccacacctggatctcagacctccagcctccagggctgtgggagaatcagtgttttgtgtctaagccgcccagcctctggtattctgtgacagcagcctgagatggactaagccatctcataagaagagacgaggacacagacacacacagagggacgaccctgtgagggcacagggagaagacggcgtctccaagcccaggagaggggcctcaggaggaaccagccctgcccacaa

SEQ ID NO: 553246 - DNA, 1878 bp, Homo sapiens
  misc_feature (393)..(393): n is a, c, g, or t
  misc_feature (404)..(404): n is a, c, g, or t
  misc_feature (408)..(409): n is a, c, g, or t
  misc_feature (411)..(411): n is a, c, g, or t
  misc_feature (423)..(423): n is a, c, g, or t
  misc_feature (425)..(425): n is a, c, g, or t
  misc_feature (443)..(443): n is a, c, g, or t
  misc_feature (445)..(445): n is a, c, g, or t
  misc_feature (465)..(465): n is a, c, g, or t
  misc_feature (470)..(470): n is a, c, g, or t
  misc_feature (489)..(489): n is a, c, g, or t
  misc_feature (492)..(492): n is a, c, g, or t
  misc_feature (495)..(495): n is a, c, g, or t
ttgggtccgggtgcgtggctggaggcagcgagcgccgtatcttccgggcccgcccatcggggtcccctaccccattccggaccccggcgtgcgagcgcgcggccccggtatcacccgcctcccggtcatggtgctcaaggccttcttccccacgtgctgcgtctcgacgtgacagcgggctgctggtgggacggtgggtgccggatcagatcagcgccgtggtcctggcgttcctgcactttcccttaatccccatccaggtcaagcatgctcctgtgcccaggtgcggcaggccagccaatgtgtggacgtggccgtgctggtgcacctgtgtgccactgccggcaggagacccgaggagagcctgggtccgcttcctggagagcctgggtngctgtcttccnccannangccctggctgcngntgtgccgggagagaggcngnacgttctggagctgcgaggncaccnaccggcaagcgcccactgnccncgntgcccctggtgaggaccaggtcatgctcatcttctatgaccagcgccaggtgttgctgtcacagctacacctgcccacctgtcctgccctgacctgccaggctggagccaccactgccagcaacaggggtggccatggctgcctgtcttcgacacggatagcactgcagtgagtgtgctcttccagacagatgaccgcatttgatgagtggccccgatgcggctgaggccacatggacagtacggagggcgtggaggaccacgcatcctcgcggatgctggcacaggcagacacctcgaggacccatttgtctgcatgttcggaccagacctgcatgtacgcataggtctacaagactgtcacgatgcacttgcgcgaagtggttcaaagggctactgggacacccatgatcctatacctacgagggacgcaaaacatcgtcacaacggtgacggaaacaggactcctggcaacccgggctgcgagaccaccatcacagctacatctacagctacaacgtgacagggcggacgaaaacccctgaccacaagcgtgaaatgcaggaacgggccaaccaccgggagagacctcacttgatgactcgcttggcacagttggccccttgggcacatcaatgcctgctgtccctgagcatccaccgggggaggaaagccgagatcggggcattcatgggcactgaacgccacaacggctccctgtgggcatgaacacgttgggcagaaggacgcatcaaggacattacgtgatggcagataggcatagaactggggatggatcacacgcctggggactcacgaatgaacccactggtgcgcagcagggtacaccacggttgcctgggggaacgcagtacatagccatatagcacaaaatccaacatggtgtgaatacgtcgttacaaatcccagccatcaatgtatgcacacataccgtagtgagcacaacatcgcattgcggaccgttggcgcatcatcgtagcctggtacgtggcaccaatcaagtgttgcaccatgcgtaccaacccgacgctcgagacagtagacttgcagcggccctataccggttacaacaggtcaacggcggggacgcagacacatcagtaggcccacatggttactctcacgaaagcgaccagtggcaaggagccacaagcagcggtcatagaccgagcagcacttcagtcagtgactaacagctaaacagaggtcgtacaagtacgcgtagcctgggcagagcaccgaggcacagtaggcacaaagagataggctagaagcatagaggtcagagcagacgagtcgacacctatgcagtaacatgtgtccttctctccttcgctcgtgctctctctcgccaccaacagcg

SEQ ID NO: 553247 - DNA, 797 bp, Homo sapiens
gacggggcactggggaggcagggttgggtccgcctcgagcggggagggtgatgctgcaccacagggcggggctggaggtaaagcgcggagcggagagggaccaggctcggactgatttgtgtccaggctagcccagaggggcgggccagatcatcagaaaagcccttactgaggaaaaacgtgtctcaacaaaaacatcagctgcagatcttgtgacgagaaaccagatcaccttgtgggaagatttaattatttctgagttgcgagagaggtttccttcacacaggttcattgtgcagaagaggccgcggctttctgggggccaagtgtgtgctcacccagagcccgacgtggatcatcggacccccatcgacggcacctgcaattttttgtgcacagattcccgacgtgttggcggtatacgcatgtggattgtgctgtgtccgacaagagcttgaattcggcggagtgatttaccactgcaccagagtgaggcggattgtacactgggcgccggcggggtccggggcgccttctggcaatggccagcgggctccggggtctccgggggagacagatctctcaaaagggccttggttcctgacagacaatttggcccaaatggttgaaccctgcgacccttgaagcctgtaccctgagttaagcatgggagcggttgctggattggcaagggcggcatgggtccccagtgatgggaagctccccattggccctctgccactgggcccagggggcccggcggtgcctataaccgttgggcgcgcctggttggaacg

SEQ ID NO: 553248 - DNA, 427 bp, Homo sapiens
cgggtattgtcgaaggacactttttcctcagcgcacggctagtccaaaatcccttggtgagctgaaccgttgctcctgggatgaccaacgcttgaagagactacgttactaacttgctcaccgcttcaatatgtccacactcatagtgaggcgcactgcaccccgattttctgaacgctgcctaactcacccaccagaccacatcatgttctcatcattaacttcccaagtgtccttaaaatggctgctgtatgttacaatatgtgtgtcttcaccggcctgctcatcaagctgcaggcgtacaaaggtgaccatgacatatcgccctatcagacgctcagtcataactcatcgttctaactcttctgcgtactgggcaaagcgtgcgcctacgatcttagtggccctcggatatctctcttcgcgc

SEQ ID NO: 553249 - DNA, 120 bp, Homo sapiens
acgtggtcggatcatctggcatcacttactccatttagatctacgtttctccctttagaatagaaatgtctgtcttatgcctgtcccaccattgtattttggaagtgattgttccccgct

SEQ ID NO: 553250 - DNA, 109 bp, Homo sapiens
gccccgcccatcgacccccttctatgaactctccttgagcactcctggcctactggtagatggcggcggcgcaggaggcggacggggcccgcagcgccgtggtggcggt

SEQ ID NO: 553251 - DNA, 128 bp, Homo sapiens
gcacgcagcaatccagctcaaaacgcttagcctagccacacccccacggaaacagcagtgattaccctttagcaataaccgaaagtttacctaagctatactaccccagggttggtaaatttgtgcca

SEQ ID NO: 553252 - DNA, 398 bp, Homo sapiens
aggtgcgctcagacacccgggatcagtcagaatataaaaaggaagcagcaggacacgcccggatgccctgaccacagagacgcatccagtattggcagcgttgggcttggaggcttctgcaccgattctgagagttctgccagcctggatccatgccttgtgtccccagaggtgactgagccaaggaaggacccacagggagacaggggggcagaaggttctttggttccagaccaccacccgtcccaggagtgagaggaaccctccgtcctccattccctttgtcgagttgtcccccgaagttttggttgggaaagtccagcagaggtacctgaagattggtcctcaagatcaagtcttcccagtgggggaacctgccccattttccccaggagaat

SEQ ID NO: 553253 - DNA, 341 bp, Homo sapiens
cttgaggaccccgggtcgagggcgtacaacaagaggtctggctagggttagtgtaaacggtagactttattgatcagtgaatatagtgtccaagaattgctaccaccattatccatgaggaaaatgtaggtaagataaagaagtgggactgatattggtgaatgggaggacagctagtaaaaagtgtatgatttgagtgaacattttggtagaccaacatgtgtatatagatatagttggctatctggggatatgaaagatggtctactttgtcatccaataacttgggttctgggtctcatttctttggttaaaagccctcaaattcaacaatttgcacc

SEQ ID NO: 553254 - DNA, 385 bp, Homo sapiens
gatgtatcatattggcaggctgcttgaactcctgatctcagtgatctgccactggctccaagtgctggatacaggcgtggcatggctgccacatgtatttatttgcatcaacttgaaggaaattttcactgggtatagaattttgggttgtagggattttctcttggatcattgtgatgatcactccactgtattctgttttccactgttgcttttgagaaattgccttgtggtctaacaggtgcttctttgacagtaatcactcttttttcctttggctacttttaagagcttctgtctgtcttggaggtaggcatctcactaacgcgtatctaactatgtgcttttatttatcacgcatgagatcctttgggctcccccaagc

SEQ ID NO: 553255 - DNA, 90 bp, Homo sapiens
aagcgctcgaacccaggagatggagggtgccagtggaacagagatcacgccactggagtgttactcactccaagcctggtaatcaaatcc

SEQ ID NO: 553256 - DNA, 803 bp, Homo sapiens
gaacccgggaggcggaggttgcagtgagccgagatcgcaccatgcactccagtctgggcaacagagtgagattccgtctcaaaaaaaaaaagaaagggaaaaaaaatatagcattatacctcttcctggtctcaacgcgccaggaaaattctggaacactccaaatccaagtggaataatccaaaacaaaatttataagtataaaataatttcactctcttatagtaatagtatactttaaaaagcctcagggtatatgatcttctaaacagctacaattcaagtggcacgctacattaaccaactatgtcctctagtggagaacaattaggcctatttcactgctgtgtagcctcagggcctaactgtgggtgccaaataaatatgcggtagaattacacctggattggtaaaaaccattcgtttggtttacaaatgtgccaaaaatctcaaagaggccctgtatttatggtaattcttggaaattatattgattggattcctcagttatggactggttgggtgtgactttagtacataggtactcaatattataaaaactcaaatatttggctgggattttacacaagatcttcccttttctacaagttaattttcaacaagtcatggggtatctctaaagaggtatattgatggttagaagcatgttcaaatttttgtgcttatcaggactattgttagattttcccagacgaattcataatttcaagagccattctgctgaagatttgcaggagtgaactttactttgggatttaacacttgtgcgggctgagggtatt

SEQ ID NO: 553257 - DNA, 353 bp, Homo sapiens
cattttttaaaaaaaaaaatctcataggctggtatgaggaatggcaaatctcgcccattatttattatcaatttaaaaatatttctaaggcctttggtggtggcagcctcttttcttgattgttttcatcaaataaggtacatttgtgggaaaaacatgcttattttcttatatttccttaccaaaacttgaagtcaggatattacccttccttattaaaacctcttttactaagactggcaatgaaatcccattggatgccatattgggcactgtggaccaatctccaccctctgtatgccctctctttttgatgtggccacggagaggtcactgtctcctgacctgccctt

SEQ ID NO: 553258 - DNA, 493 bp, Homo sapiens
  misc_feature (4)..(4): n is a, c, g, or t
  misc_feature (208)..(208): n is a, c, g, or t
  misc_feature (217)..(217): n is a, c, g, or t
  misc_feature (221)..(221): n is a, c, g, or t
  misc_feature (240)..(240): n is a, c, g, or t
  misc_feature (249)..(249): n is a, c, g, or t
  misc_feature (251)..(251): n is a, c, g, or t
  misc_feature (269)..(269): n is a, c, g, or t
  misc_feature (284)..(285): n is a, c, g, or t
  misc_feature (293)..(293): n is a, c, g, or t
  misc_feature (295)..(295): n is a, c, g, or t
  misc_feature (302)..(302): n is a, c, g, or t
  misc_feature (306)..(306): n is a, c, g, or t
  misc_feature (310)..(310): n is a, c, g, or t
  misc_feature (336)..(336): n is a, c, g, or t
  misc_feature (348)..(348): n is a, c, g, or t
  misc_feature (385)..(385): n is a, c, g, or t
  misc_feature (393)..(393): n is a, c, g, or t
  misc_feature (488)..(488): n is a, c, g, or t
cttngtttttctacccatgtagttttcttgcaaaccaatcagaatccatggctttatacaatttgcctaaaatctcgacccgagatatatgcttcatgaaattacaaaatgcatcatatatcattcatggtcaatcctgccttttctagaacttttggctgctagcatatgttggtccaagctaatagttgatcttttggatcctganacacatacntaanatccctcaaatatgccttnggcttatantncatggccagagccttttnctccgccatgattannattgcagntncaccatnagtnaagnaagaagaatttgcagctgttactgtnccgtaggcttcnatgaatgcaggttttagtttggccatctgctccagtnaggaaggncggatgccattatctttggtaactgtatcttttcctggtactttgaagggtaccacatcagaaaggagtccttcatcctgtgccttcttggctanactgt

SEQ ID NO: 553259 - DNA, 395 bp, Homo sapiens
  misc_feature (386)..(388): n is a, c, g, or t
  misc_feature (392)..(392): n is a, c, g, or t
  misc_feature (394)..(394): n is a, c, g, or t
tgaaaatgtgtctaaaatggagtggaagtcaggggccatcaccgaaggggactgacaccagggaagctagagcctagcttcccctccccgccttccccctagggaaggacccagaatttatgctgcagagctaggaggtcagactgggcaaaatagagctgtctgtattgtgcccagggttgaggtgggaggaatgtttctgctcaggcaaggctccaacaagccaggctgcctgttaaggggcacagatttctggccctcttaaaaactgctatgttggcctggtgcggtggctcatgcctgcaatcccaatactttgggaggccaagatgggtggatcacttgaagtcaggagtttgagaccagcctgaccaacatggtgaaannntttntnt

SEQ ID NO: 553260 - DNA, 125 bp, Homo sapiens
tagctggacatacttctggtgggcactgtgcggaaacttgaggatgactcgttgagctgcatgccttaaaggcatggcgtgtctcctcacttagtgcaggtccatcgaccacaagccctgtactg

SEQ ID NO: 553261 - DNA, 838 bp, Homo sapiens
  misc_feature (7)..(8): n is a, c, g, or t
gattttnnttataaaaataagggatcggatggagagagctggcaatagagtgagccccaccacgtggtaaaatatgggtgacctacccttattttacacacaaacctggaccgtgttaaccccgccattgttaccacgggaaatatatccaccctatggtattatagaacgttcccggccaccacgacatgtcccaatgggttgcaccattaacctggagtggtccttcagacctagccatccgtgttttacagacccacgggcaaacgtttcttttcggcgggggatattttttgaaaacaaattttggtggtaccaaaaagttccgcgcccactatactgtagccattcattgtccccccgactactgtccccccaaaatggtgttccccccaacttctcgtcgctttacctgcgcgaagtagaaccactgcctcattttttagaaagaagctctcgtcttctaggccgcacctcgttgggcaaacacaaacctgggtaaaacccaaagttatatgttcccaagcacccggagaacgccttaatcattactccccaagacgtccaatccaaactctgtcgcgtggagcacacccttccgcaaagacaaatgttacaaagactttacagctgtacagaataagggttctccaagggtataaattctttgtgacagcccaaggaaatgccggttcccacatataccccaccaatattttttcggaacaccattgcgggtaattatcattgggatacatcatccataaataggagcagagtctctctccttttgtttcaaccacctaaatttctttaaaaaaatgcccttcggccacaa

SEQ ID NO: 553262 - DNA, 140 bp, Homo sapiens
caaacagcgaaacgatagatacatatctctctggaccagtgattctgtggtgaagctggatgaattggacatgatgcactcactgggtgtgatggcgcttgtttaatgaaaaacgtgcacgcgagagatgagttccgcta

SEQ ID NO: 553263 - DNA, 889 bp, Homo sapiens
  misc_feature (172)..(172): n is a, c, g, or t
  misc_feature (243)..(243): n is a, c, g, or t
  misc_feature (261)..(261): n is a, c, g, or t
  misc_feature (279)..(279): n is a, c, g, or t
  misc_feature (348)..(348): n is a, c, g, or t
  misc_feature (380)..(380): n is a, c, g, or t
  misc_feature (387)..(387): n is a, c, g, or t
tttggggtgtcccctctcggtggctccagggtggctgggggtccttttccggttgaccccccaaaaaaccgggggtctaagaaaaagcctcccaaaaaaggttgtttgtcccaaaatgtttcccccccgtaggcactttcctaaccttcggggcaggtattgggcctcaaangagccaatcgattgagcgccaaaaagtgattctatttgcaccaatcgaaggcatgaaaaccctgggcgaangcattctagcatgggacnagtcgggcctatctcacngttgttcccctcagtctttgtccccaaaacccaggttgtggttttccaaacgggcttttcggggagagnttttgggggggaaaacccccctattgaacgcntgctcangttcattagataaaacccggtgccgaaattagtgattgactatctaagaaggtttggatgaagctaaggcagcttcgcgagcggccccccatgcaagcgcgcattcctgaggggctgaatcaaaccttggagcaatccagagtcggtgctcgctctggacttacgagagcgacgcagacacccactgccatgccgaccatatgggaccagctagggggcgtagtgctaatggaccacttcgaacggacacacttattgtcaagcatcatcttgcctggtatgacaacagaaatgttgggctacagcaaaacagggatcggtggacatcatggcccacatggcatccaaggagtaagacgcgtggaccaccagccccagcaagagcacaagaggaagagagagaccctcactcgctggggagtctctgccacactcagtccccgacacaacgtgaatctcccctcctcacagttgctatgtagacccaagaagagggaggcta

SEQ ID NO: 553264 - DNA, 719 bp, Homo sapiens
  misc_feature (51)..(51): n is a, c, g, or t
  misc_feature (71)..(71): n is a, c, g, or t
  misc_feature (81)..(81): n is a, c, g, or t
  misc_feature (99)..(99): n is a, c, g, or t
  misc_feature (107)..(107): n is a, c, g, or t
  misc_feature (177)..(177): n is a, c, g, or t
  misc_feature (217)..(217): n is a, c, g, or t
  misc_feature (277)..(277): n is a, c, g, or t
  misc_feature (314)..(314): n is a, c, g, or t
  misc_feature (319)..(319): n is a, c, g, or t
  misc_feature (354)..(354): n is a, c, g, or t
  misc_feature (399)..(399): n is a, c, g, or t
  misc_feature (408)..(409): n is a, c, g, or t
  misc_feature (412)..(412): n is a, c, g, or t
  misc_feature (430)..(430): n is a, c, g, or t
  misc_feature (446)..(446): n is a, c, g, or t
  misc_feature (479)..(479): n is a, c, g, or t
  misc_feature (482)..(482): n is a, c, g, or t
  misc_feature (538)..(538): n is a, c, g, or t
  misc_feature (566)..(566): n is a, c, g, or t
  misc_feature (592)..(592): n is a, c, g, or t
  misc_feature (636)..(636): n is a, c, g, or t
  misc_feature (643)..(643): n is a, c, g, or t
  misc_feature (708)..(708): n is a, c, g, or t
aagcgaaaaaaggataaaagaagttatggggagctactggacaaagagcanagaggtcagggggagcactngaagtgggancacagaggttaggggganaaatggangtgggatcacagaggttgggggagctactggtacgtgggagctcagaggttgggggagcaactggacgtnggaacacagaggttgggggagctcctggacgtgggatcanagaggttggggcagctactggacgtaggatcacacaggttagggggagctaacagttgcnccagctccctagggagctggtgagctcggactgagcnctggngctcacaagattgaggagtagggtggaggagttgnagaggatcccctgaagagaaaaaaaaaaaaaaaaaaaaaaaaaanaaaatagannaangtgtttagaaaggagggnacgggtaagggcagtntccggggggagttgggggctaaatcggggcggnaanaaaaaatgggagtttataaaaagttttctgtaaagggcagcagggaggtgggtaangcgctggggcggtgggtacagggtcganttatagaaaggtagctcctacggcgngcagaagggctgtattatctggttcattgtcgcgcagaggtgcnccatgcnaagctacgggaaggcaggactttggggacacagccggtgggagaagggtgaggcgatcccctcancacgtccttgt

SEQ ID NO: 553265 - DNA, 138 bp, Homo sapiens
cttgctcccagattcaaacacctcccattaggccccattccaacatttgggatcaagatttcaacataaggttatgaagaggacaaaaatccaaaacatagacagaggtgttaatcatctttccatgattaagggttc

SEQ ID NO: 553266 - DNA, 137 bp, Homo sapiens
tgagctcggtcctacatcataaacatatagacaataacacagagaaactaaagagtgaaaatagtcaggtacctctattgttgcatattgcatatgcaggaagttagttagttataccagcaccaaagtcccagatc

SEQ ID NO: 553267 - DNA, 849 bp, Homo sapiens
tggcctcatcgcagtaagtagcctgcctcgggccacgcagtgagccggcatcatggtattccttcaaagtagtgctgcgaggggccagcaccttgggcttccgtgttgcaatggggcaggacttcaatgtgcccctctccatttcccggctcactcctgggggcaaagcggcgcaggccgtagtgcccgtgggttgacttgggtgctgacgcagtcgcatgtgcgagaatgcggggtagccctcacacaacatcgaagctccaggaacaaagatccgggcctgctgggtaagcgctctcagccctgggcccttcagcaggggcccaaggccgggttcaagaagcaaaccgcagaagacacaagctcgctccgaaccgcgtggttcccaaggattgccaagcacagccagcgggctgagtgagagaaacaacaggagggccttggcgtgccgactggccgggtggacaggggcccagtccgccgttcccctttcccggcattccttttgcgcaaccttcaagcaggggcaacccgagtttccattgcaaaggaccccggactagaagggaagcaatcctggaagcaaaattccaagggggcccccttaacacaggccctcacacagggtaccgcttaaccacgaagggcgtggcccctgtccccctaggggccttcggttgggaccccctatgccgttttgtggcgcctgacagtctggctaaatcgccccgggtgacctcaaagcacggaggccatgatggtagcttagaccccgggccaaacagccacaggcccgggacacggccccaacgccggtctggaagagcggtcacctccaatttgttagcg

SEQ ID NO: 553268 - DNA, 374 bp, Homo sapiens
ggccttgtcccctcctttgagaacgtgccctcagtgggggcagctccctggcttttccggctcctccgcccacaggattcaggcacgctcagccagctctggtttcatccacactgaggggcctgtctgtgcataggtccctcactaaatgcacaagaagcctttactggtgttgctatgttaaaatgtgactgtcatcatccaattccagtttgcccatctacaaaacaggtataagaagagacagaaggcctagcatacccaaaggtctagaccggtgtacttggaaaataagaattattaatacttaaaaaaggtagcaaaaaacatgaaaacatatattcaccattcttaaaatacatattaaaaaaaaa

SEQ ID NO: 553269 - DNA, 87 bp, Homo sapiens
cggcggtggcggcagcgcgtccatccgggtccgagtaacctgccgccgccgccaaaactacgccaacgtggcggacccggaggctgt

SEQ ID NO: 553270 - DNA, 620 bp, Homo sapiens
ggagttcctccttgctctcgcccctactctttctggtgttagatcgagctaccctctaaaagcagtttagagtggtaacaaaccaaaaaaaaccacaccaacacgactccgcagccacaaaaggggatgagaacagcagctatctgggaccaccccccggctgactacccagtaaccggagaccggccatggccccctgagaggtccttcgggaaggctccgccactccctaacgaaggacagcaccaacccagagcaccagggcggaacacaccgaggacgtgatgcaacgagggaagccaggcgggccattgcgcacactatcgggacggaccggtggaccgcgacccactacgtgaccaacttggccgcaacaacacattacacacaggcacacagcacgagggaatctccatcgggaggacactaataaaaactaagacaatgggaaaactgggaagagcaacccaagaacggcaccaaaagggaccgaaggagcaactagcggggcaccaaagggtcccaatacacactgcgagggcgaggaagaaccggcaccgacaaccgcgacagcaaaacactactgtccacgagaccgtccaagaacacaacaaacaagg

SEQ ID NO: 553271 - DNA, 100 bp, Homo sapiens
ggattacaggcatgagccactgcatcatggccggagttcttaaatcagttctgccaaacctggactgaaccagacagcatacacacccatgcggcccatg

SEQ ID NO: 553272 - DNA, 489 bp, Homo sapiens
  misc_feature (109)..(109): n is a, c, g, or t
ccagtcaaagcagaggaaaggtttccatttggcaaagccatagaaaagggcagctgtgaagacataggagtagaagaggccagtgaactcagcaagctcaatgtctcanagagtgtgtgaggcagcgccgagagctgccaaggtgctctgcgtgtccaaacacagtaacatctgtgtcgataggctgttgtgctatctagcacctcagtttctgtccccagatgtggtgtcacgtggtcatttcagcccgaatctctgtgtggagcacagttattcagggttcatttccacccatttcggttttcctttacttgcgttcctggaagccttttcctggaagcctgcccccagcccagccaggggatccagtcagcagcgtggagggattcaagtgccttcagggtctggccttgcgtctggggctgaggccactggtggaatcatggccctggggattatttgacttctttaagaaaaacaaaaaaaaaa

SEQ ID NO: 553273 - DNA, 342 bp, Homo sapiens
ccccggggggggggccgttttaaaaaaaggggaccccccgggcggcaggaattgggcccaagacaatttcccatccctttaaggccttgggcctcccatttggatttttttaaggaaaaaattgggggcccggctttcccgggtgggtatttgccgggcccaatgttttacccttaagttaatcctttgctttagaggccagtttggtaacaaacacccttttgccccaattggggggttttattttttagaaggggtttttcccccaggggcagggaaaaaatgttcagggtccttggtaaaaaaataaatttaaaattaaaaaaagtttgcagaccccca

SEQ ID NO: 553274 - DNA, 245 bp, Homo sapiens
tccctgtacatctatgggggaaggggagggaagaaaggatctcatacatgtcacactgttctttttccaggtgaatgattttcctaattttcaaggtctgatgccctttttataagcttccagagcacctgaggtgacttgcaccaagtcatttagcatcatgcaattttaaatgtctcttattatcacctaggagattgggagcaagttgatggcaaggactgtgctctgtctgagttctggca

SEQ ID NO: 553275 - DNA, 758 bp, Homo sapiens
  misc_feature (68)..(68): n is a, c, g, or t
  misc_feature (71)..(71): n is a, c, g, or t
  misc_feature (630)..(631): n is a, c, g, or t
  misc_feature (644)..(645): n is a, c, g, or t
aagaaaaccagaacaatccacactaatagtataaattacagcacatctagaagcacggtccaggcaanctngtagatttaatactagaactgaaagaagcttttaattattcctcctctggtgatttattagacacttggaatctaagagtctcacaagtggatgagccaggtttataccacaattaaccaatagaaagggtctggtctaaatatgccttaaaagccaaatactaaatctaaagggtgtgcatagttgagtctaaaaagaactaaaatatagaaattaaaagttccacacattatcaaaagcaataaatttactaagaggcagaactcccaaaacaagttatctaacatgaaaatggatgtacaacctgaacagaactttctgtgaagtgttcacataaattttcagacatgagctgcaagatattatgactatatctcaaacaggttcataggttcaacaaagtccaactaaaaccaataaatgacataatgacatcatagttcacttgttctcttaagaaaagtccctcaggaaagtgatagagaaaatacgagacaacttggttgttcaaattctttacatctatagacaagtcaattaaaaagacctcctggaacnnctgtcatgagggnnctttcttaaaaaaacaaaaacccaatagctatcgcttatgaatatataggtggtcagaatgattagattgtggtatataattaggaagattaagtaggaaaacgaagttaatc

SEQ ID NO: 553276 - DNA, 285 bp, Homo sapiens
tgttcctggaattcaagtgaagtaatgataatgatataaatataaacgcacatgttgttgtctatgagacatacgacatgtgcgtttttgatttatttacaatgagcaagcgcttgtaaaaacgcatgttgataataatttgaaataggggaatgaacaacctgacagttaggttctattgaattaaagtctacaacagttgcccctttagtaagtataccttgtaattctatttgaacatttgcatcaaatacattaaatagatcagcatctattaaatataaa

SEQ ID NO: 553277 - DNA, 191 bp, Homo sapiens
acttttgtagtactacaaaagatgtatgagattgaagcatctgaccattctccccaaacatagattaggggggaaccccccataacactcacgtgctcgatgatcttatcctaagatttcaactgaagaccccacgatcatcactggatatttacccataatcactgcttattacaactcattactggagc

SEQ ID NO: 553278 - DNA, 187 bp, Homo sapiens
atagtgctacatctatgtgatgggtggggtggggagggaatcactgatgctatagaaattgcgctgcccccccaggccagccactgttccttttggttcaacgtctctttttattccttgatatttttcttttttttttttttttttttggggaatgggccatttgtaattttaccaaaggttccat

SEQ ID NO: 553279 - DNA, 158 bp, Homo sapiens
accacagctggacagacatcacaggataacccaggcgtgggaggaggccccacggcctgctggtggagtctgacctggggggattggagggaaatgacctgccctccagcactaccaaagtgtgcgattaagtactgtattctttccacttaaactga

SEQ ID NO: 553280 - DNA, 161 bp, Homo sapiens
  misc_feature (60)..(60): n is a, c, g, or t
  misc_feature (127)..(127): n is a, c, g, or t
  misc_feature (147)..(147): n is a, c, g, or t
gaagaggaggaaggagggcgagcgaggaggatggcggtgtcggggctcctgacggaactntaatgaatcattgattgaccagcactattttaccacgttggaatgaatgatcaagaaatgggcatanggcttttagatccaacatgnaacagatggatgtt

SEQ ID NO: 553281 - DNA, 242 bp, Homo sapiens
cccacgagcgcatgactcactcccttcatgaggcttctgtagagatacatcacttaaggagcgcaagcccggccacgtttccagagctggtattctgtatgtgaacccacagagatctgggcgggaatccgtatgtggccagttggatagacagaaggcggcatcaatccacatggggtcaatatcgccatccaggactatccattggggtccatcaggctgaagattggcttgttccgctg

SEQ ID NO: 553282 - DNA, 214 bp, Homo sapiens
gcgggctgaccacaggcttcgcgcccatgaaagggggcgaagagtcacccacagctatacgcggggccctggacaccctgcaccagctggacatcgacggaggtatactaaacgcccatgtggttgggctgtactcaatcatgggcaacaaggacctgtggcctatgatgctgagcagcattttaattccgggcctgatgcagtgcatcgagct

SEQ ID NO: 553283 - DNA, 179 bp, Homo sapiens
atctagagagaaaccctatttctttacagtttactaataactatcttactagccttatggtgtgttgtgtgtgcgtgtgtgaattacacagtgggggaggtatgaaacacagagtctaagatgaaactctacttttaattttttttttttttttaaaggctttggaaatttcataaaac

SEQ ID NO: 553284 - DNA, 940 bp, Homo sapiens
ccctgtggagacggacttcggggggacaatgggaaagccccagtggccaggggaaacgcgggggtggaatgaggccaaggaaaggggtcccgggatcggcttggaagggccaaccctcccgggcaggcggccgtacacccgggtccgcaacagtagcaatgccgcgtgctgttggggacaccagcaagacacacctgagaaggattaaggacaggctcaaacagctggcgacgccaagcgctgtggagtacagccgtagcacgaatagagggagacccagttcacgatctttcttggagcggggcaggagagacgagaggagaaacgggtagggacgagaactgacgcacacatacacagccttggaccatgagacagaagccgtccgtgggaactccactggcgcgtcggaatgcgcgctgccgtgcacagccccctggacggaggggggccaggcacaccactacagaggagctgcaagcccgtggcctggcctgcatacatgccctgcttccacgtggctgccacgctgacacacccacattcaccaaacccacccgcgccctgggacgcagccacgccaggagtgaggaacacggccgctcggagagcaaggcacaacctacgagcttcttcggggcagcagagaacttaggagagaagcagcggaggagccccccggcagatgcacccgcacccgggccccagccgttccaatcctgtgctagcagcctggggcctccactctggccggaggaaggaccgcaggcagacagcttgggcctctaacagcttttgtccggagctagacttcgtgtcctttcagttggtaaatggttttctatagaatcaataatatgtctttctttaaatatatatttgttaaagttataccgcttgctctatgggaatccgcttcagccgattccaatataatact

SEQ ID NO: 553285 - DNA, 876 bp, Homo sapiens
ttcaccatggtgggtgggaccctgtacacgtatctgaaaactggaggggcttacaaaggctctcatcgctgctcagtacagcaggggctctattgtcctgcgtgctctccgctaccaccccacttccatttagtggcaaaccaaaccgtacccctgaattactccgcaaatttcctgccggcgaggtcccagcgatttgagggtagatagatggattctgtgtgtctgagagcaacgccattgcctactatgtgagctatgaggagactgctgaggtgaagtactccagagtgcagtgagccgctagcgtggtgcagatgggtgatgcttagcatagattccgatataatgcccccagccagtacctgggtgttccctcaaccttgtggcatcatgcaccacaaagaaacatgggcgactgagaatgcacataggaggaacgatggaaggacgaacttctaggcggacctagctggtactgcgtctcactgtgtaaggactgagggatctcccttgcatggctagtggacagaactgatgtgacgattaggtctgatcaattcggcaggttgtcatgcaccccttggttggtgggctctataaaagcaggtactagagccttactttctcgtcatggctcttttcccacatacgcaacctgcttggttgccttctactcttgcaattaatcctagacccgcatgattccagtgggctgtcttgggtcgaaagtgaaaactcgtgtgatgaaggaatggtcccagggattcgaatgctaataaaagtttagccagagagcccaaacctaaaataaggaacacaccacggaacagagaagggtttcacggggaaggagacagcaagaaagcccccagg

SEQ ID NO: 553286 - DNA, 533 bp, Homo sapiens
ctgctctagagccagtaccctgatccctccacgtcatcctggatttacaggaatctgtcatagctttttcttgttgtagatgatagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatcccccctgagggattcttgatgggctgagcagctggctggagctagtactgactgacattcattgtgatgagggcagctttctggtacag

SEQ ID NO: 553287 - DNA, 684 bp, Homo sapiens
gtaacgtggactatgctctagcaaaccagaacgacatgggaggactatacctatgattcggcgcatgagctggagtcctaggtgcagctctaagcctcaacttattaggagcgggaacgtgggcaacgaccgaggccaaaccttcataggtaaatctgaccaacatcgtacatacgttcgtcggttcagcagaaccatgccatgtgtcaatcacatctttcttttcatcagctcaagtacccgatccagtagatcaggtaggccttgggctaacgtgcacgttaggtatgccgccgtacatttaactgctgcggtggcccctcgcgtattcacttgggacgctctttcgctccggccacttaaagagcgacaactacttataggcatttgcgttgtacccatacgttaagcacgttgcctcctcgtgcatcacgtgaacctccacgtggtgcttacagacccattctcttagccttgattagcgctggttaggcggtccggtggaagcccgagggggaacccatggggttgacatacccaggtgtcagtacaccactttcctgccgttgtgagccatcgggtgtacaagggttatcatccccccacctcacttgggtggaggtcgccttcccagattagtcaccccttaaaccccaattcatttccttccccatttaccagcca

SEQ ID NO: 553288 - DNA, 852 bp, Homo sapiens
  misc_feature (141)..(141): n is a, c, g, or t
ggccccaaggcttataacctgtgggaatggatctatatacccctgatccggcatttttgttaaacctgggcgaaacaattggtgtttaccgctcgccgcaaatggctcgcaaacagtgtgtatactgtaagcgacccgtcnggggggagtcttcttgtgatggtttccttgtgcaacacgatggtcttgcccccccagccacagtggtggtggtgcccaccgcacccgggtagcccgcaatgttttggcaggggtgcctccaccaggaatgaccccagtgtcgggtgaacacccggaagtgctcgggagaagcccccgtgtcatgaaaaagggggagattggaggccccggtggtaccatcaccgtagaacaggcggggtcccacccccctcgccgctgggagggctaatggacagaggtacctaccaaccttgcggggggcgatcgttacaagaccccagaaggtgcttcaatcacccgcgcctggaggaattgagaccaccccccccctcttgcgttcaggcaagtcagaaagaacgggcaccctcggggagcaccaacagaccagccgggagcccatgccccgggacatcccagctggcggccacgcgaaaaaatgtgttgatctaacggcagaagccaggatcgccacaattaatatgccactacgataatgtataaagggttatgagccttggaaccccccgccaggcaacatcataacacaagaccccaggctggatattacccccccctgtggcggcccagatggtagggaaggccgcgcctgggaccacgatgtgaagccccctgggccatatggggaccccccaaccttcgcccacaagacaa

SEQ ID NO: 553289 - DNA, 711 bp, Homo sapiens
ggcctgtcctgtcccacggctgtccagagactgcagatctgttcagggcacctctagaatgctcgtcatcttttctaggtgtcaacaggtactatctgtcacataactaactttcgaggcacttggaacatacctgaactaagaataaatctgttcacttgtatagctcacttgaacgatcaggagaatcccatctaagagacacataggtacctctatcgtgacaactcgttgcactgtccccgaaccaggtctgaacatgaggtgcgagacgtactgcactacccatgagggactgcgccgagcgtccacaagcatgtcttgttcaccagtagtccgagacaaccctgctttcgtcagcccagggtttgcatcccctttgggctacctcgctcgtaggaccttgacccagcatgaaccttcgcagccctacacgagcttgcacaaagcgccgcaagttggccctgttgaggacagtcccttctgccagaatggcagttgggggacattataacgcgtgcccttgcaatgccatctccacgtgatcataatgtttggatattgtgtacacttacgaaccaccacggttggttatccttcgacttagtggtcaagggatgttcccaaataacccactagctgcgataaaaccgggcgtcttgcgacacatccagatgtgatgcgttttaccggcttgcacacttgccatcc

SEQ ID NO: 553290 - DNA, 396 bp, Homo sapiens
tgtttgtgaatttcttcacttgcactctaattcggacttgccaaaggatttgctatttggtgttatgggtaatacttttttctggcctagttttttcagaggtcctaaaatagaaatttacttttttggatagaagtacagaattttgagaagaaactaaattttccccaaattttaaggaaaaattgtcattatctaaaaatgttgttataaatgtgtttcatattaccttcttactgtgaaattccctataccagacagagttagggaaattttaaaaatttaccctatttattttctggaactaaatcaagccttaactataacattttgggagtaatgggaactacttctggctttaagtaaataaaagtcattgttttcaaccgtgtttca

SEQ ID NO: 553291 - DNA, 275 bp, Homo sapiens
catgaaatgaacatctacatgctgttaaataacattttaaaatgtatgtatctagtagccaatatcatagaataccatatccaatatgaatagaaacagcacaatttacttcaaagcaggaaatctgcatcaggctttaggtgtgttgtcaaagatacttgtcggatattaccgtcatttgagcagtaagcaaaatctgaggctcagcaaaatcaagtgacttgctaagtgctgacgggtcaagagtctttgagaattcaaactaccactgtgct

SEQ ID NO: 553292 - DNA, 929 bp, Homo sapiens
gtgcgaagctgtaggggaactattgctagaggtgtgccgggggacaggcaaggatgacgcgggcatcaagacgcgtgtgccacgcgcatgtacaagaggtctgcgctctggctgagaccacgaaagtccaggtaaatagccaggtgtctacctgtgtacgccccatatcgcaggatggtcgaaaagatgaaccggaatgaacttatcgtagcattgttggtagagcacgatataccatgtcacatggaggaacatgcctaatacaagatgaggatagctacgttccctcgaaccagtcgtagagtgccaaaagtaaagttgccaagcatggggcggaagtctcgacctttacagggctaaagcaggagaggcggctcggaagtaagtgagcacagcatcgaagaccagttgaaggccctctagatttcagatacacggcatcaggactcatgtgccatgcgccagggaagccatgaacaggtaggagctcggctgtgggagatcacctcgtggtcagagaacacaattgcctatgcagtgctgtcgatacttgtagaactctcagactgtgctctttttggccggactatgaggtacgtgactgggctgcgagccggaccgctggaaacgctcggccagttggggggctccgtacctgtatcacccgtgcgtcgttgtgtggcgcgcagcgatagtaggcgctttcgggcggtacccgtatccaaccggtctcatctgggatggtatagccttgtgtcctaacacccggggaagcatctgccgggggctctcccgacgccccccgacacttgttttcccgtggcgtggccagccgtttcgccacggccatccactgggtttggctggccccaatttgaccgcgtttacccttggccctctggtcaccaagcttgctgcttcgggaagcc

SEQ ID NO: 553293 - DNA, 1385 bp, Homo sapiens
agcgggggtggacgggcacgaggacacccgggtgggctgacctgtgcacagccactgaccttgctatcccacctaggacctggatgtacacccggcctgaatgtgaactggatcagtgaccgcttgactcctattggcgcttatccagacagagcattgcaggcttcgttggtggacgctgggtggaacaccattgcgatgttggcctggcctatccaagatcgaggcgataaatggtcctcgtcatgacaagaccacagtagttgtaacagaacaatcacctatgtatggcatgacccttgtgaatggccagactagtcttacaccaattgtgtgcaccctctggggcttcatacaccttgctagactagatatcagtggcttggtagacttaatcacagacacagtgtgactgtgttgtcgcagtgtgcttgctgtgacatcaggccgtatgcgcactgtctgcgcgacttcttgcatgtcacctgtgtactggttgcaaaggcaccatggctacgaagcatgcctttagactgccacgcaggttttactctcgtctgtcgcacccaaccacacggacaccacaatctcggtgcagctgcgtccccaaactatgctccacctgaagggcaatacagctggctgtcgcgcccttcttcatacatgtccggcggcctaagatccgctagtctgcctctgcggacacatattcccccgtagcagacctaattctaaccacgttactcctacctattctatcccgcgcgggcaacacaggcacacactttgtcgcgaacctcgacggcccccccccaacgggtactaatgcgccttgggttctgcaacggtcggcgccaattgctaggcaacattatggttgccggccatctatcaacgtatctaaattccgcgcaacaagcaagcttgtagctacccattcccacatcttgtggcataccttccgttcaatagcatcgcgtcgcttggacttgtcgcgctccattgtcgtaggcgcgatagcggctccacgtacagctctggggttacaggccccactaataacttgtacccgtactctcgaccatggaatcacatcgcgtccatgtaccgtccgcgccacggcggtttgtacttctccccaaacaagtcatggcacacgtctaccagggttcacccggccaaccccagcgttttaccggtctgtgccaagtgtacgggtcgcgcaagcgcaacccccgccaagcgggatccttccactacgcggcatccacaacatcccgcatggccaccagtctcctctgcgcccgccattaccagcgtgtgcataggcccaccggtgggcactaaagccccgcgcaccccacacatgtccgcactgtgacatg

SEQ ID NO: 553294 - DNA, 214 bp, Homo sapiens
cgtgtgggtcctggagactcacgctgtgctccatctgcactgggtccgcctccacttcagtgtttgacctctgcaacaggcagacacaaaggtcttctcaccctgtcactgctcagtgactggcgatgtcgtacacggtcaatgactgactatgttaatacgaaaatggcttcataaactatcgagctgccgagtagtctccctactgttgact

SEQ ID NO: 553295 - DNA, 84 bp, Homo sapiens
  misc_feature (34)..(35): n is a, c, g, or t
ccggggtttgcatgggggggtcctctttccccgnntgcgctgggcggcgtggcgtgggggcaggggggcggtgggggggccctc

SEQ ID NO: 553296 - DNA, 181 bp, Homo sapiens
acgcgtttgtgccacagggttaaggaatttatacaacttgctttttttgaattgtgatgaaatttactatattaactatttttaggtttacagtttagtgacaataagtatattcatattatcatacaaccatcatcaccatccatctccaaaactcttttcatcttgcaaaatctgcgtg

SEQ ID NO: 553297 - DNA, 116 bp, Homo sapiens
  misc_feature (71)..(71): n is a, c, g, or t
  misc_feature (100)..(100): n is a, c, g, or t
  misc_feature (116)..(116): n is a, c, g, or t
gtaaatatgaaaaaagtgctacataaaacacttcttaaacttttttttttttaaaaactgctccttgtggngcaggactaccccataggcagtgtacccncaatagatagcctttn

SEQ ID NO: 553298 - DNA, 281 bp, Homo sapiens
ccccccccccccccctttttccgggggggggggggggggccccaaccggttttttttcttggccccctttttttttgggggaaaaacgggggtttttttacccacgcccgttgaccccccccagggaggggggggggttttttggggcccccccgggttttttttttgggggggggggggttttggtttttttttttttaaaccgggcttttttttgggggcccccccccccccaatttttgccccggttttttggccccccttaaaagtttttttgggga

SEQ ID NO: 553299 - DNA, 795 bp, Homo sapiens
  misc_feature (494)..(494): n is a, c, g, or t
  misc_feature (527)..(527): n is a, c, g, or t
  misc_feature (581)..(581): n is a, c, g, or t
  misc_feature (769)..(769): n is a, c, g, or t
tccatctgcggtgaaaaatattagttcggctattggtatgtttatacagcatgctcacgatgaagtataccatggggtatacagttagcagcccgtgtatgctctttgtgacttgagttcccagctaatccaagcagataatttccacagatcactggaaagctttggcgagataagagcgcctacctaaaatgcgtatccgtgctgcagaattgtcaagcttgccctagaaggaaagtcaagtgcccctgagcacaagaaggaagcttggctagatcagggatgccacctgatgcttgagaagtgccttgacacattttgaacacaaatagtttgatcagctctcaaaatacaaagggaggtttcaaaacaataagacataaaatagataaaacagaccagaggctctccttattgtttggcaaggagacaggagaaacaagcagtcgcatagtcgtttttccctaaatctaatacgtttcacttaacgctgntgtgatctgtgacatatgggatatattacttgngtctttgtcaaacaacaaaaacttgaacttagccctttatttgctgcagaaagngtgcttctagtggcttcttaaattgaatggcattttataatgaacttaccatataaaaacatgatttgggctctgaactagtagtgatagactttggttccaatgagggactggaaaaaataattggccctaaactttctgtatctttgctggaaagagttccaaagttttttcaagagtggggcggntttgtcagagccatccagaggccttc

SEQ ID NO: 553300 - DNA, 182 bp, Homo sapiens
  misc_feature (124)..(124): n is a, c, g, or t
  misc_feature (137)..(137): n is a, c, g, or t
aaggatctgtgggcatcttgtcccattgaaatcttctcatatactgtttgagaggagaagcaattgaacccagtaatctaaggtgaatgaatagtatgtgtccagcggaagaactgtctggggngaggagagtatgnttgtgtccacggaaaaagggaacgctggactggggcagcaggcta

SEQ ID NO: 553301 - DNA, 292 bp, Homo sapiens
cccccccccggaaaaaaaaggttttttttgggaaaaaaaaaggaaaggccggaaccggccccaaccccggggtcctttttggggccccaaaaaaattttacccgggccccaccctttaaggggaacccaggcccccccccccccttttttggggaaggaaaaacccccctttggggtttttttttgggggaaaaaaggggttttttttttttaggttttttttgggaatttttttgggggccaaatttggggggtttttttttttaaaaaaaaaaaaaaagtttttttggga

SEQ ID NO: 553302 - DNA, 139 bp, Homo sapiens
gggatgaacatttattgtacagaactattggtgatggcctggatacggttttgtatgaattgaaaaactaaacggaataagagaaggaaaaaagcaggtattaaaggactaagaattgggaggactcaggacatctaat

SEQ ID NO: 553303 - DNA, 685 bp, Homo sapiens
acgcgttccactacgtgcagctgtggacagcctacaggggcctccagcctgtgccatcacgaggaggtgattgagctgtatgggggtacccaacacatcccagtatatgcagatgagtggcttttttggcaagggtccctccattaagccggttcatggacatcttctcgcgtccccggaggacttgcgctctcgcttgtccttggtgttgcgttggacttagcttctctggggccagctatgccatggggtttgaccatcggacagtctcttaccacggacgtcgactggacgccactcccggagacgtgcgtgtgataggggcctcctgtgccagtggttctgtcgcggcgacagggtgtacgtccgttcctgagaggcggagtgaggacgttgtgcttgtgcctcgaagccgtcgtggtggcccatgtgaactcaggctgtgcctcattcactcgaacagtccttgtccgattcgtacacaaggtgaatgcgcgtgcatgtgtgtgggccccgatggctcgccagctcttgcgatgttgggcagaagtccaggccaagacgatgcgcacttcttcagtgaccgggggcaagccttggcgaaaaatccttgagaacgggctcacttcagccgggaccgaattcgcccgctgtgaaaacggggaagattatcggctggaacctg

SEQ ID NO: 553304 - DNA, 355 bp, Homo sapiens
  misc_feature (61)..(61): n is a, c, g, or t
  misc_feature (136)..(136): n is a, c, g, or t
  misc_feature (224)..(224): n is a, c, g, or t
ttttggcttttttgcctcccaccttttagcccacattcatttaactccactactgtgaaancttgcttaaagaaaatccctcttggccgggtgtggtagcccacgcctctaatcccagcactttgggaggctgagncggggagatcacaaggtcaggagatcgagaccagcctgaccaacatggtgaaaccctgtctctactaaaaatacaaaaattagctggncgtgttggcacacacctgtaatcccagctactcaggaggctgaggcaggagaattactttaacctgcggggggagcctagattgcgctactgcactccagcctaggcaacagagggagactctgtctcatt

SEQ ID NO: 553305 - DNA, 310 bp, Homo sapiens
gatttttttcctgacatgtatggtagggggagaagtacatacatgtcaggaaaaaaatctatactgaatttttaaaaccagaaaaaaaactgtgatggtttagcaggcgcgcaggcagttaggggaaggtttaaacaaacagctgcaggccgggtacagtgggctcatgcttgtaatcccagcactttgggaggccaaggtgggagaatcacttgagcccaggagttcgagaacgacctgggcaacatggtggaaccgcatctctacaaatgggtcgacgcgggcgagatttaggtagttgggaggtggc

SEQ ID NO: 553306 - DNA, 166 bp, Homo sapiens
ttttctgctgagactgaattttctgctgtccacgagccatatctgtaattccagctacttgggaggctgaggtggagaattgcttgaatccgggaggcagaggttgcagtgacgcgtgatggcaccgactgcactgcagcctgggcgacagtgagactctggtctc

SEQ ID NO: 553307 - DNA, 778 bp, Homo sapiens
  misc_feature (560)..(560): n is a, c, g, or t
aagctttaaaaaaaaaaaaaaaaggctgaattcttttttcttcatcactggcatatctgcctattctccaaaattattatgactattcagctcactttaacagttgaacttcaagcgacaatctttgaacacccctttctcatgtgatttaaaatgaaaccatttgggaaaagtttcttctagccagtaatagatttttttttaaatggctctgccttgtgccgagaaggatgttcttttaagaatgaatctttggatgtctgataccaccaaatataggtggtagggagagttggaggctggccctttgagcaggccattagcttacttgctggggcatctccgatagcttattggcctacctttttggctgggaaaccaacctggttttgaaaacacaaattctatgaagactggcagctaaggattcatccggtagacttaagagcttttggtccttgtgggatatttcagtgggaaaccacatcagtctcaatactggtcattttaccctgactcagaagcagctgacttcattcccttgccatgatattatattnaaggcaggcattgtacccagacataagagacacattatcgtgtttcacgcaggaaggattccaggtttatgaacctctcagaccagatcttgcttgacccaagcggagactttcgcatgtgtgtccatgaagaaaactcattcttaattccccagtcaatttaaaggccagtatcctgaagtacttcgaatgaaatgccctggttaacccttggaact

SEQ ID NO: 553308 - DNA, 1195 bp, Homo sapiens
  misc_feature (599)..(599): n is a, c, g, or t
  misc_feature (655)..(655): n is a, c, g, or t
  misc_feature (666)..(666): n is a, c, g, or t
  misc_feature (809)..(809): n is a, c, g, or t
  misc_feature (843)..(843): n is a, c, g, or t
  misc_feature (1181)..(1181): n is a, c, g, or t
  misc_feature (1185)..(1185): n is a, c, g, or t
  misc_feature (1193)..(1193): n is a, c, g, or t
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgagggttccagaggccagaaatgggaagtccagccacaaataaacccactaaatttgataataagaaagaagatttgacacagaaacaagaagatttctaaaagcacactattaaatctccaatgtgctgaagtctggtgtctgaggagggagggctgacacttcctctcagagcttgagaacgggtgggcacgggccnttgccattcattgttggcacggggaggtctgcatttggaacccctcgctgcatgtnagcagacccanctccacctagaaacagggaccactggctgtgggcaccgctgctccctgcaggcacgcaggccttctctggagtgactggtcctgagctgcagtgcctcctccgtggggctgcagggcttccatgactgtatccagggggtttnttacctcatttccaccggagttcttttcccattncgggttaaggattgacggcaccatgaagagaggagccctgagccggcagaaggaagagaagagggaagcagaggagccctgagctggtggaaggctgtggcgggtaccttggaggaagagaggagggaagcaaaggcagagaacaaggcagaggccacccccaggtggggccacctcacccaccgcccccggagactgcgtggcggggaaggcggccctagtgtggctggtcggcctgcatgcctgggcagtttgcagcctgtccaggtgtcagagctgttagctctctgatgctggtggctgttcccccagaatggaagcattgattaaatttctanacanaaaccccncc

SEQ ID NO: 553309 - DNA, 742 bp, Homo sapiens
  misc_feature (728)..(728): n is a, c, g, or t
  misc_feature (732)..(732): n is a, c, g, or t
  misc_feature (740)..(740): n is a, c, g, or t
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgatgacggcaccatgaagagaggagccctgagccggcagaaggaagagaagagggaagcagaggagccctgagctggtggaaggctgtggcgggtaccttggaggaagagaggagggaagcaaaggcagagaacaaggcagaggccacccccaggtggggccacctcacccaccgcccccggagactgcgtggcggggaaggcggccctagtgtggctggtcggcctgcatgcctgggcagtttgcagcctgtccaggtgtcagagctgttagctctctgatgctggtggctgttcccccagaatggaagcattgattaaatttctanacanaaaccccncc

SEQ ID NO: 553310 - DNA, 215 bp, Homo sapiens
tgcttagcttagtacgagctggtggaatggcgaggggacacagaggcgcagtcatgtgggatcgacgatccctggcattctacagcgacagcttcgggggcgacggcccaggccgaacgagggggcagggcccgcaaaatcgcaagctgcagaagggcggccttgggtgggttgggggtgtgggtgatggtgttggtgtgtgttggtgtgtgagg

SEQ ID NO: 553311 - DNA, 374 bp, Homo sapiens
taggctaaattataactgcgtcatatatctaaatttgaatagtcataagttactgctatataaaaacattttgcccatatattctatgacttcttctacttcccttaaattatattcctttgacctaagcataatattgattgtataaatttgtcatcatttgtagtctggttcctttcttctgactcatattctaaaataatgccagattctagataatagagacaaggtacattgatacaggataatttatcttagtttcagcttgatgacaaacaattatcccctttatcttgctttacccacacttcattcacactctcccttgcttgccatcttcggatttacagtatacttaaggtattccgtgaggg

SEQ ID NO: 553312 - DNA, 307 bp, Homo sapiens
tactcgtcagcttatccagaggctgaagcacgaggatcacgtgagaccaggaggttgagatcaacacataagaccccgtctcttaaaaaaaaaacgaaaaaaaaattattggggtgtggtgctggcacttgcctgtcatcccatcccacatctcagttacttgtggggctgaagcaggaggatagcttgagcctgggagtttgaggctgcagtgagtgtgatcacaccatactccagcttgggcgacaaagcaagaccctgttttcaaaaaaaacaaattcttgggcaaaaagggttccggtaaact

SEQ ID NO: 553313 - DNA, 383 bp, Homo sapiens
tgtttttgagtcaggggctcactgtgtcacccaggctgaagtgcaatggcgcagtcatggcttactgcagcctcgacctcctgggctcaagcaatccttctgccttagcctcctgagtagctacaactacaggtgtgagccaccacacccagctaattttttattaataaattttttgtggagatgggttcttgctgtgttgcccggactggtctctaattcctggccttgtgtggtcctcccacctaggtctcccaaagcagtggggattacaggtattaacccaccgcacctgggccttaacattttaagtggaaaatttaactttttccttattatgttaagcaattcatattctttcattattggaaatattaaaaatt

SEQ ID NO: 553314 - DNA, 104 bp, Homo sapiens
gaagaagtgaattcgctgtacatcttgtcaccagcactgggcctctgtcctttgtttgccttccgcttaatgtcaaagataaaatgcagttaccttctgggggg

SEQ ID NO: 553315 - DNA, 373 bp, Homo sapiens
gacctgatttctgtccttcctccttttctaatatatgcatttaatgctgtacattttgaacaaagtttatatttaaattttagcaaagccacatggtttatcaagaaagctttctgaaagaatggggttcatggggcacataaaaagaaaaatgttgcagtatcatggagtttatttgaacaagtgggagagaataacagtctgacagaggaagaaagaataagacattcatgtttgggcatgtgcctgtagtctcagctactcgaaaggctgaggtggcaagatcgcttgagcccagaaagcagaggtttgcgtgggctgagattgcgtccctgtacttccgccctggtgacagaagcaagacactgtctcc

SEQ ID NO: 553316 - DNA, 148 bp, Homo sapiens
actagaagcggcttctgtgaactctgctctttcggagttctttctcaacttgtccctatacggtcacttggttgactactcggtctcgatgccgagtatttaagcctttagatgtgagtttaccaccgcgcttgtgggcgtgcattcc

SEQ ID NO: 553317 - DNA, 354 bp, Homo sapiens
ctcgaaaccatttaccctatagacgctatccttatagacttcccatagactcggagggaactgcagggagaccaactgatttagagcgaattggacatggatcgatgagcgacctctgattgattactgctagaatgaacttgtcaatgatgcatgggctattaccatggaagctatacaagcgacctatgaacacccttgctagtacacctgtcaatagccctgctcctaccgatgaaccacatggacagtacacatacttataactccagtgcagaattgtctgcactctatagaactctatatcagctaataatgcatcgctgaaccatatttcactagagatttgcggtt

SEQ ID NO: 553318 - DNA, 104 bp, Homo sapiens
cgactctttggatcccctgagcccaggtgatgtggtttggatttgtgtccccacccaaatctatgtcagactgtaatccctagtgatgtaggagggggggtttt

SEQ ID NO: 553319 - DNA, 181 bp, Homo sapiens
ggtcgtattctccggctcagacgcaacctggctttcgaccgtgatggttgggaaatggatagtaaaacagctgcctggcctttcacactttccaccgcgatgcgtccgcccatgagttcgaccaggcgttttgagatcgtaagaccaagtcccgttccaccataattgcgaatcgtaaggt

SEQ ID NO: 553320 - DNA, 387 bp, Homo sapiens
cacgagggtcacattattaagcgagaccccggtccgcttaacgacccggtaaacagaaggatagaagtctaacctcagcgtctggctgtctgcgatcctattttgcatgccaagcggaggctgattctttcctccaaaaattccaaacttccactgcatgtacggcggaaccccaagctctgaatgtcgagaaaggtggtactggttacaaatgaagtcgactacccaccgttcaaactccgtcctcgtcatactggcgtttttttccgggtcgtcgtcaccttttgaagtgtgcttcgacccagttctgccgggcagagattctacattctgtgcaagcgttctaaagaatcgctcaacgtgcccgccgtagtggggtctctttac

SEQ ID NO: 553321 - DNA, 152 bp, Homo sapiens
  misc_feature (21)..(21): n is a, c, g, or t
  misc_feature (113)..(113): n is a, c, g, or t
ttttatgcattctaatggctntgcccataggagagatacccagagtggcaaacagaggctaaggaaaaaaatgcataatacctcgagacatggtttttggcaaaaactccatnactttaaactagctcttttactatcggacctacataaga

SEQ ID NO: 553322 - DNA, 201 bp, Homo sapiens
  misc_feature (36)..(36): n is a, c, g, or t
  misc_feature (42)..(42): n is a, c, g, or t
cctgttgttttgtccaaaacaaactgcacaccacanacaganactcaaagattgcgagaagtcaggaagaagtttctggaagagactctgcctttttctcttgtaagcatgcttgtctcccagggactagtctaccaaggttatttggcagctaattctagatttggatcattgcccaaagttgcacttgctggtcccttg

SEQ ID NO: 553323 - DNA, 140 bp, Homo sapiens
ctcacgtcattgtcatggtggtagagttcagccagggtgtgttatggcgcgagagaccgacagaacctgccaaggctctgcgtttggtgatcggtcatactcgcccaggacaaccaaatggccgccaaggctgacattgc

SEQ ID NO: 553324 - DNA, 304 bp, Homo sapiens
gcagccagccgcccgccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccagccccccgggatgcggtagcggccgc

SEQ ID NO: 553325 - DNA, 867 bp, Homo sapiens
  misc_feature (170)..(170): n is a, c, g, or t
tcttctgtgtcttctggggctcttttgttcataaaatcgccgccaaaaaaaaaaaaaaaaaacatctcggggcccccggggctcgccccgcaaaccgagataaaccccacgaacatcgcggggccagaggtggttcttctcttctacccgcgagaccaaacgtacagtgnattaggggcggaggaacctatacgccccggaagagtggattcgaggagtggccacaaaaactccgccggggagccgcacccataacggcgttgcggaggctggtggtccacaccaacagtgcgtcgcaccgaaatacacacagagcacgcgccgcccgcggtggcgcacttgataaaatttccgcatgtttggccccctcacgggtggagcctcacagtgtggaaggggaggcaccaaggaggcggcggtgactagcacaaagaatcccagaaggtggcacgggagcaattcgcgtcgacccacacacgactacaagacagttacaacccgcggggaaaaaccaaaccacaggcgggggacgctgacgttctcccggaggaggggtcacctccatacagatcccccttcgtgggagcaagacggaagtacgacaacgagaccggcgcacataacaacagggggagaaaatgagaagggctctccaaactcattgagcaccagaagttcaccgccagcgagtgagacaaacaacggagaaaagagggtcccgcaacacaagaaatacacccaaaaaggggacacccacctcacaggggcccgagaatggcgtcctatcacgggggaatccgctggccccaacacaccgaggaaaatcaccccgacttttaccccctctataataaaatactttgttgc

SEQ ID NO: 553326 - DNA, 252 bp, Homo sapiens
  misc_feature (58)..(58): n is a, c, g, or t
tggcattttggaggaaaaggtggggcctcctcgccagcctcctccccctgccctggtnaaaccctcaactctactactaaaaaaaaaaaaaaaaaaaaaagccaagcctggtggcatgtgcctgtagtctcagctactcgggaggctgagccaggagaatcacttgaacctgcgaggtagaggttgcagtgagctgagatcgtgccactgcactccagcttgggcaacagagtgagaccccatctcaaaaag

SEQ ID NO: 553327 - DNA, 1777 bp, Homo sapiens
taaagttttggatttttttttaaactcctgtgaaacaagtagacacgagtaacaaccagcctccgtgggagaaatttcacacaccaacgtgcctgtggagggctcgtgggaaagcgtggaggggcgtggagcgagggttgtgggcagaaggtgcaacgagggaggggaattcctcgccctctcgagctccacgtgtgtagcccctccacgtggtcagtgacactccagagggagcagggtgagggacaataacatatatgagctcaaaacagaggcacaaagaggttcagcgaaaagaacacgagagagaggggtggaagagacgcgtggagcggagaggtggggacgaccaaacaacagaacaccaataacaaaggggctacaatgtgcgtaggcccagtgagtaagagaaaactcaccaagacaaaaacaaaaagtgcctgtggcgcacaatatgtgcgacagtgcgagatcaagagaaaacgacccccctcaaaaaacgggggagacagagacacagacggagcgcacgtagagagagagagaaagcgacaaagcacacttgtgggaggaagatagcacccacaaacatatcaccccaacaagacaaaccaccacgggcgagcacatacaatagacgcccgagggcgccgcacacaaaccgcagaggcgcgcgaccaacgaagacgaccagagcgaccagccaaggcgagcgaagccagcagcacaacgcaccgcagaacaaagaggaggcgccaccaatcacacggagtaaaaaagcgaaccatacctgagagaaggaatacaacaaaaaaggtagaggcaacatacacaagaggagaagaccaacacgtagaggaagtagaccccaaacaaccaccagtgaagcagcaatagtgatcaaccaccccagagagaaaatataaacaacaacacacccagaggaaaaaagcagcagaataaagaagcattccaccagagagataacaaaaaaacactggacacagagagaccaccaaagactatggggccacccccaccgagacaggataacacacaagcaaaagtaagaaaaacacatcagagcaagaaaccaccacaaaaacacaagaacaacaagagaccgacgcaaaaacacaacgaaagaggcagatggaaaacaaacaaaagaggaaggcataacacaataagaaacaagaagaacacacaagcaacgaagaggcacagaacaggaaaccacatcgtcaccaacaaacaatcagacgacaaacgaacgaaaccacacgagacaagacatacagcagacaggcaaatacataaagaaagaagcacaaccgcaaggcaacaagacagcaacacacacaccaggcacgcgcaacaaacgaagcacacacaccacaatacaagaataagagtgatagaagacgacagggaggtacattgcgacaagagcagagagactaaagaatacagagcaaacagaagagagagcagacaggagtatagaagcacaccacgatagggcagacaggaaacagaaaaacaaagcacagagagaagagaattaagagagcagaagagaggagcgcaatcgaagcaacacacgcggcacatcagcaaaagagagcaactgaacaaaaataaccacaaacaaactagaacaaagcaagaaacgaaacgagatcaacacgaacaagacaacactcaaaaccgagcacagcaagacagaaagcacagactaaagatcatgacgtagaagcgacacataaaagaaaca

SEQ ID NO: 553328 - DNA, 1093 bp, Homo sapiens
cactccttggcgcctgcctgagtcctccaaatcaccacaggactattcctagcccatgcactactcaccatcacgcctcaacctgccgttaacactcagaatcgtcccaccatcacgtcgaagcactgtaacatttatgagtcttgcagtcatcctcctaccttcacgccaagtggcgccctcaatattctttatctgcctcttcctacacatcgggcgaggcctatattacggatcatttctcgtacgtcagaaacctgaaacatcggtattatcctcctgcttgcaacgtgatagcagagcagcctatcgatagagctatgtcctcccgtgaggccaaatatcattctgaggggccacgagtaatcacagagatcgttgactgatccgccatcccatacattgggacagacctagttgcattgaatctgaggaggctactacagtagacagtcccaccctcacacgattctttacctttcacttcatctatgcccttcattattgcagcccctagcagcactccatctcctattcttgcacgaaacgggatcaagcaatcccctaagaatcaccttccattccgcataagatcagctttccacccattacgtacaccatcaaagacgccctcggcattaacttctcaatgcgtctcctccttaagacctttccactcttttttaaccaacctctaaagggaacccgaaaaaattatactctaccacacgctatataaaccgccgccccagatttttagcccagaggaaattccccaatgagaataacattctcgaccgccccataaatagtcaggaggcttgtacaaaaaaaatacacctcgacgtagaaaaacacccagacattatacacagacataatgtccacaagcaagcttttttctctccttgtttctttttctttgtttctacacccacgcctcaatataaaaacacatatattacaagcaaacactaccaaacacacacaacacaagcaactacacctacctatagaggcacaaggcgggtgatacatttgtcttatttgtttttgcggtacacacacaacatcactacagaggaaaagaata

SEQ ID NO: 553329 - DNA, 246 bp, Homo sapiens
  misc_feature (229)..(229): n is a, c, g, or t
gaggtccaactctgttgtcttttgtaaaataagggttgcttcattatacagaagaattttgaactcagaaattccaggactgctccatttgctttatttgctataccttcaagggcagagagtcagggcaactctgtgaaccccaagtgatcagtcaggtgatggcaatacttagcctgcaaatctactaaaacaagtcataaagtttccatttagtgctgtacacaangaagaaatatttaacta

SEQ ID NO: 553330 - DNA, 669 bp, Homo sapiens
aaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaagagttgggcatggccctgaggctccttatagctggaggaatgcatggatcgcttgtctgaagcactgacaggatggactgagctgagtggagagagacagtagagtatgaaggcatgcatacgcattggccacatactcctttccatagagactcgttcaaatttgtataatgtacataatttaacagttatgcggtaaagtgcagatgaactgtctcgttgagatgtactgtaacgttcactgtagggatgtataacgggaatgaattgtgatgtttgacaatgttggcacaattgccaacgtaccgttatgctttctaaacgaattttaagttttcaaagtatttttgttacatagtcgactcttttttcaatggacgcctctcaatttacgct

SEQ ID NO: 553331 - DNA, 520 bp, Homo sapiens
  misc_feature (12)..(12): n is a, c, g, or t
tatccagttganaagttgaaaaacccaaagggaaaaaccctttgttaaacgcgcgggctttaagactgttggggaccacccgaccccgacattggggcgccaaccaccggcaaacacgcggcagcgcaacaccgggcggaacacccctttcggcggcacacacgcacaccggagcgcgcttttaaacgagcagcgcgcaacgaccgcgggcgacacccacacccgcgcggaaacaacagttttcctccacttggcggcgcccaaaccgatttgtggggggccccaaaaagcgcaggcccccctcgtgggcgagggcgccatatcagatacccagaaaccgctatagcctaacaaccgccgcgtgccaactgcaacacagcgtttctcccccagggcggacaacagccccatggggccggcgcacccccaccgacacaacccgccgcgcgcgcaaatcccccgcccccccggctgtcgaacacccaacaccccccgcgctcctggggggcaccacaccacg

SEQ ID NO: 553332 - DNA, 277 bp, Homo sapiens
  misc_feature (60)..(60): n is a, c, g, or t
  misc_feature (107)..(108): n is a, c, g, or t
  misc_feature (134)..(134): n is a, c, g, or t
  misc_feature (139)..(139): n is a, c, g, or t
  misc_feature (141)..(141): n is a, c, g, or t
  misc_feature (181)..(181): n is a, c, g, or t
  misc_feature (204)..(204): n is a, c, g, or t
  misc_feature (249)..(249): n is a, c, g, or t
actctagaggtatccccgctcacgcccactaggacggctcatgggctgccacgtcacaanctctgatctcgaccgtgcatccttgtcctcttagacaactcctgtgnncaccgtttctccctccacagggcctnagccntngtgtccggtccctaggaccaggctcttccagtgctagganaggtatgagcagcctctcacctntgagctgtggggatcacaattgctgcctgcctcagtcttggactncttgtgggccttacgggtactgagctcg

SEQ ID NO: 553333 - DNA, 272 bp, Homo sapiens
tggggaagcggctttgtttccaggtaacacggcgggtttcaccacatgggactggctgcagtggtgttcatgctgtgatctgctgaggcgtggtgagcatgatcctggttgtgagtgctgcgcatggggaccatggggtgtctgcgtcaacgtcacctgcgggggcgggatcagggctcctggcttcggaggctgctggatgaccagcggtgtgggtagcccctgcttgctgacgcccgacctgcgtaggctgcgtgaaggtagagaacaag

SEQ ID NO: 553334 - DNA, 312 bp, Homo sapiens
gtgtatgacactagggtagtttgcaggtggtaagccatttaccaagatagttgtaggtaaagaagggcagatttattagagaaatgtgaaaatatgttgcagtgggcagctcagcagagaaggggctacctgcaaagaggcaagggctggaggaaagttttgtagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 553335 - DNA, 440 bp, Homo sapiens
tagctagttggttttcaacatgccttcctcaccaagcctaatcatttctagcttttaatttaaagtgaaagatgtacaaccctttctttcacttgatcacttagaggccactgtagggttattattaattggcctaatttcaatattgttgtatcttagggaatagggaggccagagaaggaggagagagatgagggaaccactggtcagtggagcagtcagaacacacaaaacatttgccaagcccaccaccttgtatgggcacagattgttgtagcccaaaacaattgcaatagtaatgcatccagaattggtgggttcttggtctcactgacttcaagaatgaagccgcggaccctcgcggtgagtgttacagttcctaaaggcggcgtgtccagagtttgttccttctgatgttcagatgtgttcggagttcttcc

SEQ ID NO: 553336 - DNA, 334 bp, Homo sapiens
caggtacagatgatagaaacacatatctagggtaagtaatagacacaactattaagtgtatacagacgacagaaatctgtactttacgcaccaattgcaaatgcacagataacaatgaacttggggcactgaaaggtcaaagggaatctcaaacatattcactattttaaaatttaagacaacgaagcttagacaaaaaaccccaacatatacaccatatataacagtctattaattaatgactatccaatattaacttttatctcaagccactaagcacccttcatagtagattcatgtatcatctcctctttggctatgagatgcgtagttt

SEQ ID NO: 553337 - DNA, 1209 bp, Homo sapiens
ggcggggagcggcgtcgccaagctacttctagccgaccagcaccttcgctgcaagcccattttcatctcgggacatggaacgaggccaaggcgggagggtgcgcgaggctcgtaccgtcgccgtggtatcgggagtgtgcctgacacactggtgcaccgaagttctcagcttggtacatcactgtgattaatgggacgggatacagtccgtatgaaattgtttagtgaatgaatgcccgatgtcacagaccccgagggttggtgtgatcttcgtggtcattcaagggagatgatcagactcgtggaataaagcaattaagagtagtgagaatgcagcgggacgacattgttatgcgggttcttctcactgaaacatgactgcggtccaatggctcagatggatttacctatccgaagttctactgttgggccacgtggtccgtggcagcgtcgattccagtgcgaggagcatgcgcgcgttggtgtcgctcgattttcgcgagcgtcgaattttagcgctccatgtgattcacaatgggtcgacctgttcgttgggatcccgcgcattccggctcggcaatgatgccctgaagtttcccttgctgggccgtcgtttgttttgtccctgatgcatgccgtgggaccgtggggttagtaccgggcatcagcctgtttctttgtcccttttgtgctgtgcccacgtggtggttggttgtgcctggtccacgtcccggtggcatctcggctcttctccttgctgatcgtgcaggagtgcccttgtgcctttgctcctgtgtagtgcacgggagcctgccacggtcggggccctgtcctcgtgtccttcctcattggttgcccctttcgcggctgttgagcgccctggggacgagcctcgtcgcgcttcgctgcttgggctctggccttctgtggctgctgccattggcgcttgtgatccttgcctacggccgtgttccggggtgcccaggcgcatctcctccgcctttctggcgccggcttctttcctggtgcgcgggcgctccgggtgccgttgccattacgtggggccaaggtttcaggtcctgtctgtctgggtgccgtgtgccctcggtgttcttcaatgctcgtggctgtctgcccgcttctcttctcctgtgtctgcgcccgtcgccgtggccggcgggcccctcctgtgcccctctgtgttctccg

SEQ ID NO: 553338 - DNA, 220 bp, Homo sapiens
agcgcatcttctcccatcagttttttacttcaagtttactttgtctgatattaatatatccaggcaaattctctttaggttactatttacatggaatgatctttttccattatttaactttcaaccttttttgtctttagatctaaagcgaaggatggccaggcgtgatggctcatgcctgtaatcccagcactttgggaggctgatgggagcaagatgg

SEQ ID NO: 553339 - DNA, 150 bp, Homo sapiens
cccacttccacctttacttaccagacaaccttagccaaaccatttacccaataaagtcataggcgatagaaattgaaacctggcgcaatagatcatagtaaccgcaaggcaaagttgcaaattgtaaccgagcttatatgagcaaggact

SEQ ID NO: 553340 - DNA, 912 bp, Homo sapiens
gagcgtcaacgaatgacagaccattataaagagtattccgcataatgcaacgaactagaatactcgagaaagtccgaaggccacgtaaagtgcctgagctactattaagaatcgctgcccatgtacgcagcagaatttatgtagcatacttaaagccgggaagcgctatggagggaaacgaagaagcttgagtttgaacattacagacacaatgttgatcctacggtacctcaaggggacagtgctagaagtttggccaaacagagcgaacaaaaaggtcaagatgcttacccaggtggctctgccatccccggacagtgccaaggagctattatatacgaggtactcaccagatgagctgcggatagtctgcccattaatagaacagtggcctgtagtgagtccgccctctggatcctgtagctccctgcgtctagacatgtgatggtgattcagatgatggcgagagatggtcgaggctgatgagaaacggaacacacataataggcacttctggatcaggctcctctggcgatgtagtctgaaggggtatatgcctctgcctgaagtcgaggaggagctctcttccagggtaaggaatcggtgcatcgaagacagatcaaaggctgcccagtcctatgaagacagattggtcccaaaacgtcgtgttacgtgtccatgtcgagtgcctgcggtacaatgccataggtctttcgaatgcctatatggttggaatttgtcgtgaacggtatggcgtccaacaaggaaaggaagggctgatcacttataccgtgcccgatgtgagaatagtggccatccttcttgccggtttgggatggcgcgtgttcttgattagacctaccaggggggttgatgtaccgcggattttggaccgccggaaaaatggcggaa

SEQ ID NO: 553341 - DNA, 619 bp, Homo sapiens
gtgtggtatctccatatttaaaagtcaggacaggaaggaagatggggacggattagccatgtgacgtagaagaaccaagaggtgtcccaaaagccagggggagagagtttcaagaaagagagagtgagcagtggtatcagaagctacggatagtccagtaaaatgaggagtgagaatggaccattgaaattagcaacaaagagattccgggagacttggaaaggaacaatttggatacggtggaggatgaaaatcggatcaaagagcaaaaagggacgtggagacattacctataggtgactggggagttccactggtaaggagagctgagaaagggagtgggatctgaaggagaacgtggtgagatggggggttggggggtgagagcaagtgacgtccggtggcttctctttccttaggggaaatggaaagcaaggacataagctaagtgaagaaataggagggggtttggcgagcctaaggagagaggagaaggtctacgtcaccttagagagggggagagtgacctgattagagaactgacgtggatggccaggcagtcctaaaggaggttcaggacagaagtcggtaccgagagttgcatggcccaggatgtcag

SEQ ID NO: 553342 - DNA, 765 bp, Homo sapiens
tccaccagagattggaaatccagattacgttcagtggtatagtttaaaaattaccgaagcaggctgggtgcggtggctcacgcgtgtaatcccagcactccgaaaggccgaggcgggcggatcacttcaggtcaggagttcgagaccagcctggcaacatgatgaaaccctctttctgctaaaaacgcaaaaattagccagacatggtggtatgtgtctcaaaaacaataaattaataaaaagaaaaattactgaggcaactccatcagaagcctgtaccccagactacctggcatagtccctgattgttgaagacaaagtaatctggtgtgtggttggtggaaaacacttgcagaaaaacaatcagaataaaacaaaaactatcaatggatgataacttaaaatggccatagttaatctgatgagagtgtgtttgacaaggaaattggtgacttctgtggcacatggtgttttaaacaataaccaaaattatgactgatgacattatactaggacatatcaacagcaagtgtgctgaaaaactttctgtggaagtttatacaattgtctggaaatatacaaataacatttaacattaacataagcctaatttttaaatatctccttttacaggtgaacgaaaattttttgagatttcccagaatggaaattctaaaatcaggttgaatcacgatttcgggtaaggggggagtaggcgatggggaatggctggcctgcggggtattagcaggggaaattttgaag

SEQ ID NO: 553343 - DNA, 250 bp, Homo sapiens
tggcagctatgtaaaatggatgagttctgatttatcctcagctgggtagctgtggctgtatagcagtactactgattggtgtacattaatttggcatccagaaatttggctaaattcatttatcagttctgggaatttttgggatgagtcttcgggtttcctaggtatatgatcatatcatcagcaaacagtgacaggttgacttcctctttactgattgggatgccctttatttctttctcttgtctga

SEQ ID NO: 553344 - DNA, 1078 bp, Homo sapiens
tgggtttttggggtggatgggtgggctaaaatggcaatagtttctttttgcgggagacatatttctggccaataaaaggactaagaaggggcacaactttttttttaaataaccatagaaggaaagatactttaaaaaaaatctcctagatagttttggtagcggccataacttaattttgtgggtaacaattggtcgcactatttggtagaaaagggaggcaaccggtatgttcgggggttatatgggtaaggtttggttaagggtattagcgctttgggtttttaaagagaagatttaacacagtggtttctggggattaagggatatagctttctccagaagtgtgggtcacatttcatttcctgggtgtgtagagaagcgtctttaaattttcttcgtacctgtgtgtaacccaaaattcttcccagtgttttttaacaacatcctctcacagtggtggggggtttcctttattatacccaacaggcagaaagaataaaccggggcatttattaaaccatctggcgcattaaactgttggggccaaagtgtggtgtggggttctacccttatgaggtctgtataacaaagagaacattgttcctccaagaccagaagaggaaactctgcggcctcacagggggtgttttttaaaaatatgagacgagggtggatctcgagaaatttttttttatccaagatgtgaaaagggttttcataaaggtggccacatttaaacgccttttttccccgtgggagtggcctactagagaatttccagggggcaattttagggggggggggaaaccccgtgtgggttgggaacatcctaaccggggttttttttcaacaaacaattatttttcgacgaacgtcgaggatttttacaaaaggggcgtggggggaaaaaacttattctattattttttggtaaaagaagaatataattgcccaccagaaaagtcaataatatcaaaaggagggtgtagttcaagaaaacaacacggggggtataaataaacaaatcaaccgacgagtcattttttccttaaagaaagaattataataaggattc

SEQ ID NO: 553345 - DNA, 303 bp, Homo sapiens
aatattttatttttttttggtagagccgaggttcccctaatgttcgcccaggctgggtcttgaaactccggggctcaagtcgtatccccccatctcggcctcccaaagtgctggggataccagttggtgagccaccaaccccagctttatttgcacaactttaaaatttagggtaaaacctggtaaattctcccactaggtgaagtcacttaatttatttaaaagctataaaattgggaattatgggatattgaagaaaatctggagaaaaatatgttaagttcagattgtagttcacagtat

SEQ ID NO: 553346 - DNA, 504 bp, Homo sapiens
taggacacaaaggaatgtgctctggagactctcccagcactccctcaacataaggagaagaaaaacaaattttcctttctcttatagtatgagtttatagatttctgttctctgtaactagcaacttcaagcattctgttttatctaagtagtggagtgaaggtcataaactgtctgagcaggcctgagatacagccacctggacgccatagtgaaggtcatggaataagctgtgctaggcactaaaggaaaacctagataactgacatctgggttgcacagcaacggtcatgtgtaatcctgagttatgaacctgtcacaatttgattaattgctctgcctctgtatccttgctttcacaccactgtaactgtaagcctgcttcaagctagcccactccctttttgaagtgtgtataaaagtcaagtgctgtctttgttttaggcccagttttccagatgtaagtctgagtacactcaataaagatcctcctgcttaaccccg

SEQ ID NO: 553347 - DNA, 1093 bp, Homo sapiens
gtgcagtggcacaatcacggctcccaggctaatgtttttatttattaatattagtaatattttttatttatattattattttggttgagataggagttgctccatgtatgcacaggctagtatctcaaactacctaagctcaagccatctgcctagcctatggcctcccaaagtagctgggattgtagacataagccacctcacccagcctaatgaatatataatctaacattgtaagaatgaggtactgtttccatcagtctaatacagatataataaacttccctaccaaacaccagtttcatatttgcattgtcttcattttcattatcgcattgttcactccgtcgataaacttgcacatggacacaatgctcatcatcactacatgcacaaacttagctgcaacgggcacgacttggtatattcagcaaagacaataatattaaacacacgcgacactgccaacatataatatgatacctattcatcagttattttcctaaaaactgctgtattctccagaaaacataaccttcaattacacccctgtttagttgtagaggcttaagaccccaatcttccgtcacatactgtaacaataggggaacaagaaggctaccatgacacctagacatgtgtagccagtaactagaaaggttacacatcctgcacaacacgtaacttccttgcttcatcccactgcccctgtactcaggactccatcaaacacgtccataaccccacaacgaactaaaaaggtaaggcacacgatcaggcacaacagttcctggaagacaccaccaaagggggaccgcaatcacaacagatactttcaatccccaggagccacacgaacgaacaccaacaaaaaccaaccacccatagcacacctgacactaacacgaccaggccgacggaacacacgcgccaatgcaaaaccgaaccaacacggcgaataacaaaagagacacgaacccaagatctgtcgaaagcaatcaaacacacacagagaacgagacacgcaccccaaaaacccaagaaacaagcaacagacctacctcacccaactacgagaatactacacgagcag

SEQ ID NO: 553348 - DNA, 702 bp, Homo sapiens
aacttaggatcacgccggttttcgcaagaatttgagaggctatagcagacaccttaacagagagcaggagtcatagcaagctctcagtaactataagagtagcgtactgtggcaacagtacagacttccacagcatatgcgggcaagagagcagacattgccagttattgacagactgtcgcagaaggagcatttgtaccaggccgttaaagcctgaagtgcctcatatatcgaactaagcactccagtctgtgcgacagatacagactccttgtgacacagctataagtccaatgacgcacacgcgggtgactacaacgtctacctctcaggctcatgagcatcgagtgcctttggatcacgactatagcgtcaacgacagatgaacgctaccactaccagacttttgtacagtcatagcagcatgaggtcatctttatgcaggagattgtcatctgatgactagactccatagcaatacccgcaacgagcgccctaatagttagttttcacgttgaataacagcttcaaacttaacttacgattttagcttagtcactaggcttagaagtagtactgaaggtctaataagaccgactattcaactattaaccgaaccctctgggctaagtaccctgttttagcgcccaagttttacttggctacctaagtccctctatactcacaagcctattgccctcg

SEQ ID NO: 553349 - DNA, 146 bp, Homo sapiens
gctcttaccaacatctactactcaccccactgcctacgaactatcatacgctgagccagcaacttagtaaggactagcttacacaatagcttttatatgtatagatacctcttcacggactccacttatgactccctaaagcccat

SEQ ID NO: 553350 - DNA, 223 bp, Homo sapiens
cggatgtagcgctctaaggtatgggatacagatgaatgcaccatgcatgctaattttgtatttttagtagagatggggtttcaccatgttggccaggctggtctcgaactcccgagctcaggtgatctgcccgccttggcctcccagagtgctaggattacaggactgatccactgggcctggtgaaaatttgtatctgtttgatcagtgtcttcttaatccc

SEQ ID NO: 553351 - DNA, 105 bp, Homo sapiens
agagagttgtctacaagcccgacacagtagcatttgtgccaataactggttggaagtggtgacaacagtgctgagagccaagatgctaactatgccttggattca

SEQ ID NO: 553352 - DNA, 413 bp, Homo sapiens
  misc_feature (124)..(124): n is a, c, g, or t
tttgttcggggtttgaggtgccaccttacaaaaggatgggtgtacgctctcttttcagaatgtggttcatctcaaagccctttacactttggagccaggcctgttcaattttacaaataacacngttttgcttgtagtcagggtgctgtgacaacatgaagagttcgagctacctcccaggatgagtgcaggttttcctggtgacaaatctcaggcattcaaaggttctgttagcagtgccatacttgtgggtttacagagatggtgtgtctggctgagaacaaaggagccgtaccaggaaagttgaagcatatcttcattttcaagtccaggctaaaataaggtctgaggaaaagaatgagctgcgtgtgaaggataggaacagaaatcatgaaagatctgtttgtccaggc

SEQ ID NO: 553353 - DNA, 203 bp, Homo sapiens
tattgactcggagaattactagtgccttccatgcactagcttattatgtacttatatagacagttctataattattctgattataaagatgaaaaaacaaacacacacaagttaactgtacagatgaactggtggcacaatcagcggggcagcgaatagattaaaagctcagcagctaggttggaacactcaggtgactgaat

SEQ ID NO: 553354 - DNA, 234 bp, Homo sapiens
  misc_feature (15)..(15): n is a, c, g, or t
  misc_feature (28)..(28): n is a, c, g, or t
  misc_feature (126)..(126): n is a, c, g, or t
  misc_feature (128)..(128): n is a, c, g, or t
  misc_feature (167)..(167): n is a, c, g, or t
  misc_feature (170)..(170): n is a, c, g, or t
  misc_feature (174)..(174): n is a, c, g, or t
gcgactcctctgagntgagtttgaggcngtccccgactccttcctcccccttccctcccccttttttttgttttccgttcccctttcccctcccttccctatccccgacgaccggatcctgagtgnanaggcggtggcagctgctgagttctcggtgaaggtgagtntgnaccntgccgccgccgagtggagcgctctaaaatggccgccgtccctggtcgcttcttctcgagt

SEQ ID NO: 553355 - DNA, 158 bp, Homo sapiens
acattaacatttgaacttagctagtaattctataactgacctattccccgtactaacgtattggtgtccccgtgtggcatgttttctagagcgttcctactttaaagcatggaacatgcaggtgatatgggaagtgttgaaagacctgagaaaacgag

SEQ ID NO: 553356 - DNA, 142 bp, Homo sapiens
ctcgctccctttccctaatttcctctgtaaacggttggaatttcacaagtcgagcattctcaatctgtcgcatcagtttcaccgcacaagatgccctcaatggcttgtccatggtaagcacagccccttctgtcgtcttctc

SEQ ID NO: 553357 - DNA, 207 bp, Homo sapiens
tgttgcatggcatcatctgcagcaattcgcgcttcaagcatgttggttcgcgcatgcaggcaagcaagcaaacagcaaggcattgggtgcaccacagcaagcaagcaagcaagcaagcattcaagagcaacaagtcaccatccgcatccacagcaagcagcgtccaaccaacacaccacacagcccccatcgtcggcacccagcaca

SEQ ID NO: 553358 - DNA, 196 bp, Homo sapiens
gtggccttcgcggctgtcggacaacttctggtgggcctgtgcggaaggcttgaggataaatcgctgtagctgcatgcacttgacatggcctggcctgtcgtcctcacttcagtgccaggtccattcgaccaaagcccttttctgatcaactatctcattgtccagcccggggctaccgagcctcgtaattcgctaa

SEQ ID NO: 553359 - DNA, 188 bp, Homo sapiens
aacctttccccccggggctttttttttttcccaaggaattttttttttttctaagggggcctttccccccccctaatttttttttattttttaaaaaaaattttcccccttttttttaattttcccgttttaaaaggattttttttttttttttgggtttcctttccaaaaaaaaaaacttttttcca

SEQ ID NO: 553360 - DNA, 978 bp, Homo sapiens
agagaataaggagactggcggagatggcagtctctcgctggccctgacgctgctcctgctgtgcagactctcccgctgctcaggcgagggcctggctggagcccccagatcacgcccgttccgtactgacacgcagcttctgagcgctggtcagttgtccacgtgaagagccgttcattcagtggctggagatctccctgaaaatgcaagaacagggttccagaacatggctctctatgctgacgtcggtggaaaacaattcccgtgtcactcgaggccaggatgtggggcgttatcaggatgtcctggaagcctggagcacagagaggcgcccactgctaggcacctgatgagtgttacgacttcttcgacgaggagtccgtacaggctcctcaggaaggctcataggaagtaacgaggacatttccatcatcccgcctctgtttacagtcagcgtgggaccgatcggggcacttggaacgggcccgtgggtgtccactagaggtgctggctgcggcgatcggcgcttgtgatcgtacgtacttggccttcagtgcgaagagccgacatgcatggcctgagggcgggagcccagccctgtccttgcttccttctaataaacatcacaggagctgggactgcccaacaaggtctacatgcctccctcttacagaggtaagacacatgggtgggaccaagggcctcaaggaccacgtgagccgcaaccttcatgtacaggcagcaggccattgtctatcctacagctaggccactaagggagggctcgaccgtgatgaatagagcccatatgggcttgaacccataatccacctggagtcccctacgtgtttgaccatcaagccgcgatagtgcacactctccgttgaaaggaccactgccccaaacgcacggaagcggaatcaactagagggcaccacacctccagggaaactgtcacctctgacgtgcatggaggca

SEQ ID NO: 553361 - DNA, 886 bp, Homo sapiens
  misc_feature (11)..(11): n is a, c, g, or t
  misc_feature (16)..(16): n is a, c, g, or t
  misc_feature (32)..(38): n is a, c, g, or t
  misc_feature (40)..(40): n is a, c, g, or t
  misc_feature (43)..(43): n is a, c, g, or t
  misc_feature (45)..(45): n is a, c, g, or t
  misc_feature (106)..(106): n is a, c, g, or t
  misc_feature (108)..(108): n is a, c, g, or t
  misc_feature (116)..(116): n is a, c, g, or t
  misc_feature (143)..(143): n is a, c, g, or t
  misc_feature (148)..(149): n is a, c, g, or t
  misc_feature (236)..(236): n is a, c, g, or t
  misc_feature (256)..(256): n is a, c, g, or t
  misc_feature (328)..(328): n is a, c, g, or t
  misc_feature (381)..(381): n is a, c, g, or t
  misc_feature (449)..(449): n is a, c, g, or t
  misc_feature (472)..(472): n is a, c, g, or t
  misc_feature (476)..(476): n is a, c, g, or t
  misc_feature (486)..(486): n is a, c, g, or t
  misc_feature (572)..(572): n is a, c, g, or t
  misc_feature (578)..(578): n is a, c, g, or t
  misc_feature (582)..(582): n is a, c, g, or t
  misc_feature (604)..(604): n is a, c, g, or t
  misc_feature (606)..(606): n is a, c, g, or t
  misc_feature (639)..(639): n is a, c, g, or t
  misc_feature (644)..(644): n is a, c, g, or t
  misc_feature (662)..(662): n is a, c, g, or t
  misc_feature (678)..(678): n is a, c, g, or t
  misc_feature (699)..(699): n is a, c, g, or t
  misc_feature (702)..(702): n is a, c, g, or t
  misc_feature (705)..(705): n is a, c, g, or t
  misc_feature (715)..(715): n is a, c, g, or t
  misc_feature (728)..(728): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (842)..(842): n is a, c, g, or t
gacgcgcggcncccanccctcccctctcacgnnnnnnncnctncncagtgtggccgcgaccctaccctctgcaaggcgatggcccgcgccccgagcgcagggtggngnggctgggngggcggccatgggctgtatcggctctnggggnncggcgggtcaggcatttctggggaccaacagatggccgaggctcagaggatagagacggctgctccagctaaaggtgaatgttgganacacagtcagcgatgctgcncaagtacaccgagcgagccctaactatccaggagatcgctgcgctggacaggtcctccctgcatggtatttnccaggtggtgaaggaacacgtgaacaagcctaccgacatggcccagggacgantggctcacctcattgagtggaagggctggagcaagccgagtgactcacctgatgccctggaatcagcnttttcctcctattcagacctcancganggcgaacaanaggatcgctttgcagcaggagtggctgagcagtttgacatcgcggaagccaagctccgagcatggtcttcggtggatggcgaggantccacngatnactcctaagatgaggactttgntnggggaatggacacagacatggctgggcagctgnccctngggccgcacctccagganctgttcaccggccacnggttctcccggcctgtgcgcnaangcnccgtggagcntggagagcgactnctcacagaccgtgtccccagacaccctgtgctctaanatntgnagcctggaggatgggttgttgggctcccggcccggctggcctcccagctgctgggcgatgagctgcttctngccaaactgccccccagccgggaaagtgccttccgcagcctggg

SEQ ID NO: 553362 - DNA, 386 bp, Homo sapiens
ctaggtactctagaggatctctcctctcgacatcttctgtaacaccaggtcccgcgaagcgcgtgtggcgccacggcggacattgacggctcttgagagtctcatcgagatgggcttccccagtggacgcgctgaaatggctctggccctcacagtgaaccagggcatcgaggctgcgatggactggctgatggagcacgaagacgaccccgatgtggacgagcctttagagactccccttggacatatcctgggacgggagccccatttcctcagagcaaggggggcttgaaagggatcgtgggttctgctgccggaaaaggcaaaacccgcttggagtgaagagggaaaagactgggaacaaaaactaagaggaatgtcggaag

SEQ ID NO: 553363 - DNA, 108 bp, Homo sapiens
ccgcctcagcctcccaggcagctgagaccacaggcgcatgctgccacgctcagctaatttaagaacaaaaattttagggtggcggtttctcactatgttgctcaggcg

SEQ ID NO: 553364 - DNA, 169 bp, Homo sapiens
cagaggtcaggctcgctcagcgtcaggtttgattcgggaggatcctataggtgcgggggcttatgtatgatatatgggcgttgatttagtactattcactgtttagtaacctcgtttagtatggtgtatattttcgtaattatacgattgctcggggaatctcggttat

SEQ ID NO: 553365 - DNA, 1170 bp, Homo sapiens
gaatcttagttcaacgtttaaattatgccacacagaacccatctaaatccccttgtaaattataacatgtatagtccaaagaggaacagcatctttggacacctacggacacaaaaccctatgatacgaagacgacgccaaaacaaaaaacacacccacaccaccacacaaacaaaacaaagagagaagagagcacagccaaaccacaacaaaagaacacacaaagacacaacaaacgaggagagcgcgcgccgcaaggacccaaaaagagaaaagaaaaaacaaggagaaaaaaagcagaacacacacacacacacacaggaggaaagaaaacaagaaacaagggaacaaacaagacagaaaaagaaacacaacagagagacaaaaaaacagacaccaagaagaaaaagaacaacaaccaacgagcgagcaacaagggaagcaaaaaaagaaggagaaaaaacaacaaacgcgaccaacaacaagaaagcaacgcaggacacacacgacagaaaacaccacacaagagagaaacaaacacaacaacaagaagagggaacacgcagcacaagagacaagcaaagggaacacaaaacagacaggagaaaaacgagacacacgaaggacacaaaacacagcagaggaagacaaagaaagaaagaaggaggaaaacaagagagacaacagaaacgaactaaaagacaaagaggagaaaccgcgaacagataagagaagagagaaagagaacagcaacggcaaggaaacaaaaaagaaagcagaagaacacaagacaaacaacgaagaacggaagagcaaagacagaaaaagcaagagaaagaaagagagaacaagaagcagcacagacaaacagcaagaggacagaaaggaaagcagcagcaggaccccagcaaagcgaggagaaaaaggaacacgagaaagagagagaggaaggcagcccccgggtagctcgaaaccaagaggaggcagcgaaacacacgaagcgcggacagagagaaagagagggaaaggagagggcgcgacgcacacagcagcagaggagaagcagcagaaagagtagcaagcagcagaaggcgacagggagggggacgacgagagggagaaggccaaacgagaaccacgggagatagcgcgcagggcagagcgcaagcg

SEQ ID NO: 553366 - DNA, 369 bp, Homo sapiens
caacctcttcatggtgcgcttggcacaaggcctgacacatttaaggaagggcacccttaccctctgcccctaccacagcgaccggcaacttatgaaccaagtggacgaggctggactgctcactgtgcttggctctttcctggatggtcgaaacattattctaagcaaatcacactatttattgcatgggctgggggctgccatgcaacccccaatgctggttaccttagatgaagaactgcggccattggcaatgtctgtccctgtgggccatgcaaaggacgttgtgggccaagctggcaaaccgaaaactatcacaaggatccagacgcatacaaccccaatggtggtggcccacggggaacgggc

SEQ ID NO: 553367 - DNA, 387 bp, Homo sapiens
agggtacagctcctgcagctgctttcatgggctggcgttgagtgcctgctgcttttctagtcgtgtgggacaagccgtagatggatctaccattctggggtctggagggtagtggtcctcttctcacagctccactaggcagtgccccagtggagactctatgtggggctccagtcccacatttcccatccacactgccctagtagaggctctccgtgggggcttcgcccctgcaggaagcttctgtctggacatctggacatttccatatacttggcctccacatccggcatcctctgaattcaagcaattctcctgcctcagcttcctgagtagctgggattacaggcatgcgccaccacagatgtatggatgatatccatacat

SEQ ID NO: 553368 - DNA, 499 bp, Homo sapiens
  misc_feature (37)..(38): n is a, c, g, or t
  misc_feature (463)..(463): n is a, c, g, or t
  misc_feature (474)..(474): n is a, c, g, or t
ttttctaacattgccttacaccgtgtttctctttttnngggaggggtggggtgtctaatgctgtggtcttgctcatctgcatggtagtgccatgagggtagttgggttcctcctggatctctcccaggtctgttggagagaacagacagacttagaacccctggagggaagctggcagcttacctcacccttgggtacagagtcttggaggtcctcctttctggcatcagctgggtaggcaggactttgttctctgagtcactttgggtcagtcccttgcctcgctggctctgcaggctgaattcaccttctcaacacctagcccatgttttcctgcagccttatggctgctattcctcccaagtgagttccagcactggctcaggcatgctagttctttaccacagagctgctcaagtgcacaagcaactgcagtggaagccccatgacattccagtctgtngagtgggcaanacctgggaagcaagttcaatgccgt

SEQ ID NO: 553369 - DNA, 775 bp, Homo sapiens
  misc_feature (208)..(208): n is a, c, g, or t
ccaggagggcacagcactgcacctgcagacaagcctgccagccctttctgaggcagatacccaggaactaacccagatcctgaggaggatgaaggggctggccctggaggcgagagtgagctggagagacaagacgaagccctggatggcgttgcagcagctgtggacagggcaaccttgaccatcgacaagcacaacaggcggatgnagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 553370 - DNA, 1129 bp, Homo sapiens
  misc_feature (208)..(208): n is a, c, g, or t
ccaggagggcacagcactgcacctgcagacaagcctgccagccctttctgaggcagatacccaggaactaacccagatcctgaggaggatgaaggggctggccctggaggcgagagtgagctggagagacaagacgaagccctggatggcgttgcagcagctgtggacagggcaaccttgaccatcgacaagcacaacaggcggatgnagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttcaaaaaaaaaaaaaaaaaaaaaaaaaaaaaaaactgtggtgggcgcgccggcctggggcccccggaaaagtttccttaaaccatctcgttggggcggcggccgggcgcccaggtagggtacaggttagacacttgggggcaaatacgcggggtcccaaagggagaacccgggggcatagaacttacgctgcgtggggtttctacaccaataaaaaaacgcgccgcggggggaacaccgagcggcggtttggagaacaaaattcacagagaggggagatccgagggtcaatcaccggggagctctatacaacagggagtcaaaggagaagctcggatatcaaatacggcccgagatg

SEQ ID NO: 553371 - DNA, 515 bp, Homo sapiens
ccaggagggcacagcactgcacctgcagacaagcctgccagccctttctgaggcagatacccaggaactaacccagatcctgaggaggatgaaggggctggccctggaggcgagagtgagctggagagacaagacgaagccctggatggcgttgcagcagctgtggacagggcaaccttgaccatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 553372 - DNA, 304 bp, Homo sapiens
cgtacaatggcccgccctgccccaaaggaggactgtgtctgtcgatgagtgacggttgagtgtccatagctgcatgtagtgtgtaccacatggagcttgcccactggatggcagacttcacctgggggcagctattgtccaactgcacaggacacttgcatttgaagaattgtgcacatacttatcttgactgcaggtgtctcaataagtacttcacgcagatgcatgtaacgcccctgaatggatgtataaccctgattgccctgacatgcgcacttgcatgcactgtgttccacccattgct

SEQ ID NO: 553373 - DNA, 486 bp, Homo sapiens
agatccatttatctttttctctccctttttttttaatttttatcttttgagacagagtcttttgctgtgtcacccaggctagattgcagtggcatgatctcagctcactataacctccgcctcccaggttcaagcaattctcctaccccagcctctccagtagctgggcccacagcacatgccaccacgccctgctaggtttttttttttttttttttttttttttggtgtttggtgtttggtatgtttagtagagacaaagtttcactatgttggccaggctggtctcgaactcctgacctcaactgatctgcccacctcacctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcat

SEQ ID NO: 553374 - DNA, 295 bp, Homo sapiens
cggcacgaggaaacaagaagtttaattgactcagttccacatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagta

SEQ ID NO: 553375 - DNA, 548 bp, Homo sapiens
aaggggggggtcccccccggggggggccgctttaaaattagggggtcccccggggtgcgggaatttggcccgggttcagctttttttcagggggggtcttgtgaggaagggccttttccaaaaagggaaggggcgaaaatccccgcttccccaataatgaaatggcccagattttgttttttttttttttcgggggtgggaaaatttgggccgggctttttgtggggggggcttaggaccgggggggggggaaaaaatggggaaaaaaactcggttttcctccccgtttttttaaagggaccccgttggggggtaaaatttgtttggcctaatcgagggaaaaggccctgtcttttttcccccctcctgcaatcccccgggcagggggattcccctgttgttttttagtaattccctggggtttaaaacaacccggggggggcctttttttgggcccttttgtccacccctttttggggcttttataaacatagtgaacttgctggttgaaaaaaaaaaaaaaaaaaaaaactcgcgtggtggtttta

SEQ ID NO: 553376 - DNA, 266 bp, Homo sapiens
  misc_feature (35)..(35): n is a, c, g, or t
  misc_feature (51)..(51): n is a, c, g, or t
ttcacgtgctgcacagccacactgtcatcacaggnaaacctgctcctaganacacactcccctgcccagcaggaggagggcttatcaccccagctaggttgagagcaccttctaagcaggggtcccacattcccaatccatgtctgcactggatgtgtccacaatgtcaactctgctaacagtaacaactactgcaaaggagcataccttgcattctcccaaagagggataatggggaagtgacagtccctttaataaagtccagg

SEQ ID NO: 553377 - DNA, 464 bp, Homo sapiens
  misc_feature (6)..(6): n is a, c, g, or t
  misc_feature (123)..(123): n is a, c, g, or t
  misc_feature (181)..(181): n is a, c, g, or t
  misc_feature (220)..(220): n is a, c, g, or t
  misc_feature (272)..(272): n is a, c, g, or t
  misc_feature (341)..(341): n is a, c, g, or t
  misc_feature (413)..(413): n is a, c, g, or t
  misc_feature (442)..(442): n is a, c, g, or t
  misc_feature (446)..(446): n is a, c, g, or t
ctcgcngagtcagatacagcagagaagggaaagtcaaatttccggaatggctatgtgtctggggtttcatccatccgacatggaagtggacttactggaagaagggagagagaatggaaaagnggagcattcagactggtctttcagcaaggacgggtctttctatctctggtactacacngaattcacccccacggaaaaagatgagtatgccggccgngtgaaccaggtgacttggtcacagcccaagatagttaagtgggatcgagacntgtaagcagcatcagggaggttggaagatgccgcattgggatgggatgaattccaaattcggctggctngctttttaatatggatatgcttatacacttacactttatgcacaaaaggtagggttataataaggttaacanggacatgatcttctttataattctacttngagngcggtctccatgtttgat

SEQ ID NO: 553378 - DNA, 168 bp, Homo sapiens
  misc_feature (62)..(62): n is a, c, g, or t
gaggtgatctagaggatcccggcgcacattttaacattgtcatcggtaggcacataaccagnccagccgttgaagggacagatctcaggctgtcaccatggaactgcagaccttccctcctccagaaccttgaagggaagccctgagagaacccaggaattttaaggg

SEQ ID NO: 553379 - DNA, 768 bp, Homo sapiens
  misc_feature (120)..(120): n is a, c, g, or t
  misc_feature (148)..(148): n is a, c, g, or t
  misc_feature (157)..(157): n is a, c, g, or t
  misc_feature (176)..(176): n is a, c, g, or t
  misc_feature (190)..(190): n is a, c, g, or t
  misc_feature (196)..(196): n is a, c, g, or t
  misc_feature (222)..(222): n is a, c, g, or t
  misc_feature (327)..(328): n is a, c, g, or t
  misc_feature (367)..(367): n is a, c, g, or t
  misc_feature (377)..(377): n is a, c, g, or t
  misc_feature (393)..(393): n is a, c, g, or t
  misc_feature (399)..(399): n is a, c, g, or t
  misc_feature (417)..(417): n is a, c, g, or t
  misc_feature (431)..(431): n is a, c, g, or t
caaagataattgatttgatcttatatttatttgtttttaggataatttttgatctttttgtaaactgctttgcttgttaatatctggtgaaaaatcaaattgagttcatttgtgttcacntttccatattttcccgagatatcctagntcatcaaangataacaggttcatcaganattacagtcagaanaatccntttttctaactggaataggttagcangggaaacaatatattcttgtatatttaacctgttcattatattcgtgtagtgctattatagctgaaaaacctcatgttcttataaagcatagctgtgttggtcanncagttttatacataagttcataattatttcatggtgcgncctatttggnaggcccgtgttagacnttttanacaatcccatccatatcntgtaattctctgantggcaagaatggatggagcatttctgagttaacagtgctggacagtatcgtactgggtgtcataaactctttatgaatggtaatattattgtaacattggaacatctggggccctcaaactatattgcaggttttcagacagtatgttttgaagggcctcttttggtgtaatgaatttctgttaatggtcttgaactttatgttcttgaaggtggctttaacacaagaatttgaagggttgataattaatttaatggggaacagtccgggacacttgttgttggaagaaccaaaaggtttggtttggagaaagggcgcccaaagattgggacttggg

SEQ ID NO: 553380 - DNA, 689 bp, Homo sapiens
cacagggctcatcccagtttagtaagcgccgcatttacataggtaaagcggcaagcactgttgtacacaacggcaaacataattaatgtctatgaaagaactccagctatctgtggtctggaaaccattatgtgctctagcatgaaagactctcagtaatcagcagagtcaacagtcttcgcacagactctgtgctgaacggtagaccatacgcttgagctccgtcagtcaatgaaacacacgttctcgtatagtcatatgtttggacattcacatccatacagatttgatgcgctccatctaggctgtagagagcattcgagaaacatattgcgctccctgagcttgtgtcaccctatcacaatgctacaaaagagctggtgaagtcttcatgtatcagtacacagcttgtgcagatcagtgttcccatcctgttcatcagttctcacgtgtgtcccaagagggtagagcccttgttagtgcaagacaagcagccttagtcgatcacagtctcaagtagcagcgtcgctagcataccgtcagtattcattcaagctagttaacctccttcgtggaaacagcagtagctctctgtagcaggagtaaatcccactgcctgtctaaataacacattattctctggccttatagctcttatacatgtgcttctctttctaaataatggtttg

SEQ ID NO: 553381 - DNA, 156 bp, Homo sapiens
ttattataataatttgtggccacacccatagcatatggaagttcctgaggccagagatcaaatccaaaccatagctgcaaactatgctacagcatgtagcaagagccaaatctattaacccacagatgccaggccagtgggcttatccgaccgaca

SEQ ID NO: 553382 - DNA, 85 bp, Homo sapiens
cccgctccccgtcctcccccctccccgggggagcgccgcgtgggggcggcggagggggagaagggtcggggcggcaggggccggc

SEQ ID NO: 553383 - DNA, 80 bp, Homo sapiens
  misc_feature (33)..(34): n is a, c, g, or t
acatctgtgtacttctgtgcatcagtgacgggnncgcagatacgcagtattttggcccaggcacccggctgacagtgctc

SEQ ID NO: 553384 - DNA, 83 bp, Homo sapiens
tctagaggatcctacatgatgctccacgctccaatcgactgctgtcacttcaccgttccagtttttaaatcctgagtcaagcc

SEQ ID NO: 553385 - DNA, 158 bp, Homo sapiens
atacgaactcgagctttgtacccgtcgatagggccactccatattacatggcaatcgtaacgatggtcgcacagcagatctaggacatgatgcaggcctgataactaatggtcgccgcccattgtatcccccatataaatggctgctcacatcaccta

SEQ ID NO: 553386 - DNA, 763 bp, Homo sapiens
gagccgggacgtattaaagggaccggagcggggagttcccgacgccgcagcgtcgcttcccttccctccctctctggccctccctcctcccaccacatggtccctcccccagcgctctccagtttctgtgccccaggagctacgcgaagtcttcaggatatggagtcctgagcgagcaagtttgcctcaagagccctcggagtaaaaacagtgactttcacatgggcgcaggaggtcctctgagcacgtatggagacgctggacaatgagtccctttcacagccaaaagcgtcgtgacggcaacatgctgtggcagggcctttcaggacccgctggccccggcgccgagcattcacggtgcgcttgggacgaggaccctcgcctgtgtcaagggaaacagcaagcgtgaacctactgggatccactaagcagtcacaaagggacaggcccttttcaaaccgaacttggaaatagacgctagtgggcacactgtcaacaagtctccggaatgtctccgtgacaaggatgcaagagaaggagagctggatgaactgggggataaatgtgatagcaaggtattccagaagtaagaaaggaggaaccgaacaggttcacaagttgagtgcggagtggagaagtctcagaaaatcataccgatggcctgtccgagacagtggctgggacagagtcatgggcaggtcagtggttaaccgagggccatgaaaggagttggcatcaaaggagcatggccatttcgttgagc

SEQ ID NO: 553387 - DNA, 136 bp, Homo sapiens
gtacctctatcttatctgaagctcaacattcataattagtgcccacacaactgctgtgtcttcatttcatagattggatttgggttgggggagtattttctttgagagattaaggatagagagattaaggatagag

SEQ ID NO: 553388 - DNA, 796 bp, Homo sapiens
gaacaccgccagcgccttgacaccagtgatagaaccgtggaaaaagcggaggggccggaagggagcaaaagaggaaaggggagagacggtagcaagcgtgtaccgaagttagaccaaagggagaaaaagggcgaacaagggggacaaaaacgaggacagagaagaaaaaaagaagaggacgatgacacgagaaaagaaaacgagcgaaaagaagacaggaagggaacagagaaacaaaggaaagaaggacagcacgggggaagcaccgaaaaagcacaaagggagaaaagagaggagaaagaggaaagagagtgcaacggaacaaagagtagcgaacaggggaaagacacaagcccagcaagagagcaaaaacgcggaagagcacagggaagagagggccaacagagggaaaaaacaggaagagccaagaccaaccaaaatgaggaaaaggaggagagctccggacaaaagggaaggcagcaaaagagggcagagcaggggaagaggcccgatacccaaaaggacgctcacggaggagagcgaaagaggggaacccatgaagagagaccacgccgaacagaaagaaagaaaagcggcgaaaacgagaaaaacaggggcgaagccctgaagagagaaagcaataaaagcaacagaacacggagccggaggtaagaacgcaagcaaccggcaaacagccaagggagaaaaaaaccccgacgaagacaaagagcaacagcgcgagcggcaccaagaacagctagaagaacaatggcgaaagaatggggcgcgcgggcgc

SEQ ID NO: 553389 - DNA, 956 bp, Homo sapiens
gcccggctcccgcccccgcctgcgccgcgcctccctgctcctctgccgccccgcctgctggtggcactctcagccccgcagccggccccgcctccccggaagggccccgggagaagcagctgccccggctcatcatcagcaactcttctgaaggccaagcacaagccgggcggcaccccaaacctgcagcagaagaagagccaggcccggcctggcccccgcagcactcgctgtcctgcttcccagtaccgcaagctcgcactcactccccagacaggcatcctcactctacgacgctgctgcaccaaccccaacccgctccgacgctgcgcgcccacgctgccccacacacgacctaccgcgcaccagcgaccctgccgcccgcctgccccgcgcccagccccctcctactcaccccggccccggcagcagcctgcccaccaatctgcctacctgccacggcccgcacccccactcaaagcgctactccgccattccggccgaaggccccaaccccccgcgcccgccacccgacccctgcctcgccgcccgccccccaccggacgccccaaccccgcaccgcccacgcccacccccccggcccacccctacccgacccgacccgcccccgcccccccgcccaccgcccgccccccacccccgcccactccgacaccccctgccccgccgcggccaccccttgactgaccgcactcacccgccccgccccccaccaaccgcccccccccccccccccccccccacaacgaccccggcaacccatggcacccaacctggcccaaacgcccagcccaagcgccccccacccccccgcccccgcccaccacgccccaccggcggccccccaacctcacccaggcacggccgggaaacgccccacccccgcccccgccttacccggcgcaagcccacaaggcccccccccaccccccggg

SEQ ID NO: 553390 - DNA, 261 bp, Homo sapiens
cctccggccggcatacttggacttctgggtcaagcaattctcctgctcagcctcctgagtagctgagattacaggtgcccgctaccacacctggctaatttttttgtgtttttagtagagacagggtttcactgtagatggtctcgatctcctgacctcatgatctgtccgcttcggcttcccaaaatgctgggattacaggcgtgagccacttcgccctgcccccccccccttttttttttttttttttggaaaacgggg

SEQ ID NO: 553391 - DNA, 217 bp, Homo sapiens
gtctctcaggtctgacttaacttggtctttcatctagaattatgtgacatgctgtcatgacctccatcctttagcaatttactccttttacagactctgtcctgattcccttgtccctcttcctatttctgtaaatgctcttatcttttcctctactgactcttatacttttgctatacatttcaatacctgcctggttctcctccccgggatacag

SEQ ID NO: 553392 - DNA, 721 bp, Homo sapiens
cgcggcggctcacgcctgtaatcccagcactttgggaggccggggcgggtggatcacttgaggtcaggagtttgaaaccagcctggcccacatggtgaaaccccatctctactaaaaacacaaaacagctgggcattgtggcacacacttgtaatcccagctacttgggaggttgaggcaggagaactgcttgaacccaggaggtggaagctgcagtgagtcgagatcacaccactgcactccagcctgggcaactgagtgagacgccgtctcaaaaaaaaaacaaaataaaacaaaacaaaaagaccaggctgggcaacatagcaaaatcctgtttctaccaaaatttttaaaaaccagccaggagtggtgtctagtcctagctacttgggaggctgagtcagggggatcccttgaacccaggagttcagttacagtgagctgtgatcatgtcactgcactccagcctcggtgagagagcaagactctgtcccaaaaaaaaagaaagaacgagagaacagagagagagcaacgagcagagggagcagaaagtacctcaacactggtaaccatagagaagacccaaaatatagggaatatagtccaaaatgaccattcgctgggtgcggtggcccaagttcgtaatccagcactttaggaggcaagggcagaggactgctggagccaggagttagagaccagctgtgcaacatagaggaga

SEQ ID NO: 553393 - DNA, 497 bp, Homo sapiens
  misc_feature (1)..(1): n is a, c, g, or t
  misc_feature (62)..(62): n is a, c, g, or t
  misc_feature (68)..(68): n is a, c, g, or t
  misc_feature (71)..(71): n is a, c, g, or t
  misc_feature (108)..(108): n is a, c, g, or t
  misc_feature (110)..(110): n is a, c, g, or t
  misc_feature (117)..(117): n is a, c, g, or t
  misc_feature (136)..(136): n is a, c, g, or t
  misc_feature (139)..(139): n is a, c, g, or t
  misc_feature (142)..(142): n is a, c, g, or t
  misc_feature (152)..(152): n is a, c, g, or t
  misc_feature (154)..(154): n is a, c, g, or t
  misc_feature (167)..(167): n is a, c, g, or t
  misc_feature (175)..(175): n is a, c, g, or t
  misc_feature (202)..(202): n is a, c, g, or t
  misc_feature (204)..(204): n is a, c, g, or t
  misc_feature (213)..(213): n is a, c, g, or t
  misc_feature (245)..(245): n is a, c, g, or t
  misc_feature (248)..(248): n is a, c, g, or t
  misc_feature (256)..(256): n is a, c, g, or t
  misc_feature (269)..(270): n is a, c, g, or t
  misc_feature (273)..(273): n is a, c, g, or t
  misc_feature (313)..(313): n is a, c, g, or t
  misc_feature (317)..(317): n is a, c, g, or t
  misc_feature (329)..(329): n is a, c, g, or t
  misc_feature (356)..(356): n is a, c, g, or t
  misc_feature (358)..(358): n is a, c, g, or t
  misc_feature (361)..(361): n is a, c, g, or t
  misc_feature (369)..(369): n is a, c, g, or t
  misc_feature (373)..(373): n is a, c, g, or t
  misc_feature (379)..(379): n is a, c, g, or t
  misc_feature (389)..(389): n is a, c, g, or t
  misc_feature (497)..(497): n is a, c, g, or t
ngtttccgcgggtgggtgttcgggggggggtggggagaggggggggggtggggccatggggntcaaangcnagaatcttactcctaaataacataaacagcaatatgngngactacngtcattcattaacttcggnggngangttcattaancnggccattaaaagngcatttgngcaattccaagggggggggggggtaantntccaaatcncccaatagacaaggaccccagggatgacatanagngtgctcanttccacccagtgnnacngggaacactggttgctctcttcaaacacggggccaagggngggnctcatgtcacangggggggggcagctgggggggggggcncnggncccacaancttngggccngggggggggnggggctcgggctccctcttgctcctctcccaaaacctcttcataaggggggggggagcgggggggctctcttgctttgggcatggccaaatattttatggccttctcn

SEQ ID NO: 553394 - DNA, 1171 bp, Homo sapiens
  misc_feature (580)..(580): n is a, c, g, or t
  misc_feature (589)..(589): n is a, c, g, or t
  misc_feature (603)..(603): n is a, c, g, or t
  misc_feature (618)..(618): n is a, c, g, or t
  misc_feature (621)..(621): n is a, c, g, or t
  misc_feature (685)..(685): n is a, c, g, or t
  misc_feature (821)..(821): n is a, c, g, or t
gctatgtacgagggccgggtgtgtattctgcctgtagccctcgtcatggtggcgcctgtgttggtacttgtgtagcggcggctctgctagtcggctttatcctcttcctgactcgcagccggggccgggcggcatcagccggccaagagccactgcacaatgatggagctggcatggagcaggccggtgtggcccagcctggtgcccctgtgatgcctgacgtgatgcctgagatgctggatggcaggcctctggctgcctggacggtgacctggtgcatgcctgcctacatggccctagctgtctgagcccatgctgggtggcctgggcacgaatgcagatgacgaacgaggaggaatgctgtcatcctagcccaggatggaggaaggttgtcggagaatgccagctggaaactcacctgtctggggaaaattggacgctaagaaactgcggaagctcggaggagaaacaagcgcgaaaggcccagcgtgaggcagatggaggctgaacgtgaggatgcggaaacgactcgagtcccagcgcgaaggctgagtggaagaaggaggaggagcggcttcgnctggaggangagcagaaggaggnggaggagaggaatgnccngcgaggagcaggcccagcgggagcatgaggagtacctgaaactgaaggaggcctttgtggtggnaggaggaaggcgtaggagagaccatgactgaggaacagtcccagagcttcctgacagagttcatcaactacatcaagcagtccaaggttgtgctcttggaagacctggcttcccaggtgggcctacgcactcaggnacaccataaatcgcatccaggacctgctggctgaggggactataacaggtgtgatttgacgaccggggcaagttcatctacataaccgcagaggaacttggcggcgtggcaacttgcatacgacaagcgaggcgaggtgtccatcgcggagcttgcccaagcatgaagtcgctcatcgcctgggcgggagtccctaggcagcccagctaacccagccttcctcttggaccagagttgtgtggctagttgtataatttaatcgtcgagagctgggagtagtgttagcgggagacaataagatgtagactgtaaaaaaaaaaaggggggcaaaaccaagggcggaagacggt

SEQ ID NO: 553395 - DNA, 990 bp, Homo sapiens
  misc_feature (971)..(971): n is a, c, g, or t
gtcgcccggggccatggagcagcggtactgcaagccgagtggtgtcccagtcggggggcctccccggaagtcatccatctgaatgtgggaggcaagagatcagtactctcgccagattctcacctggatcccagattccttcttctccagtcttctgagcgacggcatctcgaaggctggaaaagaatgagaccgggagacaatctttcaatcggcggaggaaccccttaaagttttacgcccccattcttaaatttcctggggcaaccaaaagagttgggatccccagggtggggtccaacggggtccagcctcttccaatagaaacggcccaggtttctatgggacttcacctccttcttggttttccggtcggccgtgagggttacgaagagaggaacgtctggaactcgatctcctttggggcaaacacgggtctcttctctccagtggtataactgtgcgtgccaccaaggtgtgccccaggtttgacacgcgggggagaccgtgcacacaggcctaaggtgggggctccagcaagcgtaatggaagggacggggcaagccccattgtccgtgccggtagaaaatactgatgcccccacaagctttggtccttccgtccgagacacccaaggttccattcgtaacaaaggcaacacaggggcggatccgcgggtttgggaattggccgtcacccaaggccattggcgatgcgtccagagagggttgcacgcaatcaaccagttattagaggggggaaggtctactactcgtggtgcacacaccggccattacctacggattgtgaggcttccctttgcgattaaagaacgaattctttgtcagagaggctatcgcacacagggagatgtgcgccggctatggaactaccccaagcatgatgggcttggtaatccatcgcacaaggctggcactcgcaccagaatgggtgggcctcacacattgtgncgcggaaaattgtgaacca

SEQ ID NO: 553396 - DNA, 595 bp, Homo sapiens
  misc_feature (109)..(109): n is a, c, g, or t
  misc_feature (245)..(245): n is a, c, g, or t
aacaaggcctaatggacccaatgggatttaacggaaattttcggaggcttcgggtaccccgtttggccgtgaaggagtacctgaaactgaaggaggcctttgtggtggnaggaggaaggcgtaggagagaccatgactgaggaacagtcccagagcttcctgacagagttcatcaactacatcaagcagtccaaggttgtgctcttggaagacctggcttcccaggtgggcctacgcactcaggnacaccataaatcgcatccaggacctgctggctgaggggactataacaggtgtgatttgacgaccggggcaagttcatctacataaccgcagaggaacttggcggcgtggcaacttgcatacgacaagcgaggcgaggtgtccatcgcggagcttgcccaagcatgaagtcgctcatcgcctgggcgggagtccctaggcagcccagctaacccagccttcctcttggaccagagttgtgtggctagttgtataatttaatcgtcgagagctgggagtagtgttagcgggagacaataagatgtagactgtaaaaaaaaaaaggggggcaaaaccaagggcggaagacggt

SEQ ID NO: 553397 - DNA, 295 bp, Homo sapiens
ccccccccccccgggggttggttttcctaggatttgggttttttggggccccccctttttttttgccccaccccccccccccccttttaaaggggggggggtggggccacgccccccccctttttggggtttttttttttctttggggggggtccccccaggaaaaagaaaaaatttggggggggggggggggggggggggggcttcccccccccccccaagggggggggtttggggggggggggggaaaaccccccccctttttttttttttttttaaactggtggggggccca

SEQ ID NO: 553398 - DNA, 486 bp, Homo sapiens
  misc_feature (486)..(486): n is a, c, g, or t
gctctcggggtgtaacgtgctccggtgatctattggtcacttacgcggtctgcctattcgacagtcgtgtgtgtcgctgacttccttggcactgcgaattctgtcgacccacattagtaacagatgtccaccgagctgcgcgacacgcgccagtcatgcgttgacacgactactgccgagagttgcgagggttactgaagtgcacggttgatgcgcactctaataactgggggtacctaccatacgcaagaggagcgatagatacgaacgtattacgtgacacgatgcaggaaactgttcacggacagactgaaaccgacacgcatgattcaggcacgttgtggacgcacaggcacgggttcggtccattacaccttctaggaaatgacaaaacaggggccaaaggcaacacggggccttggtcgttggccaacccctttccaggcgcacacacgaaaagagctggggttccagtttttcgccccn

SEQ ID NO: 553399 - DNA, 119 bp, Homo sapiens
gtgtgggcattctcttttcgccgctgtgtacggtcctgacgcctctggacacggtgggggttttgggtcccgcgctcgccttcgtcctcctggtcctcgctgtttcctgtgtgcccttt

SEQ ID NO: 553400 - DNA, 114 bp, Homo sapiens
atagggccgtgatactgtgttttgagccacagaaggttgtgtgtgtgtgtgtgtgtgtgtgtgtgtgtgtgtgtttgtgtcaagaggagttgtgttctttgtaaataaaggtta

SEQ ID NO: 553401 - DNA, 289 bp, Homo sapiens
  misc_feature (97)..(98): n is a, c, g, or t
ggtccaccagattagctttggcctggaagcaatggctctaaaatcaaccattgatttaacttgcaatgatatttttaccaggctgtttcagctttcnntctattttgcggaattggaatttcttagctgtgacacatccaggttacatggcatttctcacatatgatgaagttaaagcacgactacagaaatatagcaccaaacccggaagctatattttccccggttaagttgcactcgattgggacagtgggccattggctatgtgactggggatgggaatgagcgt

SEQ ID NO: 553402 - DNA, 158 bp, Homo sapiens
caggagaatcgcttgggctcaggaggcggaggttgcagtgagctgagattgcacccttgcattccatcctgggcaatgggagtgaatccttgtctcaaaaaaaaaaaattttttttttttttggaaaagaggccagtgttgatgccctgaaagctaag

SEQ ID NO: 553403 - DNA, 252 bp, Homo sapiens
gacgtggcttgtggttaccgctggcttggtccggaaacaggagccgagccataatgttatacccagcagaactggattgcgccgttggggaaggctcctcaggataaccctttgaggaagaagaaactaaagagatgccctagctgcagtgtgaactcttgtgcatggacgacaatagcagttgggggctggtaatgccactgacttgtggaggttgggagaggagactgcaggcgcaggcgtgctggaggc

SEQ ID NO: 553404 - DNA, 821 bp, Homo sapiens
gagaccagcctggccaacatggtgaaacccctgtctctacaaaaatacaaaaattagccaggcgtggtggcagatgcctgtaatcccagctactcaggaggctgaggcaggagaatcgcttgaacctgggagacggaggttgcagtgagccgagatcaagccattgcactccagcctgggcgacaagagtgagactctgtctaaaaaaaaaaaaaaaaaaaaaaaaaaaaaatttttggggggccgggctcaaaaatttttaaaacccttttggggggggggggcccaagatggggtcaccgtgtaaaccggcgctataagcgggccccaaaggaaacccgggcgcccacgacaaggccggggttcccccccaattaaaaaccggcgggggggaacacacgacgcgtcggacccaacacccaaaggggagcttccggagggccacatacggggcgtcaaacacagggggcaccaagcagagctcgaatttcaaattacacccccgacgcagggatacaaagcgagtacacagcacgaaatagcgggacgacaaagagactaaacaagaggcgcataacatgcccgcagcaccccggggaacagcagcggaagcacaaagagacggcaacgaaccaaaccaggggcacgaacagaaaggaagagcagacaaagcgcagaggacagaacggcagaagaggggaacagcagtatgaaatcagaaccacacgggcaccagcgcggacatgcattacgaagagaagccaagacgaagagagcgaagaagaacgcaccaacgaccgacaccgcacgccaaccgagaa

SEQ ID NO: 553405 - DNA, 104 bp, Homo sapiens
gccttgcgttttctttctttctttctttctttctttctttctttctttctctctctctctctctctctgtctctctcccctccctcccttctgtcgtcttctcg

SEQ ID NO: 553406 - DNA, 995 bp, Homo sapiens
gggcgccaagggagtcgctgagccggaagtgttcggcaacgagcaggccagtccggccggtcaacggcatgcgtctcggccgcaaagggacaccgccaggaattggttacccatcggtcaatacgaggggcacgccagggagaagggccaagatcgaagctcttcagagcatggggaaaagcgcggaaaggaacctgagggtggactttcaccctcttgataggagaaaacaggtgggtccagtgcgacacattccgtggcggacagagcacgcttccttccccggatggactgcgagacactcgtggtatgagcgaaagggcaattgtcgacatgcacgcttgatgcgatgatgccccaatgcccgatttgcgtgggacattaccttgtctcggctatctctcgatcagggcctgccacatctggaagaggcccgcctcgaagtaccacgtatccccgctagcttgtgtgtcactgctcttattacactaggccactccatggctaattacacctgtcttgggtgcataggtggatcatgtaccccgtcatgcacagctgcagcccaccttcacacccatgacggatgcgcactggctaggcacattttcaattaaaggacatgctgcagaagaagatgccaaaaaggaccatgggctatccgacgccactacgtgaaccataggatgatcgctatcggatgaggacccgtgcagaagtctttcgaccacctagcggagggtcaagtgagggacatctggaggctgggctctctcgacacgtagctcagccagtcactccttcccctgtggattgatgaaatatacatccctttgaatgagtttgactctgagcctgtagactccttctgactaggcagagagcgcaaccctactcatttccgtgacgatgagggcggcaaaaacagacatttcttccattcatggaacctggatttggatctctacagccgcagctcatattcgcttctacct

SEQ ID NO: 553407 - DNA, 1009 bp, Homo sapiens
  misc_feature (21)..(21): n is a, c, g, or t
  misc_feature (61)..(61): n is a, c, g, or t
  misc_feature (81)..(81): n is a, c, g, or t
  misc_feature (96)..(96): n is a, c, g, or t
  misc_feature (122)..(122): n is a, c, g, or t
  misc_feature (133)..(133): n is a, c, g, or t
  misc_feature (147)..(149): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (181)..(181): n is a, c, g, or t
  misc_feature (193)..(193): n is a, c, g, or t
  misc_feature (213)..(214): n is a, c, g, or t
  misc_feature (223)..(223): n is a, c, g, or t
  misc_feature (229)..(229): n is a, c, g, or t
  misc_feature (239)..(239): n is a, c, g, or t
  misc_feature (246)..(246): n is a, c, g, or t
  misc_feature (266)..(266): n is a, c, g, or t
  misc_feature (273)..(273): n is a, c, g, or t
  misc_feature (898)..(898): n is a, c, g, or t
  misc_feature (916)..(916): n is a, c, g, or t
  misc_feature (979)..(979): n is a, c, g, or t
aagatcttttaaaaatatttngaattgttcccccttcacactcatttttaaattgtttggntgaggtcctcaatgtctatnatgtcaatgcaaganaaaatacagagagaagttgtgaaatnacacaatagcnattaattggggggnnncaaaatatcatggccttcncgggcngcngcancgcagctttgtnacggggttatgcgggtttcnnccggggggngggggngcgctgggcngcctgcncgttcccgggtgtgtggcgngcggggnggccccctcgggttccgtttccttcgtgcgtggcacatgctttttttctcctcatgggcaattgttggggtgtttcgttgcctgtcttgggcggcctggggagggtgggggagccttggtggggggggggtcgggccggatgggattgggtcagaggggcgggtggctgtcgtctgcttatctgcttggcggtgtgtggcatttgccaccgtggggggctaacgggggcctcccacactacctgccgggccccggggggccagcgatggtgtgataaccagtcaccgatgatgagttgcagttggaccaagtacagatggaggggctggcccatgcagggcctcggggtgaggttcactaggactagctgcagggggacctggctacactctgtggcacaacagggcttcacaaaatggacactacacgtgacgtgggctgaaaggtggagcagagactgggtgggagtgtcagttgcacgttgtggggtaagggggagagggagcagggcaagtgtattatgtactgtgctctaacattctttggaagtctttcaaagattgctgcagttcctttttaaaacaggtctcttattccgtcattcttgaaagacttctccttacancatctcatactgattggncgtgatgaaccgggacagacagcaggccagcgcatgccaattaactgggggaatgcgattccnacgccactcccgcgatgattccctgttagt

SEQ ID NO: 553408 - DNA, 227 bp, Homo sapiens
aggggggggggggggactttttttttggacccccccccgggggtgtttttttccccccccccccccgacccccaatagaggggggcccttttttttttggggggggggggtacccttttttttgagggggggggggcttttccaatttttttttttttaaagccccggggggttttggggttttttaacccccctttaataaaatttttttccccccccgggggaga

SEQ ID NO: 553409 - DNA, 262 bp, Homo sapiens
  misc_feature (23)..(23): n is a, c, g, or t
  misc_feature (48)..(48): n is a, c, g, or t
  misc_feature (76)..(76): n is a, c, g, or t
  misc_feature (90)..(90): n is a, c, g, or t
cacccagtagtccccagctactntgggaggctgtaggtaagaagactngcatgagccccaggagttccagcaacantagtgagacctcantctctactaaaaattttaaaaaatggcatgggcgtggcagtgctcacccgtaatcccagctactcaggaggctgaaatgggagaattgctcgagcctgggaggttgagactgcagtgagccgtgatcatgcgcttgactccggcctgggtggagagcgagaggccgtcttaa

SEQ ID NO: 553410 - DNA, 349 bp, Homo sapiens
gtggcgaatggcattgaggttgatggacgctctctcactcttgctccagacaggaaggtgatccagtgacagcgggggactgtgcggcgcagcgttgacggtctgcatggaatctcctcatgagaaaacttctgagtgcaagcatggcctgtggtgaccatgttgtgcttcagcaaggtgccttccaggtagatgtggtggtcactcagagccttgtagacagcagccagcaccttctcggtcacatactggcagggcttcaagtcatggtccccatcagggaggatctcaggctccacgatgggcacaatgccgttctgctggcagatactgcaattgggccagcggg

SEQ ID NO: 553411 - DNA, 109 bp, Homo sapiens
tacgctgtactgttggtcgctgtactgcatcctgctgcttagcccgactgtcttcttctactatcttctcctgtttggccaccctagtgagtctgacctctcacttttc

SEQ ID NO: 553412 - DNA, 231 bp, Homo sapiens
  misc_feature (39)..(39): n is a, c, g, or t
  misc_feature (86)..(86): n is a, c, g, or t
  misc_feature (95)..(95): n is a, c, g, or t
  misc_feature (217)..(217): n is a, c, g, or t
  misc_feature (223)..(223): n is a, c, g, or t
tgaagtagcgcagggtcggcttcggggcgcgcaaaggtngaggaagacctgcggcggcgggaggagagctgtggccaccgctgcgnccggagacnaccgcccccactcctggagtccagcccggcgctcacctccgccacctcctcagggttctgcgccgcctcgcgaaagacttgcttgctgtgggcgaggtattggtagagcggtggaaggtgtngatgtncgtgcggt

SEQ ID NO: 553413 - DNA, 1435 bp, Homo sapiens
  misc_feature (403)..(403): n is a, c, g, or t
gaggttgcagtgagcagagatcgcgccaccgcgactccagcctgggcgacagagtgagactcgatctcaaaaaaaaaaaaagtaccaaggcagactgcgagcaccagcaattgaactaagaaatccatcgtatgagcattttgagaaagccacagcttgcatgcaggatagcaacgaatagaatgcagggtgggcccgttggctggggtgacaaaggtgttgctgtgtaaccgtgagaaaccaatgaggaaacaacaattatttcaccagggcatagtttgtggcgttcagtggcttcgcgcatcaggagacaacgtggctcagacatggaacagagacagacgtgaactgacacggatacgaggggtcctgactgggcattgaaggcgtcttcaccatccgnagggctaggaagcacctgtgtgcacgaccattgacccgtgtggacagcctatgctcctcttgttaaggcagtcgtgacgtagaactcaggaggactgcggacgttgcgacgggggtggctagcgcagcaacatgggtgcctatgggcacaccattacttgggacgccaggttccagcaggttccctccaactaatcagcgaagcttttcatcgcatgccttggcagcactcaactagactgactaggacaatcccagttaagaccacggtagtccacgcagtgcactctacttttgcaggaagtctctccacgcgcggacgcactttgggcgtaagcgcacacgtggcgatgaacttctcggacgttatacaaacaccagatggctactaaggcgggaaggggttcccactacctttaacacaccgtgaactcctacttggacgcacagtacacccagatatgggtgatagtagatgattatggtgcatgatgccgtttgttgatgatgctgctgatgtggtctgtaccaagcgggtggaagaacatccgaacgagaaattagggggttcttcccgttggagcaatcttcattacacaccattcaccccagggagcacctcccgtcaggtcccccaattacatccccaagagcaacacatctcgcacatgctagactctcacgaagtgatcgaaattgcgctaagtctaacctgcccctagggtgggcttctccaccacgtttttataagcaagggctgttctccctgtctttcagccgcgaggccccatacaccggggagcgcccacacaaggggaggcaccccgaccacacgcccgcagcaagcgggagaaacacaaccacaggcgaaaacacccccacggaccaacgccgagaggcatgagagcagctcaccaagcgtacacgccgcaaccccacggcggccgttacacgccaccaaaggagcgacccccagtggtagagcgccgcaaccaacactcgacggagtccgcaggtgtacgaaaaacacaga

SEQ ID NO: 553414 - DNA, 229 bp, Homo sapiens
cattgatggctgcgactgcttagggtggtggttgctgaaggtggggtgacagtggtaatttcagtgatttttggtttggtttggtttctttaagagacaggatctcattctgtcactcaggttggagtgcagtggtacgatcatagttcactgcagccttgacttcccgggctcaagcaaaccttctgcctcagtctttccagtagctaggaatatcaagaatcggcac

SEQ ID NO: 553415 - DNA, 788 bp, Homo sapiens
  misc_feature (245)..(245): n is a, c, g, or t
  misc_feature (290)..(290): n is a, c, g, or t
  misc_feature (340)..(340): n is a, c, g, or t
  misc_feature (342)..(342): n is a, c, g, or t
  misc_feature (349)..(349): n is a, c, g, or t
gtgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacaccccttgccccattttgggtcgaccatgggtccagtctacgatccagtctacggcacgggtctgaaaggagcaagacgatgatctggngtcggtgctgaggagcggtcccgggggcggcttccgtccggcccntcctgggacccgcactcgcgctccgggcccgctcgacgtcggccaccgananacaccangtggagatggctcgggagcgctcctaagaacgtcacctcctttatacgaatcagtacggcgcatcgacgcggcagacggagaagtacctcagtcctggctaacgcccaccatgatggctctacgctggccgctctcaggacggcaaggcaccgttctgaggaagtgctcggtacctgcgagacgacacttccagtgaggattgctcacgcatcaagggcttccgcgtgccgttcctttccatcatatggctgggaacccaccatactgcacgtgcattgagctataatatcgagcttacaaacgctgacagactcctcgagataaggacagcgacgaggcacagtatgcggtggtgcacagtgcggataacaaggagtggacccctggaaagccaggaaccgggaatagcaagacacgaaagaaaaaaagggacgatgc

SEQ ID NO: 553416 - DNA, 410 bp, Homo sapiens
acttcattttttaaaatgctaattggaagtagacacttttttttttaggtttctttaatcttatctaaaactcttaagacaaactcttttcctgcattccacctctgctgtgacgctgtctagttgaaagggcatttgctgtaaattatatgaggacatccagctggtgtgttctatcgcatgtaaagtaccatttatattttggaaaaatgtaaagaatggattaatttagattgtgtaaagccataaatatgtattttcccacgttatacttatattgcaatgggttttatttttttgttgttgtttagctttttagtattttgatacatggtataaagtttagactggtatgccgaacaacggataaagtgatatataatttatatattaaagcttacactatatga

SEQ ID NO: 553417 - DNA, 497 bp, Homo sapiens
  misc_feature (82)..(82): n is a, c, g, or t
  misc_feature (171)..(171): n is a, c, g, or t
gcttttgtggagaaaaccaagggcccttgggggccccctgccctttttagaacccatggggagaaaaaaaggaggccgttgngggccttgaaaaatgggttaaggcgagccccctccggagggcagaggttggcccttcttaaagcaaagaccccgcaaaggtgccttggnttcccgatttttttttttaacccgaaaaaggttttaatttataattccctatttataaaggtggcccccaccataagaataatccctggctgggccttaggatttttccccccttgggaaaaaacccttaaaccaggttaaagggagggggcggaggtttttttttttcccttttttaaaaaagggtggttaaaaccttaaccaaggggaccccctgggagccaggtccggatccttgtggagaacccaaagggcctttttaccggaaccaaggtcaagggtgggaaggttttttttttttttaaataaaattcccaaaggttata

SEQ ID NO: 553418 - DNA, 495 bp, Homo sapiens
tggacttagtcctaaaagtaggagacatttgcctctaagctgttgtctcccaccccacctttctgtgagccgccggttccctgttgtccacatcaagctgtgtgctgggcactgggtgcaggaatagctcgaccacagtctctatcctgggggtaaaggggtgaccagcccacatagggatggactgctaacagacagtcccaaagtgccatgagagaagctctcagggcctgggcgtgatggttcatgcctggaatcccagcactttgggaggccgaggtgggtggatcacttgaggtcaagagttgctgaccagcctgtccaataaggtgaaactccatctctactaaaactgaataagtgcattaattaatgatccaaaaattagcctgacatgggggcatgcacctgtaacccagctactttggcagctgatgcaggaggatcaatttgaaccccaaagccgaggctgaaatgagccaaaattactaactg

SEQ ID NO: 553419 - DNA, 109 bp, Homo sapiens
tatggtgtgctcacacgataaatcctaggaagcaagttgatatcatagctcagaacatacctatgtacccaaatggttctttttttccggagtagtaagttacaatatg

SEQ ID NO: 553420 - DNA, 165 bp, Homo sapiens
tgagtaatatgatgaacgtttttgacgacttctagtagctcgctaaccgtcgccttacccccgcactattaacctactgggagaacgtctctgtgctagtaaccacgtactcctgcatcaacactatcactactccatactatagaggacatacaaccatagcta

SEQ ID NO: 553421 - DNA, 840 bp, Homo sapiens
ttttgaatgcagactattttattgtgttagaatagaatttaatagaattatctattaaaattatattttcaacatataagagctttgacaactgataactggatccttccaaataaatgcatttgttaacaaatgtaaagtttagaataaaattgctaatggccctacctgatactgtgaaattttaaactctctaacagcagttgttacaattcttggcctgagtacatctttgtccatggctaagacagttctcactttaaaaaagcagacttgacaggacttgaagttaaccattcaccactcagcattccatcctgaaagccagagctgctcctagtcatagctgatgccttacacattacccacagtggcctggtgggcagaggtttcagttttcccagtttacattaggactcctaatttcctggcatcacattttctttgaaggttttgatgagtcccattgtttgaaatttgctctcttagccagttggaagaagcaagaattgttacttatgcctgggctgaaaagaaacaacaggttgaggtggaggttgaactctggtaactacacctggcttatggacctgttttcgttggcaggaaaatgttttggttcagagctgttaaatgatagtattggcagaaactccgcgatagtgaattagacgttgcactaattagacttgatgatcattgtgtgtgcttcttcctggaggagctgattaccgttccccctggatgccatggcctctcctttccgggtaaaagaggggcggaaattccagctacccgtctgtttgtgggcgttctcaattttgtttttcccaaaaaatt

SEQ ID NO: 553422 - DNA, 441 bp, Homo sapiens
actgacccccaaccagggccaatccacataactggaattttaaaaaccttcaaagcctgggcttgggagccacttttcagttgggaacctgggtctggggcttggatcacaagggtactttcaaaagagggctttccagggctcagctcccaaccagctgttaggaccccacccttttgcctttattgtcgacgtgactcaccaaacgtcggggagagagagcagtcagaccgagctttctgctaacatggggaggtagcaggcactgtttggactctgagcactgtttggactctgggcactgtttggactctgagcactgtttggactctgggcactgtttggactctgagcactgtttggactctgggcactgtttggactctgagcactgtttggactctgggcactgtttggactctgagcactgtttggactctg

SEQ ID NO: 553423 - DNA, 302 bp, Homo sapiens
  misc_feature (99)..(99): n is a, c, g, or t
  misc_feature (101)..(101): n is a, c, g, or t
cggcacgaggcattctgatgttaagagttgggccccatcctctctaaagtccctctgggctcagcaaatccatgactgtggataagaccccagcagccntnacatttctcctccacactccccactcacccagcagcggtgcccacctttcctgattcacgagaagtgaagcctgcactatcttggactctccagcagcttcctgtctggagtcagcttcagggatctgtgtttgtgttgctgtgtttctttttatgtttattgaagtactactgacatatgataaacatcacagagtgtac

SEQ ID NO: 553424 - DNA, 331 bp, Homo sapiens
caatagtggaactgaaaagatctcaaaatctggacttgaaaagaattcctggatctatgaacttttctcctgttatggttcattctgggagcgctgctggtggtcattattatgcatgtataaagtcattcagtgatgagcagaggtacagcttcaatgatcaacatgtcagcaggataacacaagaggacattaagaaaacacatggtggatcttcaggaagcagaggatattattctagtgctttctgaagatccaccatgtgttttcttaatgtcctctgtggcaacagtctgaatgatgacacttgatgtgtgacactgcactgtaa

SEQ ID NO: 553425 - DNA, 300 bp, Homo sapiens
atctggtgcaggatatacataagctggtcggcgtgaagttcacccgcataactccaatagtatatcccgcgactgtttgcacacagtatgacaaggacattgaccaaaacaagcaggatcagatctatggccacatttcgtggccatcttaaagccttgactgtgaaaaccccctcgcgcagggcccggcggatagggaacagcacgactggcacagtgagggtcaccgcgagcagcacggccaggcgcacacagaggatgaacgggtccttctggctgtacatgtgcagcatctccgct

SEQ ID NO: 553426 - DNA, 245 bp, Homo sapiens
  misc_feature (1)..(2): n is a, c, g, or t
  misc_feature (230)..(231): n is a, c, g, or t
  misc_feature (235)..(235): n is a, c, g, or t
nntcggtacacccgctagcggcattaagtgaacggggtgttgcctcgctgccttgctgcctccagcatgacagcccatggtggggtgcaccagggcaaacttctctcttcctaccctcctagaattctcccagcccactgctggcctctcttaaggaggatctagatctgaggctcaagtttgcaggtggggacgttcacttaatgccgctagcgcggggatccttaganngacncagcagcaac

SEQ ID NO: 553427 - DNA, 719 bp, Homo sapiens
caatagtggaactgaaaagatctcaaaatctggacttgaaaagaattcctggatctatgaacttttctcctgttatggttcattctgggagcgctgctggtggtcattattatgcatgtataaagtcattcagtgatgagcagaggtacagcttcaatgatcaacatgtcagcaggataacacaagaggacattaagaaaacacatggtggatcttcaggaagcagaggatattattctagtgctttctgaagatccacaaatgcatatatgctgatctatagactgaaggatccagccagaaatgcaaaatttctagaagtggatgaatacccagaacatattaaaaacttggtgcagaaacgagagacgagttggaagaacaagaaaacgagacaacgagaaattgagcgcaatacatgcaagataaaattattctgtttgcatcctacaaaacaagtaatgatggaaaataaattggaggttcataaggataagacattaaaggaagcagtagaaatggctttataagatgatggattaagaagaggtaataaaccctggaatagatgtcagcactagataaaatatgatagcagttcatgataatctagaaaaggtaatatgaaaggacgaagaagatacaacaaatgggagctacatactaagtggcgtaacaatcaaacatatacgtcagaaaagctagaaggaaacagaaaa

SEQ ID NO: 553428 - DNA, 435 bp, Homo sapiens
  misc_feature (382)..(382): n is a, c, g, or t
ccctcgaagcctgaggaggcccaaagtctcaaaaggcatacattaggctactctttacaggactctgtgcttccctagaagactgcgtgaaacaatgtccagaaaaggtaaactctagtcttcatggctaatttcctccacctacctaatttgcacgatcgaaacaaagcttcttctaaaaccgctactcagaaggtcttatgtgggtcttgattcgaccatagccttttaaaataacagttgaaatgtcaaagaaatcccaagttcaccgcaggtgttcctggactgggctgttaagtcgtgacagtcaacatgagagggccaaggaaggcgggaacctagggctcaggcggaggggccaggtcagattcagaagagctgngcgctcttttttgtatgagcctgggtcttgctctcttgccgggctggagcaca

SEQ ID NO: 553429 - DNA, 683 bp, Homo sapiens
gccgggcgcggtggcgcgtgccagtaatcccagctactcgggaggctgaggcaggagaaacacttgaacccaggaggtggaggttgcagtgagcctagatcgcgccattgcacttcgatctgggtgacagatggagactacatatataaaaaaaaaaaagggaagaaccagaaaaggaattgttgcttttaaaggggtttaatatagcgctgtgtcattatgcttaagctataactggttaataaaatggggtgtctctatgccatattcagtaaacacaactttggtgagccactacgttcgaataagtaagtctatcagataccttcagttaaaaaaattttgtgccctgcaaaggtcaggagtttgagaccagcctgaccaacttggtgaaccccattctctactaaaattacaaaattagccaggcttgggggcaggctcctataatccccagctactcaggaggctgaggaaggagaatctgctcgaacccaggaggcggagttgctgtgagtgaagattgccccattgcactccagcctgggccaacagagtgaagattccatctcaagaaaaccaatacaaccaccaaaacacaaaaaaccagcacggcaggaaggggggtcccacttttaatcagcctttggggggcaagaacacgatgatttgcccggagctca

SEQ ID NO: 553430 - DNA, 543 bp, Homo sapiens
  misc_feature (210)..(210): n is a, c, g, or t
atcaagcctattatattgtggagcccaatccatgagccgttacagaggacctgtaagacatgataatgacctccgtactagacaagggaggcgtattcgaaggactgcaccatgcttcacttatattcgcatgccactgacttcactcacctgctgtacactatggccttctatacgggagtactctgtcaatgagctcttaagtgtttntcttctgaggaagtttacgagccttgtaccacttccggctagactctaccctctacctaggagggcacttggctctgactatgcattacactgatcaacctctatgagtaccactactagaacgcatacgttgtactctcattacgtagggcacattcctgagctcaccatagactaattgattacctctctaacccaataatttaagcactgcttcttggaaggggtactgggcccatattgtaccctactacagaggctgaacttctggtcttcccttaacaatttcgacggcgtgtacagcttgacattttctcgagtcacggcttgcgg

SEQ ID NO: 553431 - DNA, 118 bp, Homo sapiens
atcctcagtatgttcccaaatctgtgctgggcattggcaaggacaaaacatatactagtggggtttttctactaattattttttggaggcattattttccccacacacaagagctttt

SEQ ID NO: 553432 - DNA, 197 bp, Homo sapiens
ggacctaagctactccacaaacagaaactagggcataatcctggttcgtgacctgagagacatgggtggggtctcataaagaggacgtaagctatgaaataatgtgagagtctctgtacacctctgtagacaaacatacatcatttacattgtttagcacttaccgtttctttttcataagtggacacgttttttgc

SEQ ID NO: 553433 - DNA, 236 bp, Homo sapiens
aaagttcgaaccgctgaaactgtacactgaaacattttaacttgcattaatgctttacgtctccgcatatatattaaaaattcacacacaaatcaaaatggaaccactgccactacctcatttctgtcccctatttttccactcgcaatcatatactacgtaccttttgaccccatggaacaaaaatatctaacgttcagaactaccaataacaggaagaagagaaatttcttttt

SEQ ID NO: 553434 - DNA, 406 bp, Homo sapiens
gatatctctgaggatcccggcacgagcgcccaagtgatctacccgcctcagtctcaagtagttttattttttttgagacagggttttgctctctgtgcccagagctgcagtgcagtgtgctatctcatctcgctgtaacctctgcctcctgcgttcaagttattctcatccctcggcctcctcagtagcttggattacgggtgcatcaccaccacactctgtgtattttttgtatttttagttgggacggggtttcgccgtgttgaccaggctggtgttgaactcctgacctcaggttatccgtcctcctctgcctcccacagtgctgagaacaggcgagagccacagcaccttgccagacatagggtttcataagagcaccattgtgagacactggtcagggaag

SEQ ID NO: 553435 - DNA, 466 bp, Homo sapiens
tgcggattgttctgtccagatattatgtaccggccagtgagacactgagcacgtggtccttctgccataggcagcccagctgctggtccagaaccgtgtagcccatgggacatgtgctgagtacggagttcatgctgacgtcccaaatcttggcagttttgtgcccataatcagagagcacatgggtgctgtcgggactccaactaattgtgtaaatcccaccgtcgtgggccttgcttccgcccagcgcgcacaccttctccccagtcttcccgtcatagatgtttctggggccgtcagcactggctgtggcaaatctgttcccatcaggagagaatcgcacacagttgacaaagcggctgtggtcgccaactgtgaacttgaacttgaatgggggtccctcaaagaatgccgcgcagttatcatcgcttcccgtggccagccggtatggccggctctgcttgat

SEQ ID NO: 553436 - DNA, 768 bp, Homo sapiens
gcctctcaagctgggggtcgttcggtgcggttacacgcggctacaaatgcgtatcggaaaagtgttatttctgttcgtgggccatctatcctggacgcggatgatgtacgtccgcaaggtagtagatagggtgtgcagattttgaataatataattatgtctaatatgaaagtttatgaatatgaagcgcttaaggtcctcggaaagttaggtggaccaaggggattccggaaagcagtgtggtaaagagcgttacagtggataattcatttgaatttgaaaaatgttagaaatgatactatcaaataccagcgagagctatggaataaaactattgatgcgatgaatgatgagtcgaatgaaatcaaaagaagcgcgaagctaagattgtatacctgacatcagattgaacgaattacatgaagagagctagagaaagtgtcaggatatcagagaagtcaagcaaatactatcatcttatcggagtgctctcttagcggcaagggaaagagttggaagaagaaaatggtacaggagttacgtagaggatgtgtactagtggaagagtgtccttaaagaatctctgtaggcatttctcgatgtagcatgtgaggactggccttgtggtattggaaactgctaaagtcattgtactttgtacattaagggcattgaacatgaaaaggcgttaaaagaaatacttcctgggttgcatctaagtaatgtcggaactacgggtgtaaatgctccaaggggaattcacgtaaa

SEQ ID NO: 553437 - DNA, 141 bp, Homo sapiens
tgacctctctcacactgatacagatgtgagcattacgccctggcacagttacttttgcaccaacctaatatatacatattttttatttctacatttctatgctttctagattttcaatgtagaatgtataatctagtgtgg

SEQ ID NO: 553438 - DNA, 216 bp, Homo sapiens
gtcagtgatctaccggatcttatcgtgacgtcgcgtgcatttggctgactcctatcgctccaagcccagcgctcagccatggcatgcccctcggatcaggtcatgtggctcctcagtgacatacttccacaagtactccggcgaggagggtgacaagcacagccttgagcaagaaggagctgaaggagctgatccagacaggagctcaccgattgg

SEQ ID NO: 553439 - DNA, 143 bp, Homo sapiens
ctcacagactgctgctgtcgagagcagaagctgctgagcagtaccagcagtgtgctgtgatgcacgtgctgtaactgacgacgtgctgtctgcagtgcctgctgtgctggagcctgccctgccaagtacaagcagcttgagtc

SEQ ID NO: 553440 - DNA, 212 bp, Homo sapiens
gctcgaccagattgtttcatatcatttatacttgcggtaagagtaaactagataactgggcgttgtggtgcacacctgtagtcccagccactctgaggcaggaggactgcttgtgcccagaagttcgaggctgcagtgtagctgtgattgtgctactgcactccagcctgggcaacagataaaggaaactccatctctttaaaaaaaaaaaa

SEQ ID NO: 553441 - DNA, 1023 bp, Homo sapiens
cggccagcgcgccaaactttggttgttcccaggcctcgccgttgctgttcccctcttattcattgagagagaggcgttagtccgcgcgcgggtgcaagtgagtccacctgccccctttcagtgaatccaatgtgtgtccctgtactctggcgtttcccctgaggtcccccgttataggcgcccccctgttgtcctcaaaacaaagcttcccacccaccacaatacctttatcctttatttattctaaagacacttgttcaagagacgccttctcacaggaagattatgggaaaccccctttttttagaaatatatatccttggtaccccgccacttacatttcctcagtctcccttgcatttccgccctttcccatttcccctatccgcacttccttgtaacacttaccacgactcgagggttctcacccgagttccctcgccccttttgcccacttccacagtcccaatttgcgccccccccccacttgggttttcttgtaacctctttttcgaggtacccccccgagctttccggccgggagctatatcttttccaaacctctcctacaaatacagttctcccccccgcttaatattctcctatgagacaccaaggcggagcacatttcggacactctccttgtaccggttgagccacaatctcgcaagtaagtactctcccggattgtaaacccccacattctgttatataataaatatacacatctcaccagaacagtctttgccacatccatggagacgtgtctccccacacatattagagcctttaaaacaccagaatagccaattctcccggacagtcttataacccaacccactttctacccgctacaacagacccgggggtatactaccggtccaatgctcttgagaatcttgtggagccaaacaccccagtttctatgccccatctgtctctagaattaattctgccttaaaatttttgtaaatagggcccgtatttaccctatagcaccccctttaccccctttagagccca

SEQ ID NO: 553442 - DNA, 833 bp, Homo sapiens
  misc_feature (37)..(37): n is a, c, g, or t
  misc_feature (257)..(257): n is a, c, g, or t
  misc_feature (311)..(311): n is a, c, g, or t
  misc_feature (453)..(453): n is a, c, g, or t
  misc_feature (598)..(598): n is a, c, g, or t
  misc_feature (604)..(604): n is a, c, g, or t
  misc_feature (714)..(715): n is a, c, g, or t
  misc_feature (731)..(731): n is a, c, g, or t
  misc_feature (833)..(833): n is a, c, g, or t
aaggtgaagatagtgaagttagggagatagtaaatantttgagcgactgcgtctcaggcgatcttgggaagccagagcagcacacccggtcatgtcggtcacaagagtggtggtacacaaagaaacatatttggctgaggaaggggaagattaaccaacaaagccattttccaaacaacactacactttcttaaccccctcagatttttcgcctcgtttccccctcccttgccccaacacaaacaccaaccgtattnacgcttcagactgcgaacgctgagcagacccccttcatacctactctgccccgnatcaacatttaattattatatatgcggaatatagagtacatccatgccaccacaccccctcccctacaccatatttgtcacctctgtccgcgcctttccctcgcccgctccctccctccccctctctctccacacccccacncctctcctttttacaccacccgtcttaccaacacctcctctcttctagccctctcccgctacccctgttctcactctcccctttccctaccactctttcatcacctcccccacatcctcccccacccccccctcagtcccatagncacctntttacaacattcttctcccgctccctcttcccagcaccacccccctcccacctgcctctccccccacccgccctgtttatctttcaatcgtttgcctgttgaaattgtgnngagaacatagattganataaatccatcccactcctctccctcacttcgtaccttacttccctttttctcttctcccctgtccccacaccattctccaatttcatatgataagccccan

SEQ ID NO: 553443 - DNA, 934 bp, Homo sapiens
  misc_feature (342)..(342): n is a, c, g, or t
gctttttttcagataatctcttctattttcaatatcagaatctcaatagtatagacgcacagagaactttttcgtccttatctactgtgaggcctactctttaatgttcgcaccattacgtcgtttcacccccacccggcccctttacccctttgtggggttcgcaaataatttttgttcccgggattattttatatttcctgccctatattttccttttcgctgtaataacttgagctcacaaaaacgctttatcacgtgcctcaacactacaagggaacctctgtgaccaaatggcccccgcctaaaattgtgctgtgagaattttaatatgcacatagnccccgggaagcgtggattacgaacaattttcgcctcgggagacttcttcccacgaaacgttgccctcattcttgcggggaaattggcacccctagcggaacagaaatttactcgtttaacagctccccaggagaaactttgaccgagctgtttcgctgcctgatgccgcaaagagaatattgatcactgcggactggcaaccaactgtgaaacaagttcgttttttgccccacaaaatgttaataaagagaaagtttacccaccaagtgtggagtagtggatcacaccagcgtagaaccacacacactgtgggagggcaccacaggggcacgacacacacacatcacaagagttccgaggcccccccgagcaccaatatggagtaaaatttccccggtctgacattgaaaaagaacaccaaagtcagcccaccacgatgatgagtggcgcacccacggaaactccaccgtaacctatggagggggacaggccacgaggcaaatctactcaaaatttgggggcggccacaggctgcccgctggcgggaaatggcccaggcccaccaactggggacaaaaccaaaaacaccaca

SEQ ID NO: 553444 - DNA, 208 bp, Homo sapiens
cagggtcactttcagcacttgctgtcatcaaaccactcaccaagttacccacaccaggcctgatgtgacatcgtgacacctggcttaccggtaatacgcgcaaagttgtgccttaagccgattttgttcgtgacgtgtccaattgttttggccttttgaacgggatggatgttacaagtcgtatgagagatcatattggaaccggaat

SEQ ID NO: 553445 - DNA, 326 bp, Homo sapiens
tctctacacggtcccctcctggagtctcgtggctgcgcgccccaggtcacttgttaacttcttctctttctctacgctctctccttcagctagtgaggcctcctctgtttctgaatgactctatggtggcctgctgttgcggcgcttctcccattccttcttgtaccccacatgccgcggtctgagcctcctctaaactcggcccgtgagcttctgcccgctgctgtctgctcatcctccaggatggcttctgtccactccagctgcgtcttcagctaaacggggtcctgctcgtgtgggggcgcctctagtgaggaagctgcggc

SEQ ID NO: 553446 - DNA, 510 bp, Homo sapiens
gtcactgaggctggacatgctcatggggtgatctatatctccctgcaagccatccagcaatcccaggcacgaagtattcctcccacctcagcctccgtgaagctacgctgggactcagaagatgtgtagctgcctatgcctggcgtatttatccagctcttttatatacagacaaggtcttgctgatcgtggcccagggtaatcgtgagagctcctggcctctagccttcacccacctctgcgctcgctgaacgtgcttgggattccagggcatgagcccatcatggtatgcaccctgccattactcctctgtgctcactagccacgtcgcatgctccacctgtagctactcagccatgtgtcaggttgcgttctctgactcgattctgcacgtctgacctgacttggcatggtagcctgagtggtttctcccctgaagtcatctctcaggcgctgtgatggcgaccgagccgcgcatggtgataggttcctgtgacacctcatgggtgt

SEQ ID NO: 553447 - DNA, 826 bp, Homo sapiens
gagcgggcttagctcatcatggcaagcgatgtggcttacctgtgttgtggcgttggcggctcttggcatggggctatcctctgcggtttgggactcctcagaacgaatgaacagtcgggagctatgggatggactggctgtggagccgattgagccgcgagccctgtcatggttccatagtcgcagcacctgaacgatgaaggcccatgatatctctatgctccctacaggtagcttatgctgttggcctcgccctaaggctgctggagttgtaccgtgcatttgccttcttctgcaggaatagtcacttactgatcaagggacgagactcggttaataaagaacgtattcgcacgtagctgtgtactggtatgagtcggacttccacttcttcgcaggtgtatactgaattattgaccagagcagatttgtcagtagtcttcatgactgattgatgatctattcagaggcatcaggggaccatcaatcagtgacacgacacaagggtgatgtcacgtcagtcagtagtatactagataagtcctgcgcgaattggcggtgaagtacgagggcttcgcaacgttgggagctagctatcgtagttatacctaagggcacggaccccacatttcataactggaggatctgggacggtgctaaaacggctcgcggatctccgtgccttcgatatggagacacgtccagacgttcccaaggttcaaggcagaattgctccttgcctcaagctctccatgaagtatagtcgtggactaaccagggcgcccgaacaaccaataccccgagggacatcgccgaggatcagcca

SEQ ID NO: 553448 - DNA, 264 bp, Homo sapiens
tgagtgactatcatatgtgatgtggccatagaacagggatccatagagtccaggaacctgaaactggggggaacttgtgatcctgaagaataagaaaagaggactagcatggtgtgtctcgaaacgaggatggctcagatgtgggatcgtaatgattatcaaatgtccatttctatggtaatgattccagtggacccatcagacaaaagcacacaaagacctcctcttccacaggggagactgaggggggagagtgtctcttgg

SEQ ID NO: 553449 - DNA, 135 bp, Homo sapiens
  misc_feature (16)..(17): n is a, c, g, or t
  misc_feature (38)..(38): n is a, c, g, or t
caatagtgatgcaganncgactcaccctgacaaccganttctgcgcctgagatcgaagcattgtgcttgatcacgccaccaattgccgctgacgtcagcaagaagtctcgaatgccctttgcatcggcatcgtcg

SEQ ID NO: 553450 - DNA, 941 bp, Homo sapiens
gtgcgagtcccggcgcgcgttctgctccgcgcgggtgcgaaaccctggggtgggcaggagtcgtggccggtggccggggccaggaccggtgaactaactgtggctcccccacgctgccttcgcagtgggccctgtgctccctggtgctgctggccctcgtggctggactgtgagctggtgctgtgcctggcgtgctgtgagactgtgcgcgctggcagctttcgtgtgagccaagctggtgtgcatggtgtggagcctggactgctggtgcgccaggggtcggctgtgaatgagagattcaaggaaccgccccagatgaacaggccttgagcctgggagtttcgtgacgggagcttggtcagtcaggccttggaagaaggctggatgaattgacaaggagccttccgcgggtgtcaatttcttgacgcgtctgggaacctgcgcccggagttgtcattcatcagggcctggcccttgagacccgtgaactgtgagcgagtagtgtcggggacggggaagccccgtgatccaccttatcggccttgagggtaaccttgggaaaggggcccggttcccacggtcgaacggccttggttgtgctttgcctgcggtttgggtacccgagggatcgccagagcctttggggttgccttgggttccttccccggcgcaagttcagaagcggcgtagtgcccttgccccccgcggcgttgggagggggcttggccattggggttggggaccccgttgaaccgcctgtggttgaacggttaccccgtgggcgaaattcccgttggcgcggcgggaccagaacccccgcgagggggttagccttgggcaggttctcgagaacgttcaacggtggaggaaacccccagaggctttgggtggcaattccaatctggcgtcccccgttatgccttggggtttgaagactggag

SEQ ID NO: 553451 - DNA, 140 bp, Homo sapiens
aagtgtgggaggcaggacactgtatggtctttatgagaaaagatacttcccatatactttatgggtaatttaaggggtttatcaacggtaaatggtgactatctgtctaaattcatgtctaagcttagagcaataaaccc

SEQ ID NO: 553452 - DNA, 192 bp, Homo sapiens
gttgataaccagcttatcttatcagtagttttattgctgatcaggcaaaaatagttttccaaagttattttcaataaagtatatacaacgtctcatatatcgctagtcatgataaagtaattgaggcagtttttaaacctgagtgtgagtttgttcatcacaggtctgatatgtgtctaagggtgttcgcac

SEQ ID NO: 553453 - DNA, 923 bp, Homo sapiens
ggcaggagtcgtctgagaaggggcactcctccatgggacttggtgcccatcggtcgccagatggggagactgaagccgtggatgtgtgtctctctgagagtttggagcggggctggtgcccgaattcgaccgcagcaggattctctactacatttctagagccccggaggtggcagagctggcagaccctgggcaagtgaaccctagggcatgcaggagcaccagggcgccgacgccggcgcagacggggacggaagggcccgacccgcagcccagctgtgcacagagtgccatagccaaggacttaaggctcatccaaacggggactcatatacgcgccgccaccgggaaggcccggcggcgccaagccgtctacaccggatgcccgacggagattgcctggagtgccgccgagcaggtgtcatcgtgccgcgggggcgccctgggggatgccaggagccggacggaagcgggagggagagcaaggacgaatggcagcggtgcataaggggccggaccgtccgttggatgaacggccaccgttggcgccagtgcgacatagaaccgtaagtggccgagtgtactgggacaacaggcggccactcgaatcgtagggcaaggcttgtcgcgggcaacgccagcccggtacgggagcggagagtggacaagtaaacgcatatgcaccgcccctggcgacacagcacgggatagggcccaagcagcgcctggggcagatgaccctggcacggggggtggcgccactgagcggccgtggccgatgggcacaggacaggtgcaataggcaggcgcagccagggcagtgggcaccaccgaggagggcaccgtctggtgacggacatccgtggcaccgaaagacgcgaaggacggccgcccatcacccgcaagccacaaagggggagggc

SEQ ID NO: 553454 - DNA, 960 bp, Homo sapiens
ggcgctcggaaacaaacttctgttagtctgatcaccgtcagggtacgtgctaccaccgctgggtctgcctccgcatgtgtgatggcaggagagaggtccggtcctgggacagctggatggagacgttggtgcgtgacggtgaaataactttaccgataaggaatagcgtaatatgtggcgaattaatcttcttgccaagcggtttcatgtccaagtgctgcttgttaacaagtagccagatggttttcctaatctccgcaaggatcttgctcatattaggttacacagcagtggtgggtcaatccccaataagcctttatctgactcgccaggcgtaacagcgagggttcggggatggagtctcgatgttgtacttggctgtgagcatccgcagtagtagtattgctctccagactcaggagttggcctgattgatataacgtattggggatcccctatgtgctaccctcaagattcacgtaggtttcccaatgtttcctggaaacgaataggcgtcgagaatgagtcagcctcaaaggggatatgctttcgtaggatagaaaatagccctggtcctcacaactactttgccttgatgtctgggcaagacattcttttatcaacgttgaaaaggaccatggagttggttgcatgggcaccaagtatgtccgaattgcacattctcctggggtaaatgattgcggctgttgtggccttggactgtgcacgcgtggccagaacactgatcttgggaaggtgtcccgagtagcagtggtgcattgacacccatgttccggactgggggggcaaacagatttgggttccccgtttccaaaagtcgctaatgggaaccaaggcatctgaactgtcactaacacttcagatgtttgccgttggcgtgacaactgaatgtggggagggcttaaaaatactcggggcaagaaatgttcccaccacggg

SEQ ID NO: 553455 - DNA, 698 bp, Homo sapiens
tcgagtgttgtctgtgcaggagatggagtttgagtgtcagagaatgtagattagctgttaccttttgtagaatcttagttactaataaagcactactgtaatcttagcacgagtttaactccaccctcatttacacctctcctttgattcctttccgagccatgaaaatagtgcatagtttgcctggtagaatcgactcacgttcataaacgacgaatgttagatgagcaggccgtgtatgaacgccgctctgtatccatccacgcgtgcatagctgccaagcagggagctcacagaaggggacgggagcaccgaggccagctgacgctgcacccatgagtcccgcgagactgggatcccccatcgccatcagtgattttggaagagaaaaatgaaagttctgttcgttgatccagttgcgatctggggagccccatctcgatatttccattcctggctacttttctgagagaaaatcaagtcctttttttctgggccttgctaatgggcatacggaagagagggcttctttagcgtggtcccctgctggtgggggtgggtccccaggggccccctgcggctgggctcccctgtgcacggcaggttcctgctgatgaacctgctgtttgtattgttgtaggaaaccaggctgtatgctgaactagaacggatgctttgttcgaactgcatgttacaca

SEQ ID NO: 553456 - DNA, 382 bp, Homo sapiens
tctcagtagctctatagtatccccatttggattgcgacgacctcgccaggtacgcaaggctccacgaggaagtgacttcatcactccggatgcatcgttgtgtccggcttgtactccagtgcagtacaatactgtctactcctactccaagtcctgcagagatggatcggaaagagatgcgccacttgttaacaaagtggtgacactattgtccccctcagcgaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctc

SEQ ID NO: 553457 - DNA, 940 bp, Homo sapiens
cggcgttgagctttcccatcgctccggcgtcggtccttggggcgaccacgtgtggtggccttttgaaaaccgggcttctccgccgcccgaggggtgctgtggtctgtcacaagaccccttttctccgagggcacccctctcttggggtcccccctcgcgcgtccggggattttcgcgcatttattccgcaaggtgctgacctgggagctccccccccccctgtgggttgctcggggacctgccgcttatcccttatgcggacgccggggatacatcctcgacggtttctccccgaggctgggagcgtggatggcgcgtgggcataccttctcagggtcggccccccccttgtcactctccctggcgcgctcgccctaacctcgggaggtacaactttttcctcgctgtttagccacggccggccgcccaggtttgggttcctgggcgcccccgccctttggagtctatttccccctcggtctattctcctgcagccagcgcgtttaggcccaaaccgtctttcaaacgggggagctctttcttccaggttacgctgcgcaagagaagccctcgtaattgccgctcgccccagtaccccctgcgggctctctcttcggaataattactcccggttgtttcacataccactctcagagatcacagaaaacatcctcggtaacactacaccacagctggtcgaccccccaagctcttttcaacccagtgttatacactgggaggctccacccccaccccacaagagatacctttccctctcgtttttccactcatcccccccccctccccatatagaccaatcccctccctccccgacccaacgaaaggattctcctcataaccaagaatccaccgcaccttaccccgattgccacctagtcagccgaccaaaataaaccttttggggacccctacaaaaaca

SEQ ID NO: 553458 - DNA, 210 bp, Homo sapiens
gatatattagatatggaattcagtctatctgcaagagagagcgtattcagactatccctctatcctatttgaataccctttatttctctctcttaccttactgccctggccaggacttccagtactatgttgaataggagtggtgggagacagcattcttgtcttgtgtcagttttcaaagggaatgtttccagcttttggttatttcag

SEQ ID NO: 553459 - DNA, 170 bp, Homo sapiens
ttgatgtgcactcgcctctggtacaccgcctgcctccatgtggttcgtgtgtgtgacactcagtgtgactaaacgtcgtactgccacttctgcagcccgatgactccacgcagaacgcgcctaatgggtccctgagtctcgaatttcctaatcttggtcattcgctcttt

SEQ ID NO: 553460 - DNA, 172 bp, Homo sapiens
gacgctgcgcttatgggccgtggtgccggtgggcaacgtgtgcggcaccttgctggtggcgtacgtgatgctgcacttgccgatctttgacaccaagaccgacctggccttcctggaaatcgggcgcaaggtcatggaaaacgacgcctaccagatgttcgccaagggcatc

SEQ ID NO: 553461 - DNA, 195 bp, Homo sapiens
ggaaggaagtctcacggcttctttcttgctagtagaaatgatacacctacgagaggaggacaggaagtctcacggcttctttctttgctagtagaaatgatacacctacgagaggaggacaggaagtctcacggcttctttctttgctagtagaaatgaaatctacgctagatacgcgtcatccacgcgagatga

SEQ ID NO: 553462 - DNA, 540 bp, Homo sapiens
agtcacttattatccgtaatccgtgacgacgttgtcacttggggcattgacttcttgaatcatggccattgccagtggccacgtgtatccccgtcttagataaccccagtaaagaagttgaataaaatcgagccattaatatgtgacttgacagcgttagttacgagactgcttaaagactccttttcgtctaacacatagtaattacttcagtgtccaaaatgaatgtttaaagtaagtacacgtaatccttccaaggctttaaatactcatagcatgtttagtacctgagttagagctgtaaaagcaattcacagtacatttgcccaagagccatgtgttcaaaaatcaccagaggttattccgggggcaaaagaaaacaaacaaaaaaccacacatacacacacacaaaacacccagtacaattttttctttccttttctactttgatgcttaactgagacatgaaaatgttctgagaacagtctgaacccattctggcttcaaatatttacagtgagtctcacttcgtttatagct

SEQ ID NO: 553463 - DNA, 828 bp, Homo sapiens
  misc_feature (286)..(286): n is a, c, g, or t
gatgtcactctgtaccagaatgcaggacctaatatgccccaggtgccaagactataacttaacatcatcaactctgcctcaagcccggatggcagccgaacaagccactctcagccacgagcaatcgatacttctcgagaaggcgtctgcatataaggaccctggtgttcctacttgcgtggcaagataccctgcataaatgccaactgacaatcgttcatgcagattcattcactcatcttacagatcgtgttgtatcactcagctataataggaatctctccanggtcaagcaaggttcaacatattcaaggaaggtagaacgtctcctcagatttacactgacttttcacgaggttcgttcccaccgcaccggcccgtgcagtaggaatgaaattacgttacagacgatttaagttcctttcataagtatgaaagaattgatacaagggcgtatgtgtctcgtaaacctggtctgcagaaagtcgaacttacaaaaactgttgtgacagaatgttatgtacatatattgatatgtaactgcattagtggccatttggaatcacagtggtgatcgtgtgaatatatttaacactgtgtgaaattaatttacgttgctatctcattgggaatcataaagaacaaccatgtttcttcctgttcgtgtacactttaaggtacttatactatccttttaaacttcaagaaaacaaagttgtcacgcgtatttcacctgaagggcgccttaagcttgcccgagtggttccaagtttccccgttcacactcgaaccttttactaattgttgagctacacgagatctctacct

SEQ ID NO: 553464 - DNA, 278 bp, Homo sapiens
ggactgcgtaggacggggaaaacaagactgacatgttccagactgttgacctctttgaaggcagagacatggcagcagagcagaggaccctgatggctttgggcagcttgacagtgaccaagaatgacgggcactaccgaggagatcccaactgggatatgaagaaagcgcatgagcatacgagagaattcacagagagccagctgcaggaggtgaaagcatgtcattggccttcagatggtcagcaactgaggcacttccaggccggcatgacaggc

SEQ ID NO: 553465 - DNA, 722 bp, Homo sapiens
gatttgagtgtctttccccccctcaccctcaccatctgaggggctccctgagatcttggtagaggaggcccctcctgcccagaccttcgttgtttccccggtggccctgtgctgtcttgctgttggcagactgcctgcagccatgattttgtcatctgacatcatgtgagccaaagactgagccgttgatggcaggaataataagcaatactacacaacttgcgtactttcagaaaacttttttttagcttcaccgatgacaacagaggaagaagggaactgggattgggtaagttctcctccactgtttgaccaaattctcagtgataaactatgtgtgcagatccctagaaggagaaaacgctgactttcttgttaacgtgtggcacataaggatctgcagaatgtgccgtagaccagggaaagggatcttgtgtagttcttctcgtccatactccaagtgtcatatgaatctaattgtattgttgttatactggtgaccacgaatattatgcaagtggcaccatgtggtggtgttctatttccattcaacaggaacgttctaatttagcagagaagggcaagctaggagaaaggcccacgggaacccttgaaccacgaccaaataggacaccgagtcccgattacacccccggggcatcagcttgttcctggcaaatcaatacgggccccccggacccgggtcattcgagctgaccttc

SEQ ID NO: 553466 - DNA, 139 bp, Homo sapiens
tgaggatcccacggggatatgtgcacaggctctggagcaattaaagccactgctttcgttactcaaagtggctggcagagagggatatcttattgccatcttccacgaagagcacagcagagttctgcaagcaactcca

SEQ ID NO: 553467 - DNA, 164 bp, Homo sapiens
  misc_feature (147)..(147): n is a, c, g, or t
ctgacactgctctgggttatggatctctgctcagctccagtagctggatacaggcattgcaccacgccagtaatttgtatttagtagagactggttctcatgttggtcacgctgtcaggagcaggtgatctgctgctcggcctccanagtgctgcgatacaggt

SEQ ID NO: 553468 - DNA, 239 bp, Homo sapiens
  misc_feature (164)..(164): n is a, c, g, or t
tcccaagcatgaggaactgtatgtatttctgacatgaaaacttaaaaaaatccaccaggtcagaaaacctgtcatcaccattttattccactcacagtcttctaaagaaaaagtcataaaaaaaatctatcatcaaatgtagtcacttggtgaataaacatggncctagtgtgtttcattgaaattaagactccattgattatgtgttccaagtttctacatccttgggaaggggtacc

SEQ ID NO: 553469 - DNA, 245 bp, Homo sapiens
tttcatcaggtcccaatcctggcttccctctttagaactctcaagaaaaggaggattaaactaaataaacagacagaagcgctctggaacaaaagtacaaaagacagccagagggtgtgcggagagggtgaggtgcccgcgtggacgtgcgtagataatcgcatgcagcactggaactcctgatgaggggtggggtccctacttctactcaaggtatgagggattgcggggtgggtggagagcgg

SEQ ID NO: 553470 - DNA, 950 bp, Homo sapiens
gccctagcaggtcaggcgtggagtgtagcgctggtgccatcccgcatcccggatttcctgggatccgtggaggtgggggctgtgccctgagtggatgtggcacagtggaacctgggatggtgttgctgggtgtgacagcgagtgctgggaattgtgcgagatttcactccggggctctgggtcgagctaccccgtgcttcagtgcggtcctgctgcctcctctccccaagacccttcggggacacagcactgcagacccgccggagacaacttgtgcgggagcccggagtcctcggaataacacttggtcttctgatagccgtcagcgtctccgttgataaaatcatctcgcatttcgggggccgccggaacttggtgcagaaggcccagattgggtagatagccggctgagcccggatgtggggcaacctggtgcttgaccaccctctgacctggcctcacggcacctggtggcggactgggctgaagcctttccggaatggacctcatcaccggggcagcgcaggagacagtacccgtgtgagcgtggctgcaggcggtcggtgaagccaggctccagaacccgtgtcccttggaaccctgtatagccagtgtcagcacgtcttaggcacccgctgaggcagcaggccgtagcgcggtatccagtggcctattagtcctggtgcctccgtcaatagacagagcaggttggaagcgtgagggtatgcacaagggctcacaagcggaaggatttggaagggccttggtcatagccatccgtgtagccttggccagaaaaggggaattttcttcccgtgtgcgctgaaggatgggttatagacacttcccgttgtaccacagaatgttagaatgcaccagtgatgcaagagcataggtcggggcgttcagtatttcgagttggagcctgacatgttgaggcacagaaggag

SEQ ID NO: 553471 - DNA, 412 bp, Homo sapiens
tcataccccatattctgctctctctctcccacctgcctatccttcttaccaaagctgccctgtccagttcccaacaatggaatacccagctggtagattaagagattgccagaatggctgaggccaacgctcctcagccatctcctccttcaaaccctgcaaacccataagatctcagcacagaatccactttattaaaaccagaaagtttccgtcactaactcttaacactcgttgagacaggcaataacacaatcagcttggccacgtcatcctgtaggatggagtctgtcctcgcagactgggatttccaagttcttcctaacagccatatttttttttcctgtttgcaaaactcggagatcagtgaagccttttcaccaaatatgatagcttgtatcttaggaatctt

SEQ ID NO: 553472 - DNA, 196 bp, Homo sapiens
  misc_feature (6)..(6): n is a, c, g, or t
  misc_feature (170)..(170): n is a, c, g, or t
ccccgntgcacgtggagagacagtatatcaaaacacatgtgcacacagattatgtttgggctccaaaactggatcgcaaaagaaagaggagaagaatattttgtgtgttccgtggtattcttttataagtaaagtttacccagtgcatggaccatgcttcagctcagggnacaataatccccgtcccataaccact

SEQ ID NO: 553473 - DNA, 639 bp, Homo sapiens
ggtgtttttaacagaaggcgacaaaacaagaatttggtttcagaaaaggcagtcaattaatccacgttttcaattttgaaaattcttgccgtacgagtgggctgcttctgacccaaaagagtctttattcttagcagtggggcctcagagtggaataaatatcagcgccttcacaagcaagaagaaagtgtgtggttactgtatcacaatcagccagtcacggtgataagctctagatggcacatagactagtcagtggcaaggatttgtgtctgtgatccttcgggtgtcagcagtataggcattgcccaacggtgttcatgcagggcaccgttttctgtatggagatgacagcttgagtgttcagtaagacgccggaaaagcagcgagaaatctgccatgtatagattagtatacagatcttgctcgctacgtcagtaatcaggcggcatagctttaaaaagaaatcagccagatccttcttggtctatgcacagcttgggcgattatactcaagtacaactgcactagtctcttggaatgcgttgattttagtatattctggacagtgggtttcaggtagcatgtccatccataggaccacacggattcgcttggtgccagcatcgtggatgtcgc

SEQ ID NO: 553474 - DNA, 565 bp, Homo sapiens
agcgggggcgaggcttgtccccgcgttgagccgccgccgccgccgccgcctcctcagctgcagcctccgcgccagggcctgtccacgctggccacatctgtcggactatcaactaaccgtttcccgatacaagcagtctgtcacggcacgtgactcgctgcatccagtactcggggcgcagacgcgctaactgccctgcactgttgggtgacgcttacagcgagatgccctgtcgccggcaacgttacctcaccaatgagggcgaagcgacgttggctggccctgccgggaggcccatacctctactctctctggctacatgcgtgctccatgcaacagttggcatatcatgttcgctgttgcacacctgaaacttggcgggcattccctttcctaacagtctcggcacgcgccggtgtgcgccgtacaggaatcggggaacccgtcgatccttcgtctgggccgcccataacacgccggcacaacattgttggccagcgtcctggactaccgggctgcaacagtggacgtcggaactccccctcgtgcgactttcctctcgttc

SEQ ID NO: 553475 - DNA, 113 bp, Homo sapiens
gtcctacatagcaaaaaagacacgactgtgtgactaatggaagcccaaggcttatatcccagctcttgctgtgcctacactaataggatcagtgtctaccggccaaagaccac

SEQ ID NO: 553476 - DNA, 286 bp, Homo sapiens
  misc_feature (260)..(260): n is a, c, g, or t
ttttttttgagacagagtttggcactgtctggatcacagttcattgcagccttgacctcctgggctcaaacgatcttccttcctcagcctcttgagtagtggggattacagctgtgtaccaccacactcggctaattttttattcttattttgtagagatggggtcttgcttatgttgcccaggctggtctcaaactgctggcctcaagtaatcctcccaccttggtttccaaagcatttgggattacaggcgtaacttnccacaaacggtgagcattatatttct

SEQ ID NO: 553477 - DNA, 443 bp, Homo sapiens
ctgtctgccccaatggcccccttcctgggaaataattaccaatcccctacatttatagggttgttgccagtgattaacctgagttatccacatgtaaatccatatagaacataggtgcctgagataagctgataagattattagaaatccctgcttgttggccatggctcacaccctgtaatccctagcacttggtggggccaaggcaggcagattgccctgaactcaggagttcaagaccagtctgggcaacatggcgaacccgtttctactaaaaatacaagaaaaaaattagctaggcatgatggcacatgcctgtagttccagctactcggaggctgaggcatgataatcgcttgaaccttggtggtgggaggttgcagtgagccaagatttgctactgcactccaccctgggggacagagggagacattttctctcaa

SEQ ID NO: 553478 - DNA, 405 bp, Homo sapiens
  misc_feature (121)..(121): n is a, c, g, or t
  misc_feature (167)..(168): n is a, c, g, or t
  misc_feature (179)..(179): n is a, c, g, or t
  misc_feature (193)..(193): n is a, c, g, or t
  misc_feature (195)..(195): n is a, c, g, or t
  misc_feature (201)..(201): n is a, c, g, or t
  misc_feature (262)..(263): n is a, c, g, or t
  misc_feature (310)..(310): n is a, c, g, or t
  misc_feature (312)..(312): n is a, c, g, or t
  misc_feature (362)..(362): n is a, c, g, or t
gttctgtggacctgtgcacctaccccttggaaatgtctgcgggtatttctaattccacaggtcatcagatgcctgcttgataatatataaacaataaaaacaactttcacttcttcctatngtaatcgtgtgccatggatctgatctgtaccatgaccctacataannctggatgcacntcagctgaggcccnangtatgngggctgtggggtgggtgggagtgtgtctgctgagtaaggaacacgattttcaagcattctnnaaagctcgaattcaaggtgagcacagttaactggcataaagctcagnantgctgatcccaatgagtccggggatttcgtaatcaggtcccttggcgttnggggtgggtgtgctgacaacttagctcaggtgccttacagtct

SEQ ID NO: 553479 - DNA, 277 bp, Homo sapiens
cagcagatcacttgaggtcgtgagttcgagaccagcctgaccaacaaggtgaaacccatctctaccaaaaatacaaaaattagccaggcttggtggcaggtgcctgtaattccagctactcgggaggctgaggcaagacaactgcttgaacccgggaggcgaaggcctgaggttttccatcttcattctcttttgtaatcaggagacggtgaggcatgggccaatcccattcctgccttccagttgcccaaccggcatcttcgagggtaccggagct

SEQ ID NO: 553480 - DNA, 243 bp, Homo sapiens
ctgaccgttgactatctctacaaaccacaaagacattggaacactataccttttattcggcgcatgagatgaagtcctaggcacagtactaagcctccttattcgagccgagcttgggcaagcagagaacacttctaggtaacgaccagatctacaacgttatcgtcacagcccatgcatttgtaataatcttcttcatagtaatacccatcataatcggagggtaccggactcaattcgtaa

SEQ ID NO: 553481 - DNA, 167 bp, Homo sapiens
ctctgaggatctgaaagacagcagctgaatcaggtgggtatgctaatttcacaaaaagcaaagcgtatcaatgttctcgtgtcatcccaatagacaggaagttctctcactgaaaggaaacgaagccaggtggggtatacgttccattatcagctggttccatgtca

SEQ ID NO: 553482 - DNA, 503 bp, Homo sapiens
cccccttttttttgtgggtggggtttttgaattttacccaagggcttgttaaccaagttttttgccttttttgtttccccccccggaaattggtttccccctttttttaaggccttttttccctttttgggcccatgggggaaattccccttttgggagggggccttgctttttttccccaaattgcttggtgggggggatttttttttttgggggggtttttttttttaattgggggggttttggccctttccccaatttttttttgggtggggtttttttaggtttggggtgggggtttttttttccctgggtttttcccgggggggcaattttttttcccttttttggaataaactgccgggtttttttttgggtgggaagtggggaatgggaattttttttatttttggggtcctaaaggtttttaaggttccagggggtttgggcccaaaaccggtttttttttgggaatttttttttttaagggtttttatttttta

SEQ ID NO: 553483 - DNA, 115 bp, Homo sapiens
tcactgcccacatgactggctgcccgttaatgctgctggtgcacctgcagccctgtgctccagtgagagactctgtggccctgtagccctgcacctctactggctgaagctgcct

SEQ ID NO: 553484 - DNA, 279 bp, Homo sapiens
  misc_feature (42)..(42): n is a, c, g, or t
  misc_feature (44)..(44): n is a, c, g, or t
  misc_feature (46)..(47): n is a, c, g, or t
  misc_feature (51)..(51): n is a, c, g, or t
  misc_feature (55)..(55): n is a, c, g, or t
  misc_feature (68)..(68): n is a, c, g, or t
tacaggtgttagtgggatggggtgtttagcttggtagagatngncnnaagnaatntttttgttcccanagaaagttttggcttctataggttgacccatacgaaattgccactttaaaggtcaaaaccagtccattgttagcagtttcgtatgttcaccgattagttacagcctttaatttagactacataccctcgtgcaggatcatctgaggctcggcctcagttcggtcctccataaaaaaagggtaaccgcgtagatatatactcctgctccact

SEQ ID NO: 553485 - DNA, 330 bp, Homo sapiens
catacaaataggttacatggcagtggaaaattagatttcaagtgaaattaaggttgcaataaaatgatggagagattatcttaaatggtggagatcaatgaaatcacaagcttccttataagtgaaagaagaaggcagaagaaaggcaaccatggaggtggtggcatgagaaattactcaacatcactgacttttaagatacaagaatgaggacccagcgcggtggctcacgcctaatcccagccctttgggaggccggggtgggtggatcacgaggtcaggagttcgagaccatcctggctaacatggtgaaaccccatccctactaaa

SEQ ID NO: 553486 - DNA, 364 bp, Homo sapiens
agggagagtgtcactcatcatcctgctcaccgatggcgaccccactgtgggtgagactaaccccagaagcatccagaatatcgtgcgggaagctgtatgtggacggtacaggctcttctgtctgggctttggtttctacaggagctatgccttcctggagaagctgtgactggacaatgggggcctggcccggcgcatacatgagagactcaaactctggcctgtaggttcaggactttaccaggaagtggcaacccactgctgacagcaaggagctttgagtaaccaaggaatgccggggaggagggcactctcaacatttcggggttctctttcaggggcttccatgaggccggaccgccct

SEQ ID NO: 553487 - DNA, 902 bp, Homo sapiens
  misc_feature (103)..(103): n is a, c, g, or t
ttgcgtcagcgtgctgttacagcttgatgtgtgctacagcctttatgtccctcgccttgtggctgccccaatttggagacgggcctccacatttcgcatgtgngagaccccgccttctgtggtagccccttgtatagcatggttctagccctccttgtggggggtcacaatttctatagcgcccgcccctttggtttccccccatctccgaaaattgtggggcccacgaaaaaacccggtatcaccccttgtcctaatgggggcctcacacttggggccccacttggctggtcgttatcggcctcccccctgccgtttcatgttgcttggccccccctcctccccaagaactgttattgtcccccccctcatcttggccccccccttttttcttatccccaattagctcgcgcgtaggaaccactttattcgggcacgtcgagacatatctcgtaagcatctcccccctcgcaacaagtaaaacctatcttgtgtcaaacctctcccttgaagtaaaggactctcccagtctttaataagaactatgaatcaatgtgctgagcgcccagtgtttcgcttacaccacgtttgtagggcgggagaaaaatattctccctttttcttgattagaaagacccacctctttttatctctccgctcttttgtcaagagcggtggcccttggaccactcatgctcctgctaggacgcatctgggggggccgatggcgcgctcaactatcggtgagctccccccaagagggggttttgttataaagctaaaaagcgcgcctaggcacccccggcacattgcgcttaccaaagaacagtctgtccaaaataaagatgaagattcaactcccctaaaaaaaaaggtttgagcccacgagaccaacaaaaaca

SEQ ID NO: 553488 - DNA, 443 bp, Homo sapiens
cacaaatgtaaacaggcttatgaggctgaggtggaatgtggcatgctttgtgaggaaggcgtagctccacaaatgtcacccagagtgtctactaaatgtgtggacgaagctcactacaatatgcatctcacatggtcaagccagtaattcatcatgattctgtcaagactattgactgcacctactactatccggttcctgatatcttatgttttttcctcgctcggcttcaaacctcattactgcgctttcatttaccgttctttacgacagtctctctcacaacatgagtgctctttcaccacgtagtgtacgtttcgaccttataacgtatccatcctatatttagtaacctgtccgattttcccagcttcactatcatttcaatcattgcctttccatcactttctctaccctctcttcgtcctttactatcatactcg

SEQ ID NO: 553489 - DNA, 513 bp, Homo sapiens
  misc_feature (38)..(38): n is a, c, g, or t
  misc_feature (80)..(80): n is a, c, g, or t
  misc_feature (507)..(507): n is a, c, g, or t
cactggctccctcgttatcccatgtatacatcaaatgntaaggtcactccacccccacgacgccagaatgaaaaggtgtntatctcatggattctaacttttccttcattgaaagaaccaattccttataacctgggtgccaagacgccacctgcatctatagaagtagatgacaatatagaattgataagtggtcaaaatgagagaatgggcccactgaatatatcaactccagttgaaccagttgttgcttctaaatctgatgtttcacccataattcagccagtgcctagtataaagaatgttccacagattgatggtactaaaaaaccagcagtcaaattgcctgaagagcatacaataaaatttccaagcacccaccacacgcaacaatctcctcagagcgcaaaagttttcctgatcgttccacccagccagtagttttttctccaactcccatgttcacacatgaagaaaaggctagttatcctgcagaaactgctcttntaatgg

SEQ ID NO: 553490 - DNA, 300 bp, Homo sapiens
tttttttttccttgagacggagttacgctctgtcgtccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcttttaaagatcccagcctaatgcactttctggaggtcgacg

SEQ ID NO: 553491 - DNA, 1465 bp, Homo sapiens
aggcagatcgagattgttcccaaggagaagatcgtaatcctcctctgtggacggaacaccatgtgcacctactatccgatggtcgtcccttgatggagcggaaggcagcatttgacatcaagcttccggaaaccaaaggctgccagactcatggccacggccacactcaagaggaactctggcaccatgccatgtatgtggccgtgaaaacggctgatcctttgctatgagatccagagaacgcaagccaattccacagaaagttcaatgagaatagtgggctcccggcacagcgatgcagaagccatggacgagtgcacagggacaggactcatgtgatggagctaccacattctgggattcatgacacatgctgaagcaatacaaggagaggaacgggcagacctacataaacctggataagatcccaagtgacccccatcgacttgcgttacctctcacaacagatactatatagatgccccatataggaggactagtggagcatcgaaaagcgaagggaagtacctggaatatagataccaaaaaacaatgaaaaactggatacagtagaaaccacgaaaaatgcacagggaagaagaaacaagcagcgacaaggaagaatcaatgagtgagccataaagaaacaccatggaaaacaataaaagatacgacgcagaaccccccaatcaccacaaaagttacacagaaaaggatacacatgacgaaagataattgagaaagatagaaaagagatcataaaggcaatattttgcgcacagtccaagtggaaacatatgaataatgacaaaaaacaacaccaagcaaccacagacaaaacagacattaaaggtacaccacattaaaccactcagtagaacaaggggggcagcaccaaattcaaacacacagcacgattcaaaacagagagcggcagtacaccatcagagaaagagcaaagcagacaccaaaaacaacaataagaaacgccaacaagctaaaccaaggagaaaacacagaggctaaaacacaaaacagatatgacaaggaaaacacaccaacgccgagaacagagcacagcaaaaaaggacaacgaaacgaaaaagaaaagcacgcaaacccaaggaagcgacacacaaaaggagagaaacaagagaaataacgaaaaggagatcaaccaaaaagaagcaacagcacaacgaaacaatggaacagcagaacgaggcaagagcagacaaggaacatcagaggagaccacagacaaaatgacagcaccaccaaaatggaactgttcaaaaccacgaacgcaaaactataaccacgcaggtgcgccaacatggagcccgaaagaaaagagaacaacgagggaaccatagagacacacagcacaccaagagctgatagtcaacacacacaacaagagaagaatgagcaacagaacacgaaccacacaaacatgaagtgg

SEQ ID NO: 553492 - DNA, 221 bp, Homo sapiens
agaaaaaaaaaaaaaaaactgatgaggccgggtgcaatggctcacacctgtaatcccaacactttgggaggctgagatgggtggattgcttgagttccagatcagcctaagcaacatagtgaaaccccatctctacaaaaaaaaaaattaatttaaaaataaaaatgggtggtttgaaatatgaactgccccctcccctgaaggccatgaaaaaaaaaaaa

SEQ ID NO: 553493 - DNA, 1507 bp, Homo sapiens
  misc_feature (1507)..(1507): n is a, c, g, or t
gtcttcaaggctctcatcgctgctcgagtacagacggggactcatgtgtccgcgtgctctccgcatccatcccacttccattgttggccaaaggcaaccgcagcgccatgaataatctccggcgagagagtttcctgccggcaaggatctcaggcatttgagggtgatgatggagtgctgtggtggtgggagatgcaacgccagttgcgctagctatgtgagcacatagaaggagctgcgcgggaagtactccgaggaggcagcaggccaggtgggtgcagtgggtgagctttgctgattccgatagtagtgcccccgagccagtacctagggtggttccccgagccttgtggcatcatgtcacacgaaacaaacaggccactgatgaattgcgagagggaggaagtgaggctgaatgctaggcggctgctggaatgcttactgtgaagaccgagggactttaccgtgggttggggcgaaacagaagtggaccattgggattgaccatcgagcaagttccgtctgccaccccttgtacgatggcgtcctcatagaggcagggtttcctaaggaaggccttcctatttccagtcaaggccctttttcccaaataaccaaaccgggtggggctcccatacaaagcgttgcaattaaaaccaaggggcccccaggattcccgaaggcagtgtacattggaggcggaatgttgtgacaacccaggtgttgggaggcaccgatatggccgcaaggtggcgaattgccttaaccacaggttgtggcaaggagggcccaagttctataaaaaggtgtaccgacaccaccgtggcggggaacacacgacaggcgagggtgagttcagaggggagggcgacacgtgagtgaaaaggccagaagaaaagcccccaatgatgtgcttgaaggcgggggaaacgacgccactatacaactacaaacgacgcaggctatgacccccggggcaaccatataacgaaggcgcacaaaggggggacaaaatggataaaacacatggaccacgtgctgatgcaattgaaggagccaagaacgccacaagggggcccaataatgcgttctcacgcgtgtgcaccgaaaagataatttcccgacattagagggggaggataatgacatttacagcgcagaaatttataccaatgggggaggagaggaagtaatatattgtatggggcgagagacatatgagtgggagagcagatatataagatgagggagttggttgtggtaacgaagaaattagtctcgatggaacgaactactaaagatgtagtaagagaacaaaggagaattaacgagggacgagaggaggaaaacgacggcacaaatagttggaagagacgacagagacgtatgaggttatatagagagacaaagactactagaggtaggaacaaaaaatgtacgaaagacagcaaacaaaaggcaggagagggattatatcggtatgtagtcgttttgggaaggatgaatn

SEQ ID NO: 553494 - DNA, 508 bp, Homo sapiens
  misc_feature (214)..(214): n is a, c, g, or t
  misc_feature (391)..(391): n is a, c, g, or t
tctgctctgcactctcaggtattccctgctcttactccaaaaagatggacccaggtccgaaggggcactgccactgtggggggcatggccatcctccaggtcactgcgggccaccccctggccatggcccaggccctgcgggccacccccccaccatggtccagggccctgcgggcacccctggccatggcccaggtccctgcgggcagccccnccaccatggtccaggccctgcgggcctccccctggcctatggcccaggtcacccatccccctggtcccacatcactgaggaagtagaagaaaacaggacacaagatggcaagcctgagagaatttgcccagcttgacctggaatgaggcctaaaccacaaatcttctcttcctaatnaaacaggcctcctagaggccacattctagcaaaccaaaacgagacccacttcgacaatcaaagaacacaaaaacacacaaccacacactcatgtatacgccaactccacacacaacc

SEQ ID NO: 553495 - DNA, 178 bp, Homo sapiens
ggcggaatccgagatgtgtaaccctatgagagcccgtgagcatgactcagacgccggcggagcggactgtacgttacacactcgagcaccccgggcaggagccgcagcgtgccaggctccgtgctcatgtctgcttctccgggatccatgagcatggatggcgacagcgcaggagtac

SEQ ID NO: 553496 - DNA, 319 bp, Homo sapiens
cgggatcgagggcatggggctgagcaacaaggtgttctacgccaaccccaacctcgcgtcgcgcaagttcatcaagcccgaagtggccaatgacccggcggtgttcccgcccgaggccgagatgaagaagatggcgcagcccgaggcgctgaacaacgacatccgccgccagatgacgcgcatctacacgtccttcaagaccggcctgtaaagaacacgatgaacagcaggacaggggagggctacctggtcatcgaccgggtggtgaaggacttcgtgagcccggacggcggcagcttccgggcggtggacaacgtgt

SEQ ID NO: 553497 - DNA, 810 bp, Homo sapiens
  misc_feature (152)..(152): n is a, c, g, or t
  misc_feature (187)..(187): n is a, c, g, or t
  misc_feature (281)..(281): n is a, c, g, or t
  misc_feature (330)..(330): n is a, c, g, or t
tccgtctccgcccataggcggaaaataacattaacctacggaggaaatgttcctcgtcgaagagcagagatttcgggtggagaaaccacatctccggtttgcgacacacttcctccagcacttgtcatctcggcacgcaaccgactctactntttggccgacacgctttcttgacagtgtgccgccnccacaaagtttgctgctctgacttggtgagatgagaggtgttcactcactctcgcccctctcaaaaagagaggagagagagccttgtgaggganagaatctctcacggagcgagacacaacactcatagcaggctctggccgnagaggtgcacactcccttctattagagggataaacaacactcacctcggcgacccacgtcagtttattatccggagatgataatactacatatgcgccgcactatagatcgctcgcgttggacacatacaatagttgctcacagatatatctttaagtatatactagagagatacatactcacgtttcgctcacttacacagagaatatcttggttggggcgcattttttcccacacgattattggaacggtgtcctctccgcgagtggcaagtgtttgtgtactctccaccactcgggccaggtcctcaccgcgagagagacagtctcagagacactcactgtcttgtgaagtcactcccgcagtggggacagcgctcgctttttctcacaccccttgttctctcctacgggaccgctcctcttccccgaacaagctgaaacacacggcacatcaggtggaggacaaacaaaggaacaa

SEQ ID NO: 553498 - DNA, 311 bp, Homo sapiens
taagacatgctgctgcgtatttcaatgatgcttcatgagggcaaggcctgggctctgctagggcaggatggtgctcttagagctacctgagctggacaaacccatggcagacagaacagaaagtctggcacctgctgactccggccctcccgtggtcacttcatcacacagcaaattcttaaaacgtttgggttttttcaaacgaagcatttaacgtccagtgttcagttttccgtgcttcagcggaacgatgcgtagcacaagttgaagcgccgaatcccttcctattttagcacttccaagtatcctgg

SEQ ID NO: 553499 - DNA, 548 bp, Homo sapiens
  misc_feature (517)..(517): n is a, c, g, or t
ttttttgagacagagcctgactctgtcacccaggctggagtgcagtggcgcgatctcggttcactgcaagctctgcctcctgagttcacgctattctcttgcctgagcctgccgagtagctgggactataggtgcctgccaccacgcctggctaatttttgtatttgtagtagaaaaggggtttcaccttgttagtggttcctaaaataatatgtgatgatgataaagcacatatgacaaaatgttcacaaacactgaatcttggtgagaagattgacatctttgtactattcttgcaatgtttctggaaatctgaaactatttccaatgaaagattcaaacctttctcttgtttttgattagaaaataatatcctgagaatggtctaatatctaaaaccaatcatactcttcagacttgcttatggtatctaaatgcaagtggtatttgcctaggaccctgggttgaccctttaccctactctaataccttgcaatcgttgccgtgtctaaagctngtactctcataaaaccatcgtgagtctcaaa

SEQ ID NO: 553500 - DNA, 248 bp, Homo sapiens
tcccccaaacgcagagaggactgactttctttcttgcctatcaaacctgaagaacactggggcggttgcaggccctttctcaccctcatccagagtgtcactcttttaccagagctgcgctgccatgtcctcaatctgacctactcagccatctgcattcccgcacctgcacaaggttaacaagcatgggaataaaatggcttcatctcccagagtcattgtggcatggtaactcctctctgcgtttg

SEQ ID NO: 553501 - DNA, 332 bp, Homo sapiens
  misc_feature (104)..(104): n is a, c, g, or t
gagacagtctcactgtcgcccaggctggagtgcagtggtgtgatctcggctcaccgcaacctcggcctcccaaagtgtggatacagtcgtgcgcactgcgtccngcctccttttcttttttctctcctccgtctttttctatcctacctccctgcctctttcctctctcctccctccttttcctttttcttctctcctccctccctcctgtttttctccatcattccctctcccttcctttctttttctcccgttccccgtttgcctccctcccctttttctttcctgtctccctgtctcctttgctcttttcctccctttctcccgtccct

SEQ ID NO: 553502 - DNA, 1794 bp, Homo sapiens
  misc_feature (15)..(15): n is a, c, g, or t
  misc_feature (26)..(26): n is a, c, g, or t
  misc_feature (49)..(49): n is a, c, g, or t
  misc_feature (102)..(102): n is a, c, g, or t
  misc_feature (162)..(162): n is a, c, g, or t
  misc_feature (176)..(177): n is a, c, g, or t
  misc_feature (310)..(310): n is a, c, g, or t
  misc_feature (339)..(339): n is a, c, g, or t
  misc_feature (619)..(619): n is a, c, g, or t
  misc_feature (636)..(636): n is a, c, g, or t
  misc_feature (649)..(649): n is a, c, g, or t
  misc_feature (652)..(654): n is a, c, g, or t
  misc_feature (665)..(665): n is a, c, g, or t
  misc_feature (683)..(684): n is a, c, g, or t
  misc_feature (705)..(705): n is a, c, g, or t
  misc_feature (788)..(789): n is a, c, g, or t
  misc_feature (805)..(805): n is a, c, g, or t
  misc_feature (808)..(808): n is a, c, g, or t
  misc_feature (814)..(814): n is a, c, g, or t
  misc_feature (839)..(840): n is a, c, g, or t
  misc_feature (857)..(857): n is a, c, g, or t
  misc_feature (877)..(877): n is a, c, g, or t
  misc_feature (915)..(915): n is a, c, g, or t
  misc_feature (921)..(921): n is a, c, g, or t
  misc_feature (924)..(924): n is a, c, g, or t
  misc_feature (954)..(954): n is a, c, g, or t
  misc_feature (956)..(956): n is a, c, g, or t
  misc_feature (960)..(960): n is a, c, g, or t
  misc_feature (969)..(969): n is a, c, g, or t
  misc_feature (972)..(972): n is a, c, g, or t
  misc_feature (982)..(982): n is a, c, g, or t
  misc_feature (995)..(995): n is a, c, g, or t
  misc_feature (997)..(997): n is a, c, g, or t
  misc_feature (1054)..(1054): n is a, c, g, or t
  misc_feature (1165)..(1165): n is a, c, g, or t
  misc_feature (1312)..(1312): n is a, c, g, or t
  misc_feature (1478)..(1478): n is a, c, g, or t
  misc_feature (1530)..(1530): n is a, c, g, or t
  misc_feature (1613)..(1613): n is a, c, g, or t
  misc_feature (1715)..(1715): n is a, c, g, or t
  misc_feature (1746)..(1746): n is a, c, g, or t
  misc_feature (1776)..(1776): n is a, c, g, or t
  misc_feature (1792)..(1792): n is a, c, g, or t
actctgtgagctggnctcggtatccncacatttaaaatgaggagttggnttatatgattgggtggtatatgtggctcatctcgaagactgtctattatagangggcaaatggtagtgcctcattgcaggtgtggagtctgtgtcttgaggacatcgggagantctagatgatcagnncacgcccgggagcttgtccttctccgagcggctcagtgaactggagcagctgcggcgcacagtccatgaaggtcagcccacaccacccagcccccacgcccaaccctcgtgcctccctgaaccactccactgnctttaaccctcagcctcagagtcagatgnaggggtaagtaccagatggagaccactgcccgcctctcctgcacctgggccaccacccacaactggcccccatgtgcacacaccttcccagaccaactggggtttccccttgatgctcagagaaaggcctcgaaccaacagcaccacctgggagctgttggaaatgcagagtcttgggccccacccaccccagacccaccgagtcagatctgtattgtaaccagatccccacaaggaaaagcactgctacagaggatacgaggagctctgggtatggagnttccttttaaggatagntcgctctcttganttnnntaagagttagntttggctatgctattttnntacctacccattaggcttgangacacacacgcagacacacacacacacacacgtcaaggaaagtgaagatgggatgtttccaagttctccctattgcaagaaanntgggggttttgaatcnatngtgttntagaataaagaaaaagtggaatgtnnggatgtcatcacaccanggttgtatttccaaaccaanagagaatgcggtcccccccaccccatggccctacctgncaattnacnaaagccctgtaagatccaataattgcctangncccnctgtcccanatnagataacacnagaagttcatttncnctgtagaccagtgacgtcaatgactgtttgctctgtgataccgtttcacaaatccanaatgcagacttttctctgtgccatgcaggatgcagctgtgtgtgatatggtttacagtaatatttctttctcaaagtagcaggcttgttaaggagaagataagcaacagancctggggaaaagggcaggtgtccaccaatcgatgtggtagctctttgcccctcctcggacagcaggaattagcttccccaggcattttctgtatgtgagttgtattgtgggatgtacaaatatcatctgttcctttgggtttccagnccagtagctctctattttggggtcacacatgggttctcagaccgggcgcggtggctcacacgtgtaatcccagcactttgggaggccaaggcgggcggatcacgaggtcaggagatggagaccatcctggctaacatggtcaaaccccaactctactaaaaatacnacaaattaggcaggcatggtggcgggtgcctgtagtcccagctactcaggangcggaggcaggagaatggtgtgaacccgggaggttggaggtttcagtaaaccgagattgcaccactgcactccagcctgggcnacagagcgagactccatctccaaaaacaaacaaacaaacaaaccaaaacatgggttctccaaaggcatgcccactgtctcccatggagcttgacagcccatnccattagctctcactgttaggtttctggggnaggttcttctacttgattggaaaatttccnaataaatctttccagnag

SEQ ID NO: 553503 - DNA, 145 bp, Homo sapiens
cggggacttgtctctcacctgaaaagctgcttacgggcccccactcgtcgtgggtttaaagcggattaatgggagggttggtggttctggggctggcagggcttcccagcagggcagccccttcatgtggtggcgagcttggtag

SEQ ID NO: 553504 - DNA, 203 bp, Homo sapiens
gggggccccccccccccggggaaaaaattttttggggggggggggggttttccattttttttaaaacccccccggggggggggcggggggggggtggtggggggtccccccccccattttgggggtgggcccggcccccccttttttgttttttttttttggggggggttgggaccccccccctttttttttttttgggggga

SEQ ID NO: 553505 - DNA, 190 bp, Homo sapiens
acacgcgatgggtagcaaagcagatgacagctgtacagacattcacttaaacatatattttagtgagcacacactggttctctgggaactgttatgagggctgggcgcattggtatggaaacaacatgaacagtacacaaacttgaaaagagccctgatagcagttaccacgtacacccatctgatggag

SEQ ID NO: 553506 - DNA, 172 bp, Homo sapiens
ggggtgactagcaggaccccctttgagtgaataatttatacttatttggttaatgtctggtgctttctatcacctcttctaatctttttatgtatttgtttgcaatgttggggtaagactttttttatgagtactttttctttgaagtttagcggtcaacttgtctggagta

SEQ ID NO: 553507 - DNA, 117 bp, Homo sapiens
ggtcgacccgcatccacacaggccagcaaggccctgtgccagtgccgcatctgcatgcgcaacttcagccgcagcgagctcacctgcaccacccagcattccggcactccacgacag

SEQ ID NO: 553508 - DNA, 456 bp, Homo sapiens
  misc_feature (9)..(9): n is a, c, g, or t
  misc_feature (199)..(199): n is a, c, g, or t
  misc_feature (223)..(223): n is a, c, g, or t
  misc_feature (228)..(228): n is a, c, g, or t
  misc_feature (230)..(230): n is a, c, g, or t
  misc_feature (240)..(240): n is a, c, g, or t
  misc_feature (450)..(450): n is a, c, g, or t
cacttcaancgacatcgcaaaaaggtggctcggaaattctggtggaagaacgtgaagatgattgtccttatctgcgtgattgtttttatcatcatcctcttcattgggctctttgccactggtgccttcttttaagtaacagggaacctctcccacctgcccttcttttcagggacaaccctccataaatgtggccaanagggtctcctttcctgtcttcctntacananaatgctgctnggtcctcctacccctcttcccgaggccctgttgccacgttgtatgccccaaaaggtcccttggtcccccggaaggaaaaaaaaaaaaaaaatggactgtggctgcattttttgggtccttaaagtgggctggaaagacctaaagggcccagcatgtggctgggaaactgttggtggccagtgggtaataaagacctttcagtatccctanaaaaaa

SEQ ID NO: 553509 - DNA, 82 bp, Homo sapiens
gtttttttttaaaaaaaaggcaaattttgcctctcccacttctataatttgaaaaaataaataaaccttttcttttttgtga

SEQ ID NO: 553510 - DNA, 327 bp, Homo sapiens
tgatatctgcagaatcggcttcatcgcacgcaaacggtgaagttagtcagaaagagtaagataaataccatatgatatcacttttatatggaatctaagagatggcataaatgaacttttccacagaaaagaaaatcttgtactgtggaaaagacttatggttgttaagggagaggggatggagtaggatgaattgggaatttggggttaatagatgcagactattcctttggaatggattagcaatgagatcctgctgtgtagcactgggaaacaagtctagtcacatgcaatggagcatgataatgggagtttgcgtgcgaaagc

SEQ ID NO: 553511 - DNA, 553 bp, Homo sapiens
taaggatgcataggcaatgtcaagaaaaggcaagcggcaggcggtgtggctcacgcctgttatcccagcactctgggaagctgcagcgggcagatcacttgaggtcaggagctcaagaccagcctgcccaacatggtgaaaccacgtctctaataaaaatgcaaaaattagctgggcatggtggtgtgcgcctgcattcccagctaatggggaggctgaggcagaagaatcgcttgaacccgggaagcggaggccgcagtgagccaagatcacactactgcaccccagcctggatgacaatagcaaaactctgcctcaaaaaaaaaaaaaagaaggggcaagggggagaggggggggacatttcctttttctggtcaactttagcggggggagccccacaattacggtatggggggtgctcggtgtatggggggtgcccctgtgtatggggggcgctcgtactccagtggtgtactggcggcagtgttcaaccggccgggagatccaatagggggtgcagcgggccgggctcagcaccccggggggcgggcaa

SEQ ID NO: 553512 - DNA, 1261 bp, Homo sapiens
gagtattagctggagggactttgatgctggcctactaattgtcgccctctgtactggctgaggaggtaactcgatgtttccactgaaatggtgaggtattcaagaattcgtaggactgaatctatggctgctgggcagtaaggaagagctccataatcgaaggtgatatccttctagatagacatgtggctttctggtagacatcagagaaggtagttatagtccagtgttacacgaaggatgctcctgcagaattcgtctatgttgctccacattcccactcatactacattcaaggtatactactactactaatatatacccaagtggattttccatgcattcaaagcactctatagtatgttgctggaaactatatactatttcataaactttaccatgattgtaaatagaatacaaggcattagtaataactgcttaagcttggggattagaaaaatagtcgcgctacagatagtatggtcgtagagggatcttgggagaatcacaatataaaatagggtgttaaccttaagctacggaatcttacattggaagtgtcaatgcagtagaagagtccggttccataaatgttatgttatggacaacagaaaacactgacggatattgacattgagggaatttcactacttacgtcttgacaatttaataggaaagtaaggacatttccaaacgtggcagagctgataaggatgcgtgtaaaatagtccacttggtaggggtacaaataacatcttacgggtaacatatatccggcgaggatttcgaactggtgatcgttctaaatgcggcacaagtgattaatataggagctttttaattgatggactgcatggtttggtggggggcagccagagtggttgcaggaacgtagaagttgatcgttagattaaaggtggagattgactggccccaggaaaagggggtgcaagatgggttagaaagttccaaaagattaaacaacaaaataccaaccacaattttacaaaaaggggttgggagtggagggcaaacaactggtaaaaggtatgcttatagaatcttgacagcaaatacagatggaaattggggacaggaagaaatattcatggagacgaaattactggacggacaaagcatggaatttttgaaaatttataacaggtgaatagaaaaatttatcgaataataactatgtaagtgtttggaaaaaggatataattccagattacaaaaatgtaaaaggaaatggaaattagaa

SEQ ID NO: 553513 - DNA, 249 bp, Homo sapiens
tttaaaatagccgacggtggcatggaatccgcttcattcaatggagatacattgcaccactctgattagactccactgcattcaaacacgctgcatggaatccactgcattcaatcgggatccattgggccacactgcatggaatccactgcattcactcgggatccatttcacaacgctgcattgactccactgcattgaatcttgatgcatggaattcactgctgaattggtatcaattacataatt

SEQ ID NO: 553514 - DNA, 935 bp, Homo sapiens
ccttctcctccttctcctccttctcctcctccccctcctcctcctcttctgcttttctgttaacacacatttgcatcctctgctgtcccctgacatgtgagcgtgtgagcgagtgtcgtctgtgttcttgctttccttgggaacctaggtgattttttgcttttttaaaaaaggtgtttgttttgtttgtttgttttctatataaggacatttgcctgcacgtatataagtgcaacacgtgtgtgcctgctgtctgaagaggccagaagagagtgtccgatcccttagaatgcgagttgcaactgcttgtgagctgtgtggttgctggtggccacgcctgtctggaagagcagctggtgctctagaccactgagccatctctccagccccataggtcatcatgtctaagactagaaattaacaggctggagagatggctcagtggttaagagcactgactactcttccagaggtcctgagttcaattcccagtaaccacgtggtggctcacaaccatctgtaatgggatctgattgtcctcttctggtgtgtgtgaagaaagcaatggtgtagtcatataaataaaataaataaatcctaaaaaaagaaaaaaattactacatataattatagaagtcagggaatgttgtctcaacgggatgtgtaacctgcgttcacagcgcaccaagtgtcccttcatcttgatggtaaccttagtcagggtcagacaagttagttaagcggcgagggtgaatgctcacggggaacaccttatagggaacacctggcattagcaaacgggcggggcaacgcctgcgggtacatcaccctgggtctagtcggccgaacgaggccggagagcaaaggtggcagggtgcccaaaagttccaggaccaggaaacccaaaatacaaccgctggcaccaagcgtttcct

SEQ ID NO: 553515 - DNA, 317 bp, Homo sapiens
agccctggctgatcgcttcggccagacgactgaggtcctgcccctcagtcggcgtgatgaactgggcggcttcctcgcacagcacaaagcgcgggcgatcgcgcgcggagagatagagttcctgggtgactgcgttgaccacgaccatgacgatgacgttgaacaggtcaggcatcgccttgagacgctcgagctcgagcacgacgaattcgtcgttgcggatgtcgagggtcgaggggccgttgaaataatggccataggcgccgcccgacccgaaatcgcgcaggttgaaggcgagctcacgcgcggtcggcacg

SEQ ID NO: 553516 - DNA, 339 bp, Homo sapiens
acattagccaggcatagtgcacatgtgcctgcagatcccagctaccctggaggcagaggtggaatgatcatctgagctcaggtaggcggaggctgcagtgagctgagattgtaccaccgctctccagcctgagcaacatagtgagaccttctcttcaaatgatacataaacaaacaaaaagaaaccctcatcctctgttgatcctgttcccaattgacccttgaacctagcgcaggatgtgtgctaaaggccaacatgaaggacatcatgaccctaaatatatcctctacaagctgctacctaatgttgaaattcccccttaaacctttggtgcctttc

SEQ ID NO: 553517 - DNA, 837 bp, Homo sapiens
  misc_feature (13)..(13): n is a, c, g, or t
  misc_feature (33)..(33): n is a, c, g, or t
  misc_feature (36)..(36): n is a, c, g, or t
  misc_feature (40)..(40): n is a, c, g, or t
  misc_feature (48)..(48): n is a, c, g, or t
  misc_feature (58)..(58): n is a, c, g, or t
  misc_feature (62)..(62): n is a, c, g, or t
  misc_feature (115)..(115): n is a, c, g, or t
  misc_feature (119)..(119): n is a, c, g, or t
  misc_feature (128)..(128): n is a, c, g, or t
  misc_feature (140)..(140): n is a, c, g, or t
  misc_feature (151)..(151): n is a, c, g, or t
  misc_feature (162)..(162): n is a, c, g, or t
  misc_feature (169)..(169): n is a, c, g, or t
  misc_feature (175)..(175): n is a, c, g, or t
  misc_feature (185)..(185): n is a, c, g, or t
  misc_feature (189)..(189): n is a, c, g, or t
  misc_feature (200)..(200): n is a, c, g, or t
  misc_feature (206)..(206): n is a, c, g, or t
  misc_feature (235)..(235): n is a, c, g, or t
  misc_feature (242)..(242): n is a, c, g, or t
  misc_feature (245)..(245): n is a, c, g, or t
  misc_feature (327)..(327): n is a, c, g, or t
  misc_feature (353)..(353): n is a, c, g, or t
  misc_feature (393)..(393): n is a, c, g, or t
  misc_feature (494)..(494): n is a, c, g, or t
  misc_feature (497)..(497): n is a, c, g, or t
  misc_feature (525)..(525): n is a, c, g, or t
  misc_feature (545)..(545): n is a, c, g, or t
  misc_feature (568)..(568): n is a, c, g, or t
  misc_feature (582)..(582): n is a, c, g, or t
  misc_feature (633)..(633): n is a, c, g, or t
  misc_feature (636)..(636): n is a, c, g, or t
  misc_feature (679)..(679): n is a, c, g, or t
  misc_feature (688)..(688): n is a, c, g, or t
  misc_feature (692)..(692): n is a, c, g, or t
  misc_feature (728)..(728): n is a, c, g, or t
  misc_feature (741)..(741): n is a, c, g, or t
  misc_feature (744)..(744): n is a, c, g, or t
  misc_feature (753)..(753): n is a, c, g, or t
  misc_feature (796)..(796): n is a, c, g, or t
tatgtaatcaatnattttattattttcatcaanaancaanaaagcaanaaaaattganagcnagttctcaagggaaccttttttgaagtgaagagcaagggcctgaatgagctanctanatggaaaanagtatttgcaanatgcaaatggngaactaaaggntcatgangggaanagaagggggntgtntacagaggaanagaaangaagggaagttatgggaagttcaatcaanaattggnaanaagctaggtcagtagtttacgaaagtggtcatctatacagtgcctgagtttgggttctgggcctggatcatgtaagaaaggnagcaaagtctgggtgccatgaattanacctgcaatcccagcactttggaaatctgtggtgagaggntctcttaaagctatggccttgaaaccagcctgggtaacaaaaccaagcccttgtatctaaaaaacaaaagggcaggtagattccagaaaaataatgttgcnggnagggggtgataaaatacagaaatgtganaaacagcaaaccctcaactnctgtttcattggctcccagtgtnttaatctgtgtttnctaacactttaaggtacatctgaaataccccccaaacccagaaagcttttnaanagctaggttgttcaagaacttggaaaattcaccttctgatgtnctccaaganagantccattttttatacaccttatttgctcagacctgtnacttcagcctggngtnaacacaganacctagttttcctcaaactcctcttgggctttagagagaaggngctggccctttgagccaagcaggttattggttagtagtcct

SEQ ID NO: 553518 - DNA, 328 bp, Homo sapiens
gcactgaatgtacccgactggttataggtgcgggtgttcacggctggaatcggccacactgcagacgaagcgatacccggagcgggtaacaccacccagatgtgcgagcaccgcgggccacccaggtctcggtgatggaagtgggcctgggcaacagccccatgggccgcttcaacggcgcagagttgaatgggcaatgcacagcggtgtgccaggtcggcaacatcagtgaggcgtgcaaacggcgtgcgcaccttgatgggctaacatctatgtgtacgacctgaacgtccaggcccaggactggtacgaattcaccgatacctac

SEQ ID NO: 553519 - DNA, 437 bp, Homo sapiens
  misc_feature (69)..(69): n is a, c, g, or t
  misc_feature (121)..(121): n is a, c, g, or t
gtgtgtgtgggaggggggtgccttaacctgtgtggtagtaaacttccaggttaatacataggccttttnccctcaagggtgaccactgttgttgccccaggctggagtgcaatggcgcgancttggctcaccgcaacctctgcctccctggattcaagcgattctgctgcctcagcctcccaagtagctgggattacaggtgcccactaccacacctggctaatttttttgtatttttaatagaaacagggtttcaccatgttggtcaggctggtctcgaactcctgaactcatgtgatctgcccccccctcacccgccccttggcctcccaaagtgctaggattacaggcgtgggccatgacctgctttttattatcaatctataataatatgtattgttcctatatcattaaatattctcctttaaatatatcta

SEQ ID NO: 553520 - DNA, 1729 bp, Homo sapiens
ccccgtccctgccctccccgctcctgagggccagtgccagtgacagtgcccaaagaagtgcaggtcgtgatgagcgtgcgaaccatgtcacgaagtggactattcctgtgacagacccaggcgaccgatggacgtcagcggacagatgaagtattgctctgtccccgagttcatggttcctgcaagccctctaggaggtccgaacagcctgcaagcatccgatcccactatgaccacaagaaagagacgcctataccagacgctttcatctacagaccctcgcgagaacacaaccaacactgcagccctgaacacagaggacatcccaaggaacagaacaagacaagaccccaatagatgcacacatacttgacaccagacggacagagctagcgaccttcgcagtaagcttgcagtagccgcgccaaaaacagacaccccaggcacgcgacaatctagagcccaaaactctgaacgctccgcccgaccatagaccgccacagaccacgccccgcgcagcgcaccagataggaccccgatatagccacagcatagcacccacagtcgaggtacgaccaggagagcatcccaccccaaagaccgtggacaattgccaaaactcgaccccaaacaccggacgcgtagccagatttcggacacccgccagcgcaaaacacggcccagagaaaaagaacacaccaacatcgcccaacgacacgcgcccagcacgcacatcctcccacagcagcatcaccaatcgccccaacgcccacccacaaacaacccgcccacaaagaagcgcccccacaccaccaccaacacacacacacgagacacaaacaacaaccacacctgacattacatcacagaaacaggacacaaaaaaaaacaagcaccgaaacgcgcgacaacacaaaccgacacccactgcgcaatgtcgaactgaaacacccgcacagtccccatgccagagagcacagcgaccacgggaccaccaacaaccccgcacgacacccactacgaacaagagaacccccagaaccaacacacgctggacccatgaccaacagtcaccacaaagactcccaaacccaacagccgacgacgtgacccaatacactaacacacacaaaatcaacacgcagacacccccaacacacagacgtccactaaccagactaaacactcactcaactccacgattaacagcaagccctgttcatcacaagcaatcagacaccactcaacgcaaaaataatccatgcatacacatcatatcgcattatgcaccaccatgcagcaccatcagcgctaaatacacgaacaccataccacgcagaaacgatcaatcaacacacagaaggagaacctacgatacaactagcagaaccacacagcacgataacatcaatcccggctcgagcagagttccgagatacaccgagcaacagacacacatggacaacaccaactcaggccaccagttcgaccactgctctcgcgcaaatccactcacacagaagcgatgaacgacacgactcacagatgaccgaaaggaaaagacactgcagacacacgagccacaccatctccatcgcagagaacacgaccgcgacgaagcacacgcatatcagaccaccgaagcttcacacgtgcaacgcacacgatcaggagatagagcaagaacggacaagacatcaagatgcaacacgccagagccacgacgaac

SEQ ID NO: 553521 - DNA, 815 bp, Homo sapiens
ggacatttgtgaaagcaaagcaagaatgaatgctttcccgatctcagactggctggattcagatcagtgtgttggctggttctcattttaaggggtaagcagttgctattctgtgactttagtagatctctttgtgtgcacatatacaatgtgcattatacatatatattaaatatatccacaaagcagatgggcaaaaagattttcatgctaatcttcaaaggttcatgctcaatattgtgaaaagcttttaaaaggtgtcttgaaaagacaatcattctccgtcccgtttaactttcttgtggcaagctataccggaaaagcggcatgtcaaaaatactttaggttctacatagatctctttctctctttgtccagtagtccgtccgttaaacgtccatctatcttattttaccttttactgacaatgtgaaactcgcaagaacaaatgttctctttttaacatatacagtcataaactgttcaggtaaccataacaaaactaggtgtcatttattaacgtattattcacataatgtctgatccagtatgtgcttgtcgttactttacacaatcgtgactgtgagacatgtctgcttgtgacctggtcttaccttttctccatcacattcgtacactatcgtgtgaactaccagcatttaactgataaccaatccaaaggaatattccggtggctgccacgctcctgcacggtcgacctcttaacttggctacggtcggcaaccacatgctcaccggcttaaacaccctaccttttggccccatagaaaaaccatcacttggatcccaacact

SEQ ID NO: 553522 - DNA, 442 bp, Homo sapiens
aggctgattcctggcagatgactagttacccctaataatacggtgccccgcatataggcgtaaccccgcataaaacaacataagcttctagactcttaccatcctactctcctacctcctgctacgaatctacatatagtaggaagccggagcacggaacaggtatgaacagtactaccctacccttaagacagggaaactactccactaacctgagagcctcccgtaagacctaaaccatctatctccttaacacctaagcaggtgttctcctctaatctaaaggggccatcacatttcatacaaaacaatatatcactatacaaaccccctgacataacccaataacaaaagaccctcttcgtatgatccgtcctaatcacagcagtcctactatctcctatctctaccagacagctgaccggaatttcagccgaattct

SEQ ID NO: 553523 - DNA, 655 bp, Homo sapiens
  misc_feature (479)..(479): n is a, c, g, or t
cgacttcagctcggacccacaccacctgagtccacaagggataaagggcaggataaatcctcgcaacccctgatgaaggaaataatgtatataatggtccatttccaagacaaagggcgtggaaattggcttaggtcagcaaactacagaagaaataggatatactagccctttgcttgaatagccagtgcctgcttgtcagcccccagcttctcttgccctcacctgaaccaaagaagtttagtctaaaatgaaggttttctagcctgcaaaatggctcactttttctgttcttatcagcctgcccagctacttaggtcataagtcaaatacttaaaaagcccttgagctgactaggattgcaatgcattgtaggctgcaataaaatgcagcaagacaacctaaaaaaaaacacctaaagccccaacccaacaaccaatagacaacgtccaggaagatcgtgaccccatagtactcancctgtgaggaaaggagggagggacctgtgcactagaggataaattgcttgttgtggctgtgctgggcatgcctgcccatcagacacccatcttgcaagactgtcattaaaatctcactttcgctgttctccaggtctctgagtccattctttgggtttggacggatgagtttgttt

SEQ ID NO: 553524 - DNA, 148 bp, Homo sapiens
  misc_feature (52)..(52): n is a, c, g, or t
  misc_feature (56)..(56): n is a, c, g, or t
accctaaaccaggagcctgcggcacttgctgggcctccctagctaggctacngatnccagtaccagaggagccccaaaactttgacagcctcgtgggctttgtgacggccccaggggctctgcgtggtaacaatgactgaaaaaaaaa

SEQ ID NO: 553525 - DNA, 389 bp, Homo sapiens
tggggccccccccccaaaaaaaaaggggggtttttttatttaaaaaaaaagttttttttttccccggggaaaaaaaatttttttaaaaaaagggggggggggtttttttttttggggaaaaaaaaaaatcttaaaaaaaaagggggccctttttccgcgggggagcccccccaaaaaaaaaaaaaaagggcaaagggcccctccaaaaccccaaaaaaatgggtaaaaaaaaacccgcttttttttttttaaaaggggaaaaaggggggtttttccggggggtttcccccaaaaaaaaaaaggggtcaacaaaatgtttttagtctgacaacccattcctgtcgatctcagcgggatcatagttaacgacgcacgcgtgagctcagttg

SEQ ID NO: 553526 - DNA, 150 bp, Homo sapiens
acaagacaaaataaaactcaacatctccagaagacctttcttacctttgaaaaaaaacaaaaatgaaattatgtggcatgctgctgcagcctttaagtattgtagtaactgggaattgccaatacaccgcggcaagggctacgctttttg

SEQ ID NO: 553527 - DNA, 105 bp, Homo sapiens
tcaagttctgaggatcagcactgcagtgaatcataactcttcacctgcgctgtggacactgagaacatccgccgtgtgttcaactgactgcctgtgacatcattc

SEQ ID NO: 553528 - DNA, 100 bp, Homo sapiens
caagtccactctataggatccccattttttcaactggttctgatcacatgtttggtgggggtggggatgagcaatcagagattcactttagctcttgaca

SEQ ID NO: 553529 - DNA, 714 bp, Homo sapiens
actgaacattttttttaacttgatttaataaaaatgttaattttggaaaaaaaaaaaaaaaaaaaaaaaaaaaaaaaaaaaaaaaaaaaaacaaaaaaaaaaaaaaaaaaaaaaaaaaaaaaaaaaaaaaaaaaaacaaaaacaaaaaaaaaaaaaacaaaaaaacaaaacaaaccaaaaacatatcaaaaacctaaccaaaaaaacaaaaataatctttgaccccgactgtccaccacattttccatctgcatatcccaaattaccgacacccactgccggctccaataattagaacgatccccacaactccgatgctcaaagtccattgcccaacatacctaaggacaaagccaaccaacaaatcatgacacaccgctccaactatactcccaccaccaacgtacctccagacgtaactgtcctcacgaacacccctgaaaaactgatacagcccaacgtcctcccctgattcatcgacaagatcaccccaccagttgtcattgttacacaccttcgaaatggtaaacccgccccacacgatttacacacacagtcttcctgcccaaagactacctctttaaccaaaagttccactatctaaagttcctgaccttaactcacgaccaaaaacactcccctcttgaacaaacgccgcttccaatacaccaatgctacacccccaatatcgatgcatcccctctccccaccacc

SEQ ID NO: 553530 - DNA, 502 bp, Homo sapiens
  misc_feature (465)..(465): n is a, c, g, or t
ttgagacagtctccctctgtcgcccaggctggagtgcagtggcgcgatctcggctcactgcaacctccgcctcctgggttcaagagaccctcctgcctcagcctcccgagcagctgggaccacaggtgcccaccaccacgcccggctaatttttatattttcagcagagacggggtttcgccatgttggccaggctggtctcgaactcctgatggcaagtgatctcccgcctcggctcccaaagtgctgggattacaggcgtgacaccgcccctggccgagcatattaaaatctagttttcaaaactgaactgcaggcgccgctgtaccaaacgcttccctctgctgcacaaccccagcctacagacaactggtcacttctcctacccgcagtcatcccaggacttgccagcggaaacatccttgactgatcgcactgacaccacactgacatcgagcgacgtcncgagaggagcccacgacgtcgagcggcgcaattagta

SEQ ID NO: 553531 - DNA, 271 bp, Homo sapiens
tggtaaccatgaatctattctccatcactatagttttgccttttccagaatgctgtaagtggagtcatacaatatttagcctttcagtctggcttctttctcttagcagaatgcatatgagatctctgttgggtttaccagcgcgctgctcatccctttttattgctgagaagtattccatcatgtggatgtactactgtttgtttatccattttccagtggggttgtttctgattatgaataaaggtgctataaacatttgtgcacaggt

SEQ ID NO: 553532 - DNA, 872 bp, Homo sapiens
gtgataaggccagcagtcatcccgggatgagcagtgggcctgtgccgtgctggctgtgcacctcaatcacgctgctgggagagcggcctgtgcagcaccgcgtaggtgcaggccaatgagtctgacctctttcatgagctacttcccacgggggcctcaagtaccaggaaggtggtgtggagtcagcatttcacaagatctccacaggagccccatgttgccattcaaggaaagctcgtatccatggtgagaggggaaaaagaacactcctgtgccacctgagcgggcacttgaactgaggacagcttcaacactggcggactgcttcatcctggagctgggccagaacatctttcgcctggtgtggttggacaagtccaacagtcctggaacggcaacaaggctgagagacctggccctggtcatccgggacagtgagcgaacagggctaatggcccatggtggagattgtcactggcatggggaggagagcctgtgtgaggatgatccgaggtcctgggccccaagcctgctctgaaggagggcaaccctgaggaagacctcacaggtgacaagggcaaatgccctaggccgaagcatctgtataaggtctctgatgccactggacaggataaaccttgaccaaaggttggctgactccagcccatttgccccttgagacttggctgatattctgatgacttgcttgtgtgctggacaaacggggctcttgtgggaccagatctaattatctgggaagggggccgaagaagccgaattgaaaaggagccggcagtagcctgcaggtgggcccgagggttcaaaccgcgcatgagtagccccgaaactcaggggaggaatctgctcaaggc

SEQ ID NO: 553533 - DNA, 143 bp, Homo sapiens
cgttttacaaccgttcgttgacttggtaaaacccttgcgaccttttcccacaggaaacagtttattcacttttttacttgggaaaacccctttgggcctttttccccacaaaaaccctttttattccttttttacggtgaaaa

SEQ ID NO: 553534 - DNA, 294 bp, Homo sapiens
catacctgagactagtgtgaacaataggtctactccttttctctgcttccttttagcagacaagtactttcaagccccagaggtatcaggacaaaattatgggaaagaacggtggaaacagatgtctattatttgattttagccacagaaagccacagtcttaattagtggaaccctggtgtcccatgggaggagattgtgagaaccaccaaacttgtctagtcagttccttgtcaccattgcaaaaactggcctccctacgctgtggcttactcacaattcccaggtcatgta

SEQ ID NO: 553535 - DNA, 1391 bp, Homo sapiens
gagactgcgcaaggctggggggttatgggcccgttccagtgcatgaaatgagcaatgagggcagtggatgtggagcacagggtgtggccagcgtagggtccagcacgtgtgggtgtgtaccccatgtgcctgtgtgtcagacatgggacatggcatgtggtgacacatgtgacatgagtgggtccccatgctgccacctcaacccacctgcaacttcatttatgtagcagtgcacatgtgggcatgctcctgtgcacaggcgtttctcatgtgcctattgcctgtgatgcctctgatggtgcttggatgatgctgtggaatgacatgtgcagttgctcctggtggatgtttgcagcatgggactgtacaccagtgatgggtgcgacatgctgtgcccactgtggatgtgttgtgtgcccctgtgtgaacatttgctgcatcgcaatgtggatgtgcttggcaggtgtgctctgtgcctgggctggtgcttgcctgtgtccccactgattgggcaccttgctgtggccacaaggggatcttgggtagctgtgacgaatgggtgccctagcgatgttggagaacttttgggttagacagcatagtaattgacccatacaacgcggtttccatgagcccacttggggggggcatgaggcatatggggcagtggagcatggtaaccagggcaattccccatgtgggggcatgctccaaaggggggcccatttgggcgggactggatggaacgcgatggaacataagggcggaaaggcccggtggctgtggcgccggagaagtttggacatttgcacgctccttccaagggaagggcgaacagtggattgcgcttgccaacgggccaaagtggggcagcgattgaaacggggcacggcacggcaaagccgtgtagcagccagtggtaagaaagggccggggggcaagcgggcgccaccttggtggacccccttcccaaagaaagggccccaccgggagaggccccaaaaagggggccggggtggcccatcaggcacaggtgcaccggtgcaccaacacggggaacagccccggaggggcaaactgcagtgggaatggcgccatccaagggcagggttactaccggggtgcccatggtgtaagtacactagagggtgctcccagggggggtcttcatccccaaagagacagctggagtgtaggtgtggaaacgagttgtgcccccagacaccacaaagtgtatttggcgtcgagtagtgggtgcaccaaagtagaagtgctgccagagtggtggccccgtgggtagtgatgacacacaggttgtgtaaccaacttcgactggtgggctacacttttagcacgatgtgtcgtcccacagtagattgtacacagctagt

SEQ ID NO: 553536 - DNA, 1342 bp, Homo sapiens
  misc_feature (563)..(563): n is a, c, g, or t
  misc_feature (568)..(568): n is a, c, g, or t
  misc_feature (576)..(576): n is a, c, g, or t
  misc_feature (614)..(614): n is a, c, g, or t
  misc_feature (704)..(704): n is a, c, g, or t
  misc_feature (858)..(858): n is a, c, g, or t
ttatggccgggcgcggtggctcatgcctgtaattccagcactttgggaggccgaggcaggcggatcacaaggtcaggagtttgagaccagcctgcccaatatggtgaaaccctgtctctactaaaaatacaaaaattagcctggtgtggtggcgggcacctgtagtcccagctactcaggaggctgaggcaggagaactgcttgaacccaggaggcgaagtttgcagtgagccgatatcacgccactgcactccagctgggtgacagagcaggactccgtctcaaaaaaaaaaaaaaaaaagacctgtactcagggacccaccactacacagctgtacagcaagggaaccacagtacctccttcaactcaaattgcttccccaacaacattgtcaggatgttaaataaaacaatgtttggaaaacacagtgcttcatgcgtagtaacaatgctaaatataacacttaaaatgtgcaaacctcatgatttacctaatcagcctctaaatattatataattctagcccagaaacttacattcctcagtctccaaagggagacctncacanaacaatantttactataatgtcagtttctatcagcatttcacatantcacataaataaaacttctgtatcgaatattaaactcacaagtccataggtttttaaaatatctctaatgtaaaagattcttcaacattnattataaaccattgattaacaaaaagttcctggtcaagggtggtggcttatgccttgtaatccagcacttttggaaggccgaagcaaatggatcacttgagcccacgagtttcaggacaagttgggcaacccagtaaaatctgaaacttacctntattaaaaacccaaaatttaccacgccgggtagaggaccctgaatccacgtttctaaaaggttggcatggagatcccttggcctgggaagccaggtcacacccggattttagaccaggcaacaatggggaccttgtcaaaaaaaaaataatcgcaattggggcatttgggacaattcccttatgggggggtacacaaaaagggcgcggtttacaacgcggagtggaaaacctgggtcccaatatactgttgggaaaatccctttttgccatggataaataaaagcccccccatagctcttcaaagtgcccccacgtgtcaagaatatagggatatttttaaaacgccaatatttaaaagttttttcacaagcgactggtatcctttaacagaaacacccggggtgggtggtctcttaaagactctttaaagagcccccagggggaaaatattgtggggcgcccgacccccattgtggggggggc

SEQ ID NO: 553537 - DNA, 595 bp, Homo sapiens
gcccgtctttctgaaacggaaaaaagggactaattttttccccccctaataagaggcacgaaatttcccccccccccgattatttcttccccccaccccctccccctagagtcacacacctgcacttcagcagtgtgcccatttgtctcttccccctgaaaaactgtcgtacatacaccatagggggagccactttcaaacagagtaagacaagtttctaacaggcgtcttgagaccaggttttggcagatacaaaaacacagaatcaccacacccactgattagttttcttgagtgtttcacctaatcagacaacaccttcttgacaagttcagcaactatacactttcaccgcttgtcattaatgcgcgcactgtacatcaccccctcacgtaaacagtcaagccacacttttacatatacccgcccccttgtgaataatacacgcatgcagtcattttttccaaacaaaaagtcacatacttcttcacagagtcacccacaaacttcttaaggcatggtaatacttgtaaaaggccatttatgcgtctcaatttccacccccttcaatatttcttccccctaaccacaaaac

SEQ ID NO: 553538 - DNA, 889 bp, Homo sapiens
  misc_feature (409)..(409): n is a, c, g, or t
  misc_feature (792)..(792): n is a, c, g, or t
ggatccagccagagttggaatgatgatttatttctaaatccagtactttagcgggtgaaaattctatctggacccatgaaaaatttacctgggcttagggccagagtaaacacagtttacaggaggaatgaaggctctcatgtgccaatccagttcattggtgaaattgtcagtactgtacttagacccaacatagaaaatgtggtgattctcttacctagaactgggacctgtgcgggattgttaactttattactggaccttcctgcaggagtgattatcacatatgcctatgttcagcacctgagtgatttgattttgctgcctggtcccagtctgaaggtaagattgtgattcatcactggatccagcacctcggtgatttgactcttcttttttggggaccccnaaaattttaagtattgtcaattttgggtgaatcctgcgagccatgtttatgttgactcttcccaaaatgttggctctacatgtttggttgcccatactgggggctccaatattttccccatttagaccattggtctacctattgctctgggtttaaacaacccagggtgcactgttaacttttttttctggggactgcggttgccagggggacctctgtcgacctttaactccatggtcccatcaccaattacctggtggttactcccctttctcctggcgccgggcttcggttccccgaggacacttggtggccgatttactgggctatgcttcctagggtcgagtcagatctccccctttttttccagggtcccgctattnggcgcattggccgccctttttggttggactcaacccctaggggttgcaagtttgcctactcgtgtgccgtccctaacggggacccttgtgactttta

SEQ ID NO: 553539 - DNA, 366 bp, Homo sapiens
acctgcgtgacggtcccggaagggtacgctgttacagtatagaaattcttattgtatagaacaagaggttcgccagtcatgtagctggccaccccagagggcaaggggtactggtttcgggtggtgctcagctctgaagggatgggtggaaggggaaacgttgggagaatttgcagtctgtccctcagcatgtaatcatgatccttgggagatatgtgcacagtctatccctgggattgagtggtcctaccagcgagaatggggtcatttcttggccaacatctgtcagcatccaatgaagttagcttggtcggggaaatgtgcatgtacgcgtctccacctgtgataaactacacataacaaatt

SEQ ID NO: 553540 - DNA, 751 bp, Homo sapiens
catgctagcagtggttgaacccaggtaccaataggggctagtatcacagaggcctcacgtggtgtcctcggtaattataccacctgtgcctgtgtcagagggaatgaccgggactgaaggtaccttacgactggctcatattatcaaaggaccttggctctttctagatctctagtctctcttcatatccttcatcaggtgtgttaagatgtctctgagaagccatcaaggcaaaagagaactttaagtaccatgtaccagcccggagttttgggaaagaaagaaaggaaaggtcacagtgagctaggatagggaaccttcctgccctttcggcttgcagacggccttcgtatcccagaacagctgagaaatctatgaagctgagattctgaaggacccagtgttaggttcttccagttaggcctcagttcccttccttttccaggggcggtcttagttcccatggccctgaaacacacagatttcccgcttccttgcccagaagccactggccgcccattttgccaccagtgcatcctttttacaagtggaagaactaggatggctttccaaagtcttctagaaatgaagtctttctctgtgcagctttccccttggagcggagtgagatgttcattatctgggctgggaaacacttccaggctctcctcccccacccatagacggtttgcttagttggctatgtgcttcttattcacctttgctcggaacggggcgacacagaagcacc

SEQ ID NO: 553541 - DNA, 451 bp, Homo sapiens
  misc_feature (274)..(274): n is a, c, g, or t
  misc_feature (314)..(314): n is a, c, g, or t
tcatgtactatgacagtgtaaaagcggctggtacggtcgatatccgatatgtacagcgtcgaaagaaagaaaaatgcttgtacatataggcaggcaaaaaaaaaaaagtcctgttggaaatcatatagacaaacattggcaaagctgctactgccatggtaccagtgttaaacctggtgttctacctgtgcatcttttactgatttttatgacagattttatatggtaaccattcggagaactcggtaagtgctatggcttccttaaactacgnatttatcaatatgtgctcccggggggtttaacctctgganagactgaatggcaaccagagaatgtaaacaaccaaggtgcatctgggttatgtttctaaaataaagattacataaaaacgttgggggttttctcctcgtgtgctcctttagaacccctctctccgtcgtctgtctaa

SEQ ID NO: 553542 - DNA, 477 bp, Homo sapiens
  misc_feature (426)..(426): n is a, c, g, or t
taaggttggaggggggaatgccggaaatggtacggggtttggaaactctttcatataagtaaggccagggtgaggggaggaagtttccaaaggaggggtatgagtgggtcgtagcggaatcgggggtatgcggtcgaattcataagaacggggaggttagaagtagggtctgggtgacaaaatatgtggtgtagagttcaggggagagtgcgtcatatgtggtccctaggaagattgtatgtggtgagggtgttatataataatgtggtgtatccggctatgaagaatagggcgaaggggccggcggagtataaccagaggtcgaacccggagactagtgcggacctccccttcggcaaggctcgaagggggtccggatgggcatcggcatagtggtggagataacatcatattagggccaagggntcatgatggcaggagtaaccagaggtgtccatgtgtaggacaaagggtgga

SEQ ID NO: 553543 - DNA, 1301 bp, Homo sapiens
ctccctctttttctccttcgtcggtggaggagctgtgacgtctggctatagtgttcatcgcaacgcgcggacaattttgcgcgtgtgcttgtgagtttattcggtgatgtggtgtgcgccatttacaccgcgtggcaatgtgtctgggtctcgggaacgatcgtgttggggcgtccactgttttttggcgtcaacggggaattgtttttccacccttggttctgggcaggcacacgctttcagtacggcgcgaaatttgctccgctattttctacaggcagggggaaggtttccttaagggcaactttcaaagttggactgaaatggattttcttacttcgggagcttggtctgaagatggccgtaactctcggatttagagttccgaggttacaccacagaccccgggccccagggagtcgagtatttgtttaccccccccgggacaccgaaatgttttcctggttgaagaaagggccggcggaattttcggggaactgaactgctggtaatttcacgaaaaaagggtttggctcttccacgaggcgcccattgtatgagcttttaattgcctgtacaaaggttgggccccctaggaggtttccttttgtggccacctgtggccccacggcaagagtcctcttgcgggttaccagagcgtccttatggggaggggcctttcctagtgtcgcgaagggggccctgcctattgggtgtttccctagccggttctatcacctggaggatgttggggccccaaaggcgtgtctgaaggtctcttcggtcgtcttgtgggagaatacttctgaggggaaaagaaggggctataaataccactggaagtttttgtagaatggtcgctgagttgaatccaccacgggggagagacaccctcgtgtataactattctaacgcttgaacacactgcactgttgtgcgcccacacgctgtcttggctcacgaccacgcggtgtttctgggcactcaaagcgctgatagagtcacatgtctgaccctgggaacccacaactggtataagaattggcccctatagagaagcccactgcctgagccacacgctgaggcacattgttggagaaccccacaagaatgaggatatctgcccacaccaccccccacttctcagaacacgaagggtgggaatccacgataccgcctgccaatgccccacgccacgtccccaccagcataaacacagggtctccttggcacgctgtattttctggagtctggatgttgctcttcttaagacccttttataaaattttggacaaagacca

SEQ ID NO: 553544 - DNA, 218 bp, Homo sapiens
  misc_feature (181)..(182): n is a, c, g, or t
  misc_feature (208)..(208): n is a, c, g, or t
tgcttctgtctcatcgccgccgccgctgccgctggctcgccgcggggactgcacgacagctgcccgggccaagcccgctacctcctctgggcctacacttctcgcacgatgataagagcacttttgaagaaacgtgtccatactgttgccagctgttggttctgataactctcgagtgcgnntcaaacccaaagccagttgctcagcnaagtcctgta

SEQ ID NO: 553545 - DNA, 397 bp, Homo sapiens
aaggttctcactagaactgatgttagcacagttcgacggagcaaaactatcagacgacactgtaaaattgcttactggactgaataaactctgtttagtccagataaaagggttactcttagttacaagtgttatttgtaaagtcctgtcatattcatggtcgaaactgggttgaaagcaattgaaaatggtccaacagatcagatcagataggcacacacgcctggagtggaggcagggttgtatctaagcctccaccatcagtcatgttacattcaaggggccacagtggaggaaaataaatccacaaagtagattatctaattaccatcaaaatgagtcagaagcaaaaaacaacaccctccaacagcctcttaggagtacaacctgccggtgg

SEQ ID NO: 553546 - DNA, 530 bp, Homo sapiens
cgtagagtcgagcgtgtacgcgtcttgcttggtgtgctctgctgttatcatcgtcgctactgtgaaaatccgtggcgttgcatactgcattaggtacatccctgagaacgcattgtacgtacattgattgctttcgccagtgtgatgatctggaatgcgaccggagcacattgttctgaagaatcccaggatgagtctgtcgagggaagaatccggtcatagcctcccctctgagaccggcctcagatcgagggcagtccattatctgtcgcatacatctgtcatgtccctgagattgcgggaggcagagggatgcatggatgtccacatctgtcccgggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggacatccccacttcctcctcttacccaacacatgcaggcta

SEQ ID NO: 553547 - DNA, 1290 bp, Homo sapiens
ggcccctggatgcgtccccgatctctcttcgtgtggagaccgatggggcgggtgtcacggtcaggagggtgctcatgcgtggaagtgaatgctgcgcctgcgattctgctgactgtccgatgcgccagcccatgtgatgaaccctgcatatgccatgctgtgacgcctgtttctcgtgtgctgattcgtgtgatgtgaaacatcgcaatcttgttttcgcactgtggtttcctcatgtaggaatgacgagacgacagttgtgtgagcacaacttgaacttgatgtgacacgacacgcctacatcacattgacgtgtgtctctaactgtctccaacgtggtgcagcagtgcattcaacttgacctgtctatgcttacctcttgggaatatgacacagcatgtacgaaggcacgcgcactgacgacaacgcgcacaacgggcacccaaggccacctgcaccagggctccaatcgggtcatcacgacctaccacgcacggcaaggggaatgacaggcccaacctttgcctcgcgggcgacaccttaagcccgcgtgctcgccttgctgctccacacattgggcacgcaacggaccgtgggctaccactaccaggtgtgaagtatcgccttatacaccacggtgaatcgccccttaccagaaacaccacgacgataccgcctaacgttaactatccctcatcacgatacccattgcaactactataaccaaccgcacctcgcagcgcaaatgagaagagattggcacgaggccacaacgcggtacagaagcgccgattacccaatccatgatcggcactctgcgtcgctgcatgtgccatttggtcaagttcactctgcgccattaagtcccgctgttcctatgcgctcccattcgcaccacttggcgtccccgtagggctggagtatacatcgacgatgcgatagagttggtgactacgcgcaaaacagtcaatgcagatgggcactaacaacgcaacgcaacaagagagtgaacattggacagagacgcaacagacaacacaacagtcagcgcaacagaccacgcaatgagacacgaccacgatgggcatgagcgctcgacaaaggaatccttacctgccccaaagctacctgaggaacgcttgggcccccaggagcaagcgcaccaccagaacacaggcccaagggtacagcaccagcataaagcttacaaccactaggggactagatgtcgaccgccacgactacatctgagggcggcatcaccacagatcagatgggcataactacgcc

SEQ ID NO: 553548 - DNA, 1073 bp, Homo sapiens
gccaaccccacacacaccacaccacgctccccgccacgcccatgcactagtgacctatagacccgtggtttaacaccagcacgtgatggtactggtccggttataacctgaggcatatcagtcgacccacgctgtactggcaacattagaagatataaaaattttgccaggtgcattgtgttcacacctgtaatcccagacgcgtttgtgaatgaccaatggtgtggaggattgcttgagcccagtgcatttgaaaccagccctggacaacgtgatgaaaccctttctctaccaaaaaataaaaatacaaacaaagaaagagtgtgtgaaaaatttagccgcggggcggtgggtggtatgtggtgccgtgttggttcccagccgtggtgtgggaacggggcgtggtggtgtgaagagaggtatgaaattcaaaccccccaatggaaggtttcaaacgcctgtgccgatggtagacacctccagtggtctcagcaactctacacttgtccactctcctcagaccttgtgagatatgaacaagaaagacaagatcacccttgagcactctcctataaaagaacacaatacacagagtgacagaacctctctctctcaccacagagtgtctccccctacccctttttacaccatatcatttacacacaagatatcagcgtgtatctatcctctcttctcactgtttatatgtcacagcgtgccattattttggctcccccactctatcatttcgaaccgcccccaggagatcaaaaccaaatacccgccactcttcgacgacaacttacctctacacacacaaacacaataccatacgacactatacaacacacaaccattctctaatatacaaataccacatcttccaaaaaaaaaaacccccctattctcataccacgaatccttatcatcccaacaatactcttctatgtcgacaaaacaacacctaccacatcttctaaacccattatgtagccccccacaaaacatctcccattcccacaaaccccccatcacaaacaccctgtgaccacaccccatatatattcccccta

SEQ ID NO: 553549 - DNA, 137 bp, Homo sapiens
catcatgtaaacaggaattattcccattgcttgtttttagtcaggtatgtcaaagatgatgattgtaggtgtgcggtcttatttctgggttccctattctgttcccagtctgtgtgtgaaaaagtgttgggcgataa

SEQ ID NO: 553550 - DNA, 109 bp, Homo sapiens
gaatatagatgacacgagggagaacggccctatactctgaaacattcgaaggtcaccaggtataagaggagagggcgatgtggccaggcgcggcgaggaccacaaagcc

SEQ ID NO: 553551 - DNA, 114 bp, Homo sapiens
gtaaagttcagcactcttttccttatcaggatctttcacactagtcctctattcctagtcactgtatagctgctcatctattacctccccgccctatctgatcggtcttctcgc

SEQ ID NO: 553552 - DNA, 268 bp, Homo sapiens
atgtggttgttactgctttcattcagattgcaggcgtttcattgttactaatgttggggttgtttcatcgtaatcagagaatactgtctataaccttttaacttctgggacatacattcaggtttcctttgagggctcatgtaagatattagttcagggatatttaaaatgaagctatgttccccattattagagaccacttgctacatcttctagaattacttcttaataacataatcaaggccttctatatcatagttattgaacc

SEQ ID NO: 553553 - DNA, 313 bp, Homo sapiens
gtaaaaactaactccttttcacaaagtggaagttaccagaatgtgatttcagaggccccgggggatttatcatgtgaggggtggggggggggggttgtggtgtggggtggttggggtgtgatgtggtgggggggtggtgcggggggggggggaggggtgagggggtggtgggggggggtgtggtgtgcgaggtgagggggggttggtgtgagggttgcgcgggggtgagcaagatttggactgtgatgttggttgttctccactctttctacaggacagaacagggcctctagagtgggaaatggcttttggg

SEQ ID NO: 553554 - DNA, 979 bp, Homo sapiens
  misc_feature (42)..(42): n is a, c, g, or t
  misc_feature (843)..(843): n is a, c, g, or t
  misc_feature (928)..(928): n is a, c, g, or t
  misc_feature (961)..(961): n is a, c, g, or t
cgtaggctacctatgaggactccggacagcacagaggaggcnggaagcgcgcggagaccatgtagtgagaccctcgcgaggtctgagagtcactggagctaccagaagcatcatggggccctggggagagccagagctcctggtgtggcgccccgagtgcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgatgggctggcggtagggctgcagcgaagaccgggctcgggccatggagctgtgcctggctttgctgctccacaagggcatcctggctgtcagcctgtccctgcggctgttgcagagccaccttagggcacaggttggtggctggctgtgngatcctcttctcatgcatgacacctctaggcatcgggctgggtgcagctctggcagagtcggcaggacctctgcaccagctggcncagtctgtgctagagggcatggcagctggcacntttctctatatcaccttt

SEQ ID NO: 553555 - DNA, 112 bp, Homo sapiens
actctaaggatccgcgtggtcagcaatctctgcctgggttccaaagtgcaggatacaggcgtagcctgtgctcaaagttctatttcttgtctgcaggaaccacgcggctacc

SEQ ID NO: 553556 - DNA, 293 bp, Homo sapiens
aatgataaatcgagctctgtacccgtaacattcgtgtccagtcaatacacaccaacacaacaatcatgtcactcacacacaacacactcatatgatcatacacacactcacatacaacgacatctcatgtacactcattacagctcacattcacatatgttcatacgcaatatcctcatgtacacttacactcacactataacactatacacacacagcactcaacacactacacacacactcatgtactctcacacataacattacacacacaggacacgaatgttcagggc

SEQ ID NO: 553557 - DNA, 207 bp, Homo sapiens
  misc_feature (197)..(197): n is a, c, g, or t
  misc_feature (204)..(206): n is a, c, g, or t
ggggggggggggaaacccttttttaaaaaaaaaacccccccaaattggaaaaaacctggggccccaaaaaaaaaaaaaaaccccttaaaaaccccggggaaaaaatttttttaaaaaaaaaatttttgggaattttttaaaaaaaaaaaaaaaatttttttttttaaaagtttaaaaaaaaaaaaattggggggggnccccttnnna

SEQ ID NO: 553558 - DNA, 374 bp, Homo sapiens
  misc_feature (169)..(169): n is a, c, g, or t
  misc_feature (321)..(321): n is a, c, g, or t
cgccagagcactgtatggcaggcccccatggaggatcaacgcagtggctgaacaccgggaaggaacgggcacttggagtctggacatctaaaacttgagtcattctctatagacagagcatcgagaaggcaagaatgaaaaaaagaatctctctaatgttcagggcccnctgaagccccaagctaagccatcataaccctgtgacctgcgacatatacatccagatggcctgaagcaactgaagaaccataaacgtgaaatagccagttcctgccttaactgatgacattccaccattgtgatttgtgcctgcgtccaccnctaactggatcaattggatcttgtgacattccttctcctggacaatgagtctt

SEQ ID NO: 553559 - DNA, 187 bp, Homo sapiens
agtatggatgtaagggatagtgcttatctttacgagctgtggagttcttaaatatcaaccatggcactttctcctgaccccttccctaggggaattcaggatcgagaaattttccatcgagccttattaaaatagtaggactagtacctgtgggcttcagtgatgggatagtacacttcactcagag

SEQ ID NO: 553560 - DNA, 111 bp, Homo sapiens
ccaagacggagtctcgctctgttgtccagatggtgcagtggccaatctcggcccagtgcaacctccgcctcggggattcaagcaagagtcccccctctagcacctcagtcc

SEQ ID NO: 553561 - DNA, 830 bp, Homo sapiens
  misc_feature (15)..(15): n is a, c, g, or t
  misc_feature (76)..(77): n is a, c, g, or t
  misc_feature (129)..(129): n is a, c, g, or t
  misc_feature (132)..(133): n is a, c, g, or t
  misc_feature (140)..(140): n is a, c, g, or t
  misc_feature (148)..(148): n is a, c, g, or t
  misc_feature (158)..(158): n is a, c, g, or t
  misc_feature (162)..(162): n is a, c, g, or t
  misc_feature (165)..(165): n is a, c, g, or t
  misc_feature (226)..(226): n is a, c, g, or t
  misc_feature (231)..(231): n is a, c, g, or t
  misc_feature (233)..(233): n is a, c, g, or t
  misc_feature (235)..(235): n is a, c, g, or t
  misc_feature (238)..(238): n is a, c, g, or t
  misc_feature (241)..(241): n is a, c, g, or t
  misc_feature (246)..(247): n is a, c, g, or t
  misc_feature (249)..(249): n is a, c, g, or t
  misc_feature (298)..(298): n is a, c, g, or t
  misc_feature (311)..(311): n is a, c, g, or t
  misc_feature (336)..(336): n is a, c, g, or t
  misc_feature (348)..(348): n is a, c, g, or t
  misc_feature (352)..(352): n is a, c, g, or t
  misc_feature (365)..(365): n is a, c, g, or t
  misc_feature (367)..(367): n is a, c, g, or t
  misc_feature (371)..(371): n is a, c, g, or t
  misc_feature (376)..(376): n is a, c, g, or t
  misc_feature (428)..(428): n is a, c, g, or t
  misc_feature (432)..(432): n is a, c, g, or t
  misc_feature (437)..(437): n is a, c, g, or t
  misc_feature (442)..(442): n is a, c, g, or t
  misc_feature (458)..(458): n is a, c, g, or t
  misc_feature (638)..(638): n is a, c, g, or t
  misc_feature (673)..(673): n is a, c, g, or t
  misc_feature (678)..(678): n is a, c, g, or t
  misc_feature (683)..(683): n is a, c, g, or t
  misc_feature (687)..(687): n is a, c, g, or t
  misc_feature (725)..(725): n is a, c, g, or t
  misc_feature (741)..(741): n is a, c, g, or t
  misc_feature (825)..(825): n is a, c, g, or t
gggctcatttgttanctgttttgcgcacatcaaagctgccacagggtcctcgcagcagctctgccagtagcgcaanngctgcccgtgctcctcctgtacgctggggggaagtgcagccagctcgctgcncannctccgcnccaccatncggcccaggncccnccncagctccttcagcagccgcacggtacgcgagtcaccctccagccgcagcaggtcactgtcnctcantnanatngtngcccnncncccgtcatcacggatgtgcacgtccccgtcggtcagcagcagcacagcnagcgggtgcaccngagaggagtcccggacgaagacgcngccattggactngacngccaggaaagacngnagcnagccncgcccgaaccggggggccgcccggggaaggggcgacgggggccagagcgcangcgngcccngcagnggcgcgccgagaggcngcaagcaggcgggcgcgcaggcaaaggaaaaggcaagcgcgcggcaaagggcaaaggcaagacaaaggccaggcaaccgggcccccgagcagccaacccaaagaaacaaagcaaagggaaaaaagcagaaaggaaggaaggaaaggcggaagagcgggcaaaggccgcagccacgcaaancccggcaacgaagcaccccagggaaaaaaaaaacncaacncaagnaagnaaaggcggagaggcagcaaaggcagggcaggcacgaancggccaggcaaacacnaaccaggccccggcacgaaaacaacccgggggaagaaaaccgaaaggagaaaaccccacaggcacccgaaggcaaaaagcaacnaaaag

SEQ ID NO: 553562 - DNA, 187 bp, Homo sapiens
actcatgcagcagtcctacaacaccttcaagtactactcccactttctcttcaaagtggtgaccaagctggtgaaccgcgctaccagccccacctggaggactttctctgcgcatcaacttcaacaactactaccaggaccctgaggctgctctgcgggggacgtgcacaataaaggagttctcgga

SEQ ID NO: 553563 - DNA, 412 bp, Homo sapiens
acagtgcgtcctgttaggtactggctttcacatcatactattagagaggtctgtacccacccaggctgcacggaagacgagagacatgcggacctcctgagcaaagctgagactagtactgaatactacatagatgaccaactctcagaaactaccagctgaccaaaaaaattacgatatccaccactgtgagcagactggcgaaacaagatccaggccctccaatatctccttcaggcagctggagagctatcccccgcacctcaagcacctataacgagtgaccataccggatataacttcagaccgtggactgtggatataaaggtcaaagccactgcatctgaccaacaggttgacgtgatacctcctatagcgagcacaagtaacatccaggacgccagctaagccc

SEQ ID NO: 553564 - DNA, 116 bp, Homo sapiens
agtgttacattctgaattacttaatgtacattctgtgggcattgctgtttgcatttctggccgtctccctggtacgtgtatttgcaccatatgcttgcggctctggcatacctgag

SEQ ID NO: 553565 - DNA, 118 bp, Homo sapiens
cttctagctcggtaccccacaccacctgagtctacaccacctgagtcgcaggcacatacttcctattctacaccctagtaggctcccttcccctactcatcgcactaatttacactca

SEQ ID NO: 553566 - DNA, 251 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatccctcgcgaacgtgttatccctcgcgaacgtgttatccctcgcgaacgtgttatctctcgcgaacgtgttatcctcagttagacaaggtagagccgaggggtaccgagc

SEQ ID NO: 553567 - DNA, 272 bp, Homo sapiens
gatcgtcctcaccctgtctcctcacctgtcgtccaagaagggcaggggaccctgagaagacaattttctgatactgaccatgaccttatagagacagattccaaagacggggcctccacatcccttagaagaggtactacagattttcaaagcgaaaaattagattcaacaagctcattccccatcctcggtcattcttaccttgtcacttcacctgtcaaccaagaaagaggggaccctgagaagaggattctctgatactgacaatgatc

SEQ ID NO: 553568 - DNA, 268 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
  misc_feature (224)..(224): n is a, c, g, or t
  misc_feature (229)..(229): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatccctcgcgaacgtgttatccctcgcgaacgtgttatccctcgcgaacgtgttatctctcgcgaacgtgttatcctcctctcntcacntggataacacgttcgcgagggtaacgagctcgaatcgta

SEQ ID NO: 553569 - DNA, 883 bp, Homo sapiens
  misc_feature (54)..(54): n is a, c, g, or t
  misc_feature (76)..(76): n is a, c, g, or t
  misc_feature (85)..(85): n is a, c, g, or t
catttagcccaacaagaagcacagcactttgaaaagtcaaataggcctttggtngctctgtacatttgcaattttncatttgttnttagtttatagcactaataacacttcagtcgtgaatctacagtctcaatatgataagtcttagaacatgttctagaaatagtggtaccttgctgctattatacttagtaacttataccccaatataataataagtattaaatacagattgtgtatgcattctttgtgtgtatatgccaactgtactacttaacctcactgatgagcaattagaaaaatacacaaattgtcatagtgaaaataagtcttggtcaattcagatgatacgtgaacctgataaatgctctaatagatatgctattttgtcctgtattgcttgttttacagtatggtgcatgttgtttgctaagtaaaatgataataataataaagtataccaattttaaggttagaattaaaattttgcacatatgcttcttgatattctgaaatgtattctgtggcttaattatcttattcatacacatttcacttggctttttacccctaggaaataattgtccaagtatatatctcgtcttctttcttgtaactttgattaaactgcttacttcaacttacaacattgtaaagccagaatacctcattttaacagtgaaaaaaaatatgatgacctgatgtgttctcttgtatttgatttgaactacctaaataggcttaactgtaataataaatatacaattttggcaggcattttttcctttgtttggatgaacattttgttattggtccacttctaattttgtcttaaagagttataaactcagtgtcaataaaacatcttgttatataataaaaa

SEQ ID NO: 553570 - DNA, 804 bp, Homo sapiens
  misc_feature (337)..(337): n is a, c, g, or t
  misc_feature (531)..(531): n is a, c, g, or t
agcggctgttgaactctatgagtatggttttcgcctgtcttccttctaccccatggcagctgtgggaagcagtggctcagagccaaagtctcttggttaatcgtatagctctaccaagtactacgacgtagataatctgttcaaaatgtgtatgaggtgagctgatggaggctacctgagaaggtcataagttacattccagacagtcatggcttatgtgcagaggtcgctatgtagaaccgcttagatattagatagtcagtgcgtgaatagtcacaaaggcaacttgaccacttctgtatcacagaatactgctgataactatcttccactgttngtcttgcgaatcacaccattaccaagcatttctggcactggtggtagataattatgaccgcatcgagtgtggattctctaataagctatttatagagtgcattcgagatgtgatgttaccgcgatggatatggggtaaaactgatgacaagaagagtgcatatgaatgcaatgttatgttacactagtctgagntgtgattacatttgcggttgatgatagttggttgtagtccagggagaggtcgtggggtcagttcaactccactagaaatgatttttcgcttgtttctacagatggctccttcgtgggctctgtgtaggattagagtgtccatttagtagaacaaatagaccttgctatatccttgcatggaggtttagcacctttccttggtgacattctagctgagtctgcaatacttacttcccagatgaggcctagagaaaatcctcagaatttcatgga

SEQ ID NO: 553571 - DNA, 380 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatccctcgcgaacgtgttatccctcgcgaacgtgttatccctcgcgaacgtgttatctctcgcgaacgtgttatcctcatgtcctactagtatcatttctttcttgacggacataaggataacagttatttattaggatgtgacaccagacgacgtacgtaccttacacctgattacggttttcttctactttcactgttatctgtgaccactacaacgcccatgctacgacacagactg

SEQ ID NO: 553572 - DNA, 872 bp, Homo sapiens
  misc_feature (54)..(54): n is a, c, g, or t
  misc_feature (76)..(76): n is a, c, g, or t
  misc_feature (85)..(85): n is a, c, g, or t
catttagcccaacaagaagcacagcactttgaaaagtcaaataggcctttggtngctctgtacatttgcaattttncatttgttnttagtttatagcactaataacacttcagtcgtgaatctacagtctcaatatgataagtcttagaacatgttctagaaatagtggtaccttgctgctattatacttagtaacttataccccaatataataataagtattaaatacagattgtgtatgcattctttgtgtgtatatgccaactgtactacttaacctcactgatgagcaattagaaaaatacacaaattgtcatagtgaaaataagtcttggtcaattcagatgatacgtgaacctgataaatgctctaatagatatgctattttgtcctgtattgcttgttttacagtatggtgcatgttgtttgctaagtaaaatgataataataataaagtataccaattttaaggttagaattaaaattttgcacatatgcttcttgatattctgaaatgtattctgtggcttaattatcttattcatacacatttcacttggctttttacccctaggaaataattgtccaagtatatatctcgtcttctttcttgtaactttgattaaactgcttacttcaacttacaacattgtaaagccagaatacctcattttaacagtgaaaaaaaatatgatgacctgatgtgttctcttgtatttgatttgaactacctaaataggcttaactgtaataataaatatacaattttggcaggcattttttcctttgtttggatgaacattttgttattggtccactttttttttttttttttttatttttattttttttttttttaatttttttttttt

SEQ ID NO: 553573 - DNA, 249 bp, Homo sapiens
  misc_feature (214)..(214): n is a, c, g, or t
  misc_feature (223)..(223): n is a, c, g, or t
ggtagttacccatatcattcatgcgtggtcgtagctttttgctagtgtgaacaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggagnttcaggaanatttgtaagaaaaaagggcaaaaaaa

SEQ ID NO: 553574 - DNA, 160 bp, Homo sapiens
gagggagcagggccctagccaggaccggtaccctatcctctaggatccagaccttgttttggaggcttgttcttaacttttggcgcatgtgtttcgagtttctctatttttaagatgttgaaggcctattgtaccgtttgattttttttattgtttgtga

SEQ ID NO: 553575 - DNA, 185 bp, Homo sapiens
tggggaaacaaggccccccagggcaaactgcccatggccctggggttttggcccctgtgggttcaaaacaaggcccacccttcccctggaagtgggggcccaaaattaaagggggcccatttaaaggtttaggcaaagggggaaaccaaattaccctccaaaataaaggcccctgggctttttta

SEQ ID NO: 553576 - DNA, 108 bp, Homo sapiens
tgacagagcaagactccatctcaaaaagaaaaaatatacaaagaaagaagtataaaacaatataatgcctaacaaagaacaacccttaacaatagcagggtacaacca

SEQ ID NO: 553577 - DNA, 211 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatccctcggctctaccttgtctgatctgaggtcgcggataacacgttcgcgaggggtatcctctagagatc

SEQ ID NO: 553578 - DNA, 204 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatcctgcctccattccccagttcggtcgcccttctatgatacacttcgcaggggatcacagagc

SEQ ID NO: 553579 - DNA, 117 bp, Homo sapiens
ggagggaagtagctccgaacaggaagaggacgaaaaaaataaccgtccgcgacgccgagacaaaccggacccgcaactactaggaacaggaggggtcaatatccaacacagccaacc

SEQ ID NO: 553580 - DNA, 619 bp, Homo sapiens
ttaataatacctttaaagttctcactagttaattactttatcaattcaaaggccattatatattatcttaatatgaaaaagtttaaaatattttattataaatataagttggaaattctttatataattattgaacatggaaaatatgtaaaaatacaagcagaattttgtggctgaaaagagccatttaggtattcagtgatgtactatatagcataatattctaattcagtagactaaaggtccaaataactttgttctaatttaaattattcatggactaattatttgcctttgggtacatcttggggtataatttattaatccataaaattaggttaatataagttggtgaaaacataattgtggttttcacaatattgaaatttgccatttgatattggaatacattcttaaattttggttatattatacatcattttaatgtgcatttcttgctcttttttttgctaatgacttattacttgctgcttgcttcatatttatttttatgacaatgatcttatacctccagcacgttttggctgattccctaattcaggcccactcggccttaccgcgcggccccaccttatcacaccccctgccttcggccccc

SEQ ID NO: 553581 - DNA, 2110 bp, Homo sapiens
  misc_feature (257)..(257): n is a, c, g, or t
  misc_feature (799)..(799): n is a, c, g, or t
  misc_feature (801)..(801): n is a, c, g, or t
  misc_feature (803)..(805): n is a, c, g, or t
  misc_feature (2075)..(2075): n is a, c, g, or t
  misc_feature (2084)..(2084): n is a, c, g, or t
aggcaagatttcaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacnccaagacatacatacacagcttcaagatgtcaaggtaaaagaaaaccaaacgtttcactatttagtgtttgcctgctttatttggtagaatgactttaaaaagtcattccctaattggcctgctttacaaatccacgttgttattgtgggctttgcattaactagagtgtacctaatatttttaccacttcagcattgtaagctaaaagatggtctgaaaatctgaatattctcattagtactgaaattattctcatgctagttacatattaataagcttttatttataaaagtttactaataatgagaaatttgtttctttggttttgatttcattgtaaataaatgattatgatatttgggtagcacgttttagattttggaatactacataaagcgtagtgttctctctacgatgatttttaaacttaacacatgctgctacaacaacaaataaacaagcaagtaacatttgggtagccatatcacgatcagccaaagaagaatttgtcgtagaatgttaaagctcaacatgtaaaatncntnnntgtgtcaagcaacagcataagaatttactctccgagcatgaacaacttgtagtgactttggaagaccacaagagtgcactagctgctgcacagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggagnttcaggaanatttgtaagaaaaaagggcaaaaaaa

SEQ ID NO: 553582 - DNA, 883 bp, Homo sapiens
aggaattacagatgctgacaatactgtgggaacctggagaaaattaagatgtccagaattgattgaagcgttcttaactctcagaaagctggtgaagaaagaagcatggttacaaaaggaagaatcttgatctgacgagatgaatcctgatgacagggaaatcaaagaaagtagaagagatgcttgctgtacagaactcgaagaggtattttgccagagggtcgtgtgatccttggaaaagatttaatgtgggttgccaaaggaagagctagtggtaggaatctggaggttcctcgatgaacatgggcaagagtattcagatgaaggcagactatgggtgctgggggaaagaggcaaattatgattgtgtcctcaaattttgtaatggtgctttagatgagagatgagactaagtgtgtggattctatgtccaggaagatgaaagctctattacactgtgttcacattttgtgcttgtgatatatatttcatatatatactaagaactggggtctgagattttgatttacctagtgtgactagatttaacctacttcctaggtgaacaatccacgttgtgatatgtgggtctgaaaagtacgcgtggaaagagttgccgaggcggtgaagcatcctgtaggacatggttatctttgaagcgactaaagtaaagagctttgtggaagtggcttccctttattcctaaaaggaaggtttggtacccgtggtacttgtcatggcccctttcggtaaggaacagcgttcctcaatgtggaggaaggcacagcatagtctgtcaaatgtggtgaaaggggcaagggcacactaagttttaacagttaggggggctccacatttccaccaaaaatgtaatccgaattaa

SEQ ID NO: 553583 - DNA, 1503 bp, Homo sapiens
  misc_feature (257)..(257): n is a, c, g, or t
  misc_feature (1468)..(1468): n is a, c, g, or t
  misc_feature (1477)..(1477): n is a, c, g, or t
aggcaagatttcaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacnccaagacatacatacacagcttcaagatgtcaagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggagnttcaggaanatttgtaagaaaaaagggcaaaaaaa

SEQ ID NO: 553584 - DNA, 1783 bp, Homo sapiens
  misc_feature (257)..(257): n is a, c, g, or t
  misc_feature (799)..(799): n is a, c, g, or t
  misc_feature (801)..(801): n is a, c, g, or t
  misc_feature (803)..(805): n is a, c, g, or t
aggcaagatttcaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacnccaagacatacatacacagcttcaagatgtcaaggtaaaagaaaaccaaacgtttcactatttagtgtttgcctgctttatttggtagaatgactttaaaaagtcattccctaattggcctgctttacaaatccacgttgttattgtgggctttgcattaactagagtgtacctaatatttttaccacttcagcattgtaagctaaaagatggtctgaaaatctgaatattctcattagtactgaaattattctcatgctagttacatattaataagcttttatttataaaagtttactaataatgagaaatttgtttctttggttttgatttcattgtaaataaatgattatgatatttgggtagcacgttttagattttggaatactacataaagcgtagtgttctctctacgatgatttttaaacttaacacatgctgctacaacaacaaataaacaagcaagtaacatttgggtagccatatcacgatcagccaaagaagaatttgtcgtagaatgttaaagctcaacatgtaaaatncntnnntgtgtcaagcaacagcataagaatttactctccgagcatgaacaacttgtagtgactttggaagaccacaagagtgcactagctgctgcacagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcagcccaggaggtcgacgcggccgcgaatttagtag

SEQ ID NO: 553585 - DNA, 2042 bp, Homo sapiens
gggagaacatacctgacactagagatgtacacgcgcgtatatcgtggatagttggtgtctgatgactactccatgagtttgactcgtgccagaattagatattctctaattatatcagtggttggaacaggagcctccttagtgacataaatcctggattgcaagcacagggacccataggagaaccagtcgaagagagcactactcgagtgtgcctctagagctaggacctagcacatgacacgaggatgcgatgagcactgataggcgaatgcacgcaatgcacaaagccgagcacagcacattagtgtttgcgcaccacgcgcgctccggatgccatatgcaaagggcatgcgcatagttgcgcacacaacgcgcgtgcgacgcgtacgcccaaatatcgggcaccaagcacgaacgcctacatcgtatgtgcgcctgtgtaccagcaggccaacgcgcaatgtgtcccaaccaaccccggtacaacccgtaactccttttagccgcgaggtgtaatgaactcatatcggaccacactgcttcgaacgacatagaggtctgggttagaactaccgtcgagccgagccgcaacacggtggggggagttacgccgctaaataaccgggaggggcctatgggggttgtggctacctaagataccctttggccgccgtatgtctcccacctttggggtcggattacccgcttcaccaccagaatcgggcggcggtgggttcctgccatattaaaccgttggcacactttttatattcctcatatatagcggcaccataacggcgcgaaatgggtacattgtgtgggcaccacagttactatacaagtgagtcgtacgctattggaggcacaaaggacaccgttgttctatgcggcagcttatggtacgatgcggcgttatacagaagacgacagaaagaggtaagcagaagccgtactggtgctgagtgtgcaagacaaacaggggcggggcttttatttgggccttaaaatggtgcttgggctagcggaagaaggcgtgacatacccgcaggaggaaaccagacacttacacgggacatcgcaacggatggcatacacctgcaatcggcaagccataccctagctctgtttccccacctaagagagcggttggggccgagcattagttcacccttagggaggttccgcataaacacgcttctgggtgtgggccctccagtatccattccaggccccagacatgtgcctaccggaaaaatcagaggagagcaacaggggctgtgacacacagcaacactcttgggcccagcctgaacacagcgtgggtggggtacaacgacgttgggtagccacccctagcggtggggcagggttgtcgccctgggatagcgcataaccaggagggatcaagttgggtggaaacgctaacgtatccaaacaggttgtgtcccgctttcgaaagcatcacccaacaccacaacgagaggtgtcggaccacacacatcagagagaacaatacgcctcaccagaaaggagtggggcccaacacacagcaaacaccggcggcgacgcccagcggaaactacgagtccaacaaacgacggtgctcccgcacacacacacggagctatactatccatacaagacgcaccaacgacccggtcccacccgacgagtaacacaccaggacggagtgcaacgtggcagccacatcgacacacactgacgacactctgcgggaacataccagacgccaacccaacgaaggaaggccaaccgacagcggtacaagcagacccaacagacgcataagccagtagatggagcaacacacacccacacagacggaggcaggaagaacacccacgctctgaccccagacaccgcacctcacagccaacaaatcacacagcaactagacaggagagagcagataacacacaacaccacgtcgatgcaacaacaccagccacgccaaaacatagagtacgaaacagtgcacaccaccatccaccacacacagcacaggaccgaccaataca

SEQ ID NO: 553586 - DNA, 626 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
  misc_feature (591)..(591): n is a, c, g, or t
  misc_feature (600)..(600): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatccagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggagnttcaggaanatttgtaagaaaaaagggcaaaaaaa

SEQ ID NO: 553587 - DNA, 415 bp, Homo sapiens
  misc_feature (48)..(48): n is a, c, g, or t
  misc_feature (150)..(150): n is a, c, g, or t
  misc_feature (308)..(308): n is a, c, g, or t
gaagagtggtagaatttcatccttggctggcaggctgtagaattattnttctgtgcttttatttaagtgtggaatttgaatataagaagttgctttgttgtctctttttgggggacaaattcattaacatcacgtgcctgtcatcgtctnggcactgggaatagagcagcgtcatctgcaaatgaaacaaacaggctcctgatttcatgaggcatttattctaggggaaggggagaaagggcaaaaataaacaaatgaacaaaatcatgccagccaaagaaaagtgctgtgaagcaaatcagagcagntaaagtgaacaggtgtggcaggcctggcagtgagggggctcttgtagattagaggtgaaacttgagtgaccacagagaaggaaacggtattccagcagtaaggggta

SEQ ID NO: 553588 - DNA, 450 bp, Homo sapiens
gacagcacgtgaaagagtggaggactccatgactggtgtcggcagagcagggtacaggcaccagtgtagtgagctggcaaccactgcctcgtcagagggtgggtagcaactgtccttactgggggacagcaggcctggtcacaggcttttctccctgtccctgcaagcatcacattgctggaagagaatctcatgccagagcttggaccatccctagctggggggttaggggttgtctcttggtgacctaaatgaaaaaataggtccagatcagagttcgtgatgcatagcagtcacccactctttgaatcatgggaggggaggcctagtcctaggtaaacctaaactctttgaggaaccacagagcccaaggctggaaacctccagaatcctccagcccctgatccccccccccccggggacgcatggaggcctggaacaaccaggggg

SEQ ID NO: 553589 - DNA, 893 bp, Homo sapiens
  misc_feature (132)..(132): n is a, c, g, or t
gatcgaagatggcgccgcaatctgtgtcggtgcataaccagaagagtcttcatgtggacagcctcagggacggcatgtacgagacatcttgtgtctcgattcacgaaaacagagaaggtagccagtggtggntgagacagtagagacgagaattggaaggaacctatcctagtgtgtccacctttacgagagtccggccgagctatacaacagccaccgtgatgatctccagagtcgttgggaatcttacgtgaaagaaggtttggatcgtctcttcctagtacttggcaggacatctccctggaagatagtcgtctaagttcaatctgctggtctcattgagctcgagtgaggttgggtcgtgtcgtccctgaactcgcgatgattctaccagatgtgcagggtgagagatgttcttgatttctatatggccctagttcaagatagatctaaatttgtatgaactcgagggccagtaatctgccctcgcaatgtgcataatcgcttggagttactaagcaattcggagagagacacattgatgtccctgtctttcctggagcaggggctgctcataagatgtttgatgattcaccatgtgaagagtatcagaactgttcttggaaccccacttttctgtagaggaatgtatcatcttttggggctcaccttaccaatggcaattaaggacttctatttcaaattggtgaaaccattttttaatggaatggtcctcattatgacagggtgagaaggacggcacctggttagaaggcggcttgcagtccaccttcaaactaagggtgcggaagatttgctggagagactaaggtttgcgccacaaatttataccataaaaacactgtttggcacatttgtggaaaaaaacgggc

SEQ ID NO: 553590 - DNA, 440 bp, Homo sapiens
tttaccacttcaggaaccctcctccgcctgccagagacatgaagattttggtcatcattgctcagctcctcagagtgggccgggaggggactaaaaaaactgcattaatggtggttaaaacagggtccccttgggaaggcttgggagccaggatgagtgtcgggcttttgtgtgtgcaaaaggtcaaatgtgactgctgctgtttgcctggtttttgacccagtggtggggtttgagcaatgcttttttgcccttccatggaaagtggaaccaaaaatggtgccaaggctggggctgttccctttcgtgtaaaatggggctgttattactctgtcttgaaaaaggaaggtgggatttttggggaggctggtgaaggagggcagggtttttttttttacgtgtcatgttaaaattgccaaataaagtacctctgcctgtga

SEQ ID NO: 553591 - DNA, 105 bp, Homo sapiens
  misc_feature (29)..(29): n is a, c, g, or t
tgggtgatctagaggatctcatccccggntctgggtacatctgaccgcctcttctgggaaccatgaaggttcacgacatccgctggaactttgagaagttcctgg

SEQ ID NO: 553592 - DNA, 110 bp, Homo sapiens
tctcccaagtactggggtggacagatcacttgaggtcaggagattgagattgctcgggggaataggttatgtgattaggagtagggttaggatgagtgggaagaagaaag

SEQ ID NO: 553593 - DNA, 185 bp, Homo sapiens
ctactcacgccagcctacaaagtgctgggatatcaggcgtgaaccatctgctggcccctcctttcttttttagttatttagtggtgagcaggaagtgaaagacggaaattaaagggattttttttttttttattattttttatttttttatatttatatttttttttttatattttttttttttt

SEQ ID NO: 553594 - DNA, 157 bp, Homo sapiens
ctctagcaggatccccctgccgactgggtagcgaaggaccgtcatctgagtcttccattaaggaaggctcctgacctccacatctcatgaggtgaagcctctagctaactactccaccctcttccacacactactcttcccagtgtccctccagttc

SEQ ID NO: 553595 - DNA, 120 bp, Homo sapiens
tgttagttcccaacatacgaatgtgttacaacttaaggttttacacatttcgatgttgggaactaacacacagcgatggggggggaaggaaggatgtttcaggcaagggtcctactccct

SEQ ID NO: 553596 - DNA, 664 bp, Homo sapiens
taacatgctacatcactgttgaaaacaaacaaaaatatttcaaaaataatatataatatatataatatatttatataatgaaaagctattgactagcagcaatgattctaaagttatcttagcaccaagaccatggaggtgaaggggaagggattggtaggggatgaagggactggtggaaccaagaaagggctataacaagttcagcgttgatgacatttacactatggctctcaacggtggcatgaggcctaagagacaacatcaaccaagaaggaaggaagcccccacagttctataatgtctgaaccaagcaggctgaaaacattggggccttgcctgtggccagataacaccaccctctgacaaccaagagattaacctctcagccgaacttgccacatgtatataagacacatctgactccgctacccaaaatgacctgaatccacgcgataggatctctgcatataaaatatgcgtacatcagatgtaggaacatgaacagaagttgttaacagctcacgcacattttttcttccttggcaagtataccggtagttaaatgaatcaaagaccattgatcagactcctctaggttaatcgactacttggcaccgggaataggcaattggctatgctgcttattcgcggtttgggtggg

SEQ ID NO: 553597 - DNA, 142 bp, Homo sapiens
cgggcgcacagcttctcaaagtgctgggattacaggtgagccactgcgcccagccaataattcattgtttaatccttagtttgtgggccatgtcaaaggagtaaaatgtaataagccttttccttttaccgattaggagagg

SEQ ID NO: 553598 - DNA, 150 bp, Homo sapiens
gtaagtgcagagcccccatcagctcaggcttctcagttccctatagccgtcttactcacactgcccctttcctctccctcagactttgtgtttgctgcctctactcttgttttttgttttttcttctggggggggtgtctagacacagtg

SEQ ID NO: 553599 - DNA, 181 bp, Homo sapiens
tgttgtatgaactctatggtgtacttaagttatcaagaacagcatgcgaagtgacagatatacacctgaactggtgtcatcattggagctgagtaagaagaacaataacaccgtatgaatcagaaactgggaatcattcaaggaagatgtgtgaaaaaaaataagaaaaactgagcggccg

SEQ ID NO: 553600 - DNA, 377 bp, Homo sapiens
gaagacagagcaaacctgcccagatctcaggactaccagggattgaatgaaatgagatgtgtgtgcaaagcactgcacaccaccatccacagggatagaaggggccaggagtaccaagctatgttttctaacagcctcatttaaagaacataaaaagaaaaaagtgacattcattttaatgtgtggtactgaatatgtgtaaaatataatttaatatgcaatgagtatacaaaaactgaaactgacccaattgtcccatagaaaggtttttttgataaacagaaattgacccttctggtccttaacgactggaaacttaacatttgttttatctgagttacttcctcaggaaagacctgcaggcatctcaaaaaaaa

SEQ ID NO: 553601 - DNA, 321 bp, Homo sapiens
gcgtgtactggacagacaagatacagccacacagacgcagtttgtaagatgggaagaaccttgttcaagcccatctcttagtctacgtattttgtgtcagtgatgaggaaggaaaaaggtaaatatacagtatacttcacgaaacatcatccactcaaagaaagtgtctggaataagtacaggagagagaatggaacctttcgcaaatctgaaaaacacatatatcagcgaaacatatgcagttctcaatgcagtttcattggaaatgagttttgaaatgatctgattctcatattatctctggtgtattattcaagttgt

SEQ ID NO: 553602 - DNA, 312 bp, Homo sapiens
aaccgcgagagtacgcgttggggagagccccacgttgagaactaataatgaaccattattgtatcgaacaattgttagatgacacgctaatcacaaacaacctgtcgtgcacaatgacctcattcacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcataactgaccctagg

SEQ ID NO: 553603 - DNA, 1262 bp, Homo sapiens
agcggtcgcccgcaacccgagccgcacccgccgcggacggagccaatgcgcggggcgaaccgcgcgcccccgcccccggcggcggggtgggccgggatggacgagggcaagatccgcgccgtgatgcaacaggatggggcaaggacacccatgagtaggaggcaacaaccggaaccgaaggcacagcagacaggagcgactgacggaactataagctggtgcgctgactgtggcgcccggacagcatgctgacagcaaaacagactgcaacatgaccctatacagaattgactccacgacaacccacattacggtcggagccaaatactgatacacccaaaataactagacggacttccgagagacgagaaaaccaacggtggccaactcgagctgcgggaagaaagatagcactggtcggaccaaacccaaggcagtggcggcacgagccacgcagacgagatacaggctgaccatgcacgagagcaacacatgctaagcacatgccgggagacatggctgcgaatggagcacaaaacacagaagagctaaacgaacgacgacccaataacaaacaaccaaacgcagcaggacatcactggaacccgagcgtcacaccacacgatcaacaaggggaagacaccacagttagaaaacgcgagcatccaaaaggactacacgagcacgtgcacgcgcctgacaaccaattggatacaaaggagataggagcaagcaccaacggcgcagaacacatcggtattgacacaaacacacaccagggctcaccagaacccgtgcgagcgacgcagaccgaaccccaatgaatacacattcgtcacagccgacgaactaagaagtcaaggacggaaaaaccacaacagtacgacttcggcgcgcagacacttcgcgggcaacaccagaacacaacaccagacgacgagacgcacaacctctagagggagatggaattccacccagaccaacaccacacagaagaacaagcaaacgaaagatcgccaagacaacagacactgacacaaaaagccgaaaaacacgcacgaagccccaacgcatacacagtgagacataccacacaaagtacaacagtcaacacacaagcaagagtccgcaacgagcatatctacaacgagcgcaaacaacattgagacaacacgagggacaaagacaataactctcaactagaaacaatacaaaatagatcacacaaaaaacgagacacaaacaacaacagagcagcaatg

SEQ ID NO: 553604 - DNA, 377 bp, Homo sapiens
tgagcgttctagaggatcccaagggactcgtgctggtgtctcggttgtaagggatctgctgaggtacacagatgagatatacgtggcctgatgcggggcgtaagccggtaaagagtcagttccactggagccctgagtggacaagccacagcctgtagtggtccgttaacaagaagtgttcgatgcggttgggactgtctcctagccatagtatgcaatcgtcttctctatcgtgctgattatcattttcagggctggtattctctgccggagaggactcttgatgtccgacacctgatcactggggtcattcagaaaagactcgtactcggaatcctgattggacaaatgacttccgggagagtactggtagctga

SEQ ID NO: 553605 - DNA, 615 bp, Homo sapiens
  misc_feature (202)..(202): n is a, c, g, or t
  misc_feature (217)..(217): n is a, c, g, or t
  misc_feature (254)..(254): n is a, c, g, or t
  misc_feature (465)..(465): n is a, c, g, or t
ttcccagtcccccggccccatggggggggattggtgggggcggggctgtccaaaaggtgtggttatcggactggggtccttcttttttgttgtaggaggaaaagctcaggtggaaaaggagggagcctctttcagggtggggcgcaaggccagggcccagggtttttaagggttcttccaaggttaaaaagcctgaaacaantgttttgggaggggntaaaaagcgggattttttcccgcctcccctttggggnttcaaaggccttggggatttttttttgcaaagggccccaaaagggtttggggccccgttagaaaaaaggggggggggggaaaaacagcccccccttgggtcccctgggaccccggttcccaaggggaccggggtttcccccccagtttttttttttgttccaaaaaggggggggggggggtttccctttttgtttccactttaaggggccngggggggcaattttttttttccccccggaaaaaaagaatttgaaaaaaaatttgttttttcaaaaatttggtatggggggggggggggttaattaaaaaaggcaatttcggggatttggggggggaaaaaaagccctggggcccttccca

SEQ ID NO: 553606 - DNA, 380 bp, Homo sapiens
accaggatcctcctatgatgcatgggaattacaggagttgcaattcaagttgagatttgggtggggacacagctaaaccacaccatcaatctctccataacaaaaggatcagaaactactccttttatactgcgttgcagatgaaaaatggaaagtacctctgaatggttccctcccacaatcagtcagactagtcacaggccaagtcttcttttacattgggtgtaaccaagtaaccaaagggaaacttttagagggtattgaaaccccagaaaatgtttcaaggggtgctctttgccacttgctcaatcctgctcccactctgttgcagtgtaatttcatttcaataaatttgtgctttcattgctaaaaaaaaaaaa

SEQ ID NO: 553607 - DNA, 404 bp, Homo sapiens
ctcgatgtggaccatgcgacggaatatctcgggtcaatattatctagtgtaccatccacatgtttcggactgcgttcttagctcgttgctattatattgcgtgatggtggttcaagaaacttgaatcggtgttgcatcaacaacggtatgagattgaacccgaaagacccgtttctatagtatctttgcgtcactttgtttggggcggcacagaatctgtcactcagtgattcttaggaagacagcagcatacaggattccatggaaccagtgttcgattgaagctagtactagaggagcacgcgatccagcagcagttcgtgatgaatatcgtaaaacagtctaggagcccgtgcgattaggtaaaggaagctaggaagaatgaatgagcgctatattccaca

SEQ ID NO: 553608 - DNA, 139 bp, Homo sapiens
ggctcacttacatactggtagtcttacacttgtactccgtggtggtgctttgtggtactccgaaagtagatttattttaattacttgataaaagaaagggtagttgattagcattttccatcccaacatcacccatctg

SEQ ID NO: 553609 - DNA, 381 bp, Homo sapiens
gtaatatgagttgtaaggtatttattaggagaaggtggagagagatcggagcctaatagtggtgatggaggtagtaaagagtatagaaaaggggaaggggaaaagtggttggggagcccggggtgtccgggggaagaagggggtggtagcacttggcgggagtcgcctatatataggggaggacggtattaaattgttcgataatggggcagggtatacacggggcttcacgggaattcggagaagtatagataattgttaatgttgcgatcgtataaaccgttgtgtaagctgcatgggtcaactggtgatagacaatatgtcagatggcggtactagtcccatttttgacactatcttctttggatgaaatttacattg

SEQ ID NO: 553610 - DNA, 869 bp, Homo sapiens
  misc_feature (40)..(41): n is a, c, g, or t
gtccggtgtcatggcggctctaccctgaaggtgccctganntcctcgccgataagaggcagcagttcggaagccggttcctgagcgatccggcgcgcgtcttccaccacaatgcctggtgacaatgtggagtggtcggaagagcaagccgcggcgggggagagaaaaagtccaggagaacagtatccagcgggtgtgccaggagaaacaagttgattatgagatcaatgcccacaaatactggaatgcacttctaccaaaatccatgaaaatgggtttacaaggatagacattggcttttaccgaattccctgagcttggcactagcaaaaatcaaaaatcatttgaaggcactggttcttggagaacaagagtgaagtacctgaatgtaagacaacaatgaggatggacctggtttcataatggacagacagcacaaagtgttcttcgaagaagcttgaagtataaaaccaaagaacctccgtgtggaggagaatgtcatcagaaaaattagtgaccctggaaaatttgtggcttgatgagtctccctgggatccctccagccagctaaccgtatacactggaggttggctgtggtgtggtgcacacacagcttttccaacttacacaaagcgaccactgaccccgggactcttgccacatgcctggcatatctttccaaagcttaaagaactgtcccacaccaaattagaagtatgagcctctcggagtaggccgttggtcccaccctgttgtatgacaataagctaacccatgccacaggcagctgatatcaacccatattgtgcatcggacgtgtccaacgtcgcggcataaacacgtaagcgttaaacagcgagagaattgtaa

SEQ ID NO: 553611 - DNA, 632 bp, Homo sapiens
tcggatgttgccctcctgggtgagcagatatcagtctgtggaactctgggaataatccatcaggcacactttttcggtgcggacagactttcgccagcatcattaacctggcgcaagccagtctagaatacctttggctggaacacttaagcgaagggtttttccactttctagccccccattggtgcatcggttggtcggtccgatgatagtgctgtcagtcatgctcagagcaaagcgacaataaacggaacacttatcttgtcaaaactcgatgcttcagctgtcttgcgcgtcgctgatgtatgagctttgcatgtgtgtgtgttttgtctctgtataggtagaggtattcacatcttactccgactgtaaggttgtcttacttcatctctgcccccaccacagttgccattgttgtaatcgtccgttccaacatggagaaggacatcgagctctctgccagttggcagtcatttgtctgttctttgttgattgcctcattctccagtgaactccatctggccaaatgattcagaatcaggcaagatccctgccatatggcacatccactgaaaggccactcagcaagtccgagtgagttttaatataattatcaccctgatctataa

SEQ ID NO: 553612 - DNA, 141 bp, Homo sapiens
tgaagaggctgccgaaaggccggagcttcgcctgaggatgccacagtgagacatggagcgaaaggagatcattttggacctttaagatttgactgccctactggattttggacttgtgtggggcctgtagccctttgtttt

SEQ ID NO: 553613 - DNA, 571 bp, Homo sapiens
ggcgggcgcggtggctcacgcctgtaaatcccagctctcagggaggctaagaggcgggaggatagcttgagcccaggagttcgagacctgcctgggcaaataataggcgagaccccgttctcctgaaaaaataattacaaacacgcacaacaaaaaaacaacaacttgtgttggggcgcgctcatgaggccctctcgagaaaagagagttttattagaacacaattttgttgttggagcgcgcggcgccccacagatggttaatggtgtcgaccccgtgtgtgcgcccaaataggcagtgttcccacagaggcgaaacacctcgcggggccaagtgagacataggtgcgcttgggaacatacacgcacacaccagattataaaaagaaccgcccgggggggagaacaccagagaacattgttttatcgggaaaccaacattttcccagcagatgtgagagtaactgagaagaaggcgacacagtaccggggagtcttttcacaagctggaagctcaccaagcgagagacgcacagattattctaatattagccccccggcatggggggggt

SEQ ID NO: 553614 - DNA, 1925 bp, Homo sapiens
  misc_feature (1693)..(1693): n is a, c, g, or t
gatcctcgtgtcgcgttgtcgttcgttttttgttttgtctgtatcattgttgttggtggttcgtcgtcgctttgtgtgcgggtgtggtggagccacacacgcggctgtgagcacgtttgtgggggggtgtgggggggctgcttcgggctgggtcggtgttgcgtcttgtgtctgctgggttccgttgttctgcttgtccgtccctacaattcctgccgtgcgtcgctcctcaggcgtgtgtgtgttcttccatctctgatcggtcgggtagtcgtctcgttcggtttgttagatctgctctgtctctccgtcgtggtgggtcatggatctatcggtcggcgttcgggctgcgcggctctggggtggtgtggtgtgtgtgtccttgctgtttgttacgagaatagtgtgcgtggtttttagcatgggggtggttgtgaaagagtgtgccccgacgtagctgacgtggtggggtggttggtatgcgttgtggttatgtgattcgtagtggtgcgtccatcctgttctcttgctcgctccttatgtgtctgctctccatctttgtttgtgtgtttgctgtgtggtattatctccatcttgtttgtgttgtaggagtggcggacgatcgcggtgttgtgtgggttttggttgttattattggtgtgtctgcatgtctgtaatgcgttcatccgcggtggcgtggtttgggtttgttttgcttcttcgctgtggtgttctttcctcgacgttggcgtgcgtcactagttagtgtgtctgttcggctgcttattcacgtactgggggtgtgtgtgttgtgtggggtggggcttgcgcatccctactagtattggtactgtcatcaccatcataggtcctcctccgctgttttgttgttgcgtctacttcgtttttgatgtggtgcggcgcagcaccagcactgggtggctggctgctacaagcatagttatcgtcactaacgctggtgttgttgagtctgtgatgttgagtaagcacgctccaccaccacgtttgggtggtgatgatcagcagcaacagctgcggcagctcgagaacagatgtgatgagggtggtttgttttttgttgttggagagaggaggtctggttgtggggcgtggtgcagatactaggagaagacgacagacacatgatgatggagatggtgtagaggtgttgctgctacacacacaagttgtgctatggtgtggttgcgcacacacgacatgtgtgcacactcgttatagtagtgtgtggtgcgcactactatcgtgtgttgtggtgttggtgtcgtggtgcgacacacaacacgtggtcgcgtcacggattatcgcgctgctggcacagcacacgtgtgcgcagcaaatatatacacacgtgctatcttgttgtcgtgtgtagacgacccaacgtgagtgtgagagagaagaaagctcacaacaccacacgcgggtgtgagagggagtctccacattagtatttgttctgtgtctctccacagagagagcggtgtaagagaatgtagggtctgtgttgtctcgtgtgagagaatatatgtggtgatatccaacattgaaccccacgttgcctcactccactcccactccacccatctcgcatgatgtatcgtcgtcagtgtggatattagtccgatatgagagctcgtgtgtgtgtcgcacnaagagcacacctgtgtgtctaccgagtgttgttgggagcgctcttgtgggtaaatatgaacacattgttgtggtgttgtgtggaatggtgtgaggttgtggttgatgaaattgttagaatggtccctcgccacacaatcaataaaatataataataaaagggaaataaaataaacagttggaaggcagtttgtaagcgttcagggggccggtagatagtaggtaggtgtccc

SEQ ID NO: 553615 - DNA, 232 bp, Homo sapiens
  misc_feature (28)..(28): n is a, c, g, or t
  misc_feature (69)..(69): n is a, c, g, or t
  misc_feature (121)..(121): n is a, c, g, or t
gacctcactttcttagaacatttggctnaaaatggcttgccatcggtacatatgtatctcttgcaactnaaaagcatcaggtcttcctttaaaatctagtcatcaaggccaggcatggtgntcacgctgtaatcccagcactttgggaggctgaggcgggcagatcacttgaggccaggagttcaagaccagcttgggcaacatgccaaaactctgtctctactaaaaatac

SEQ ID NO: 553616 - DNA, 1099 bp, Homo sapiens
  misc_feature (40)..(41): n is a, c, g, or t
  misc_feature (169)..(169): n is a, c, g, or t
gtccggtgtcatggcggctctaccctgaaggtgccctganntcctcgccgataagaggcagcagttcggaagccggttcctgagcgatccggcgcgcgtcttccaccacaatgcctggtaatcaccctgccccctcgcccggcctgtcgctggccgtctgtcccgccgnctcggagcattccgaaaagcccctgaccgccggccacgagtcaagctgccctacccggccacgagtcaagctgccctacccgaggcactctccaaggggagagaaactcctaggccagcgactcaccctgctcgcagccaggacgtgaagcccctaagctgcccgtttgattttctcagggacaatgtggagtggtcggaagagcaagccgcggcgggggagagaaaaagtccaggagaacagtatccagcgggtgtgccaggagaaacaagttgattatgagatcaatgcccacaaatactggaatgcacttctaccaaaatccatgaaaatgggtttacaaggatagacattggcttttaccgaattccctgagcttggcactagcaaaaatcaaaaatcatttgaaggcactggttcttggagaacaagagtgaagtacctgaatgtaagacaacaatgaggatggacctggtttcataatggacagacagcacaaagtgttcttcgaagaagcttgaagtataaaaccaaagaacctccgtgtggaggagaatgtcatcagaaaaattagtgaccctggaaaatttgtggcttgatgagtctccctgggatccctccagccagctaaccgtatacactggaggttggctgtggtgtggtgcacacacagcttttccaacttacacaaagcgaccactgaccccgggactcttgccacatgcctggcatatctttccaaagcttaaagaactgtcccacaccaaattagaagtatgagcctctcggagtaggccgttggtcccaccctgttgtatgacaataagctaacccatgccacaggcagctgatatcaacccatattgtgcatcggacgtgtccaacgtcgcggcataaacacgtaagcgttaaacagcgagagaattgtaa

SEQ ID NO: 553617 - DNA, 827 bp, Homo sapiens
agttggaacgaataggcaacatatctggaccattaagaaaacggatttgtaactagcttcaaactaggccaagcaacttagtttccctgcaaatcaaaatttttacaagcaacttgggttagacctgggtttagacgctaacatcccttccttaaatgccttctgtagttctcaccgatcagtaggcggaagaccatataataattgtcaatggtacctgtttcaaaacatatcgtctctggttttataagtaagtcgatattaattaaactcttggcaactatttcttctttcttaaaggaaacatatcccttaactttttttcttttacactgtgaaaccatacacagtagaaattctgttactctctgttattaactacataacacctgacaaatcacactttttttccatattggcatgtagctacaaatattaacaggcaaggcgaacaaggtaatataatcttaggtttaccaacatatggtgtgtaatccaaataatacttgaccagcttatctaaaatgtacataatcttgacggctagctccatgaattctggactttcaattactttatgttccacacacgcttggggactattacgattattcatttctgcatcctgtaactaaaccgtgatcatcaattttcctggtaatcttctggtcccatgtactattaacttggtccttcaactagaatcttggcaccacagcactcattcgagatcaggtggcttcctgttaatttaacctgtttgccttaataatgggtcacgtttcacaaacaaaccttgcacttaacggcttcaaaatccctataga

SEQ ID NO: 553618 - DNA, 211 bp, Homo sapiens
tggtttttcaacttttttttaaaaaacaaattcaggttccaatgcccctttttcctttcccgaacccagcctttatttaaataactttaaaacaaattttgagggaggggacaggaaaagtttgggtcacggtggaagggggaaaaaagcccattttaaccgccgaaacgcccgttttttttccgtttttttttttgccgccaattttttt

SEQ ID NO: 553619 - DNA, 122 bp, Homo sapiens
ggctcattgtgcggcctcgtagtggcgcttcgggaggccctttgcgtggctcttagtgtggcgcctggtggtgcccgcgacgagccacccctaagtagccacacaaagcgccccccaacgag

SEQ ID NO: 553620 - DNA, 176 bp, Homo sapiens
gcagtagcagccgcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctactggtgtga

SEQ ID NO: 553621 - DNA, 637 bp, Homo sapiens
aaaagtagctgaatgtggtggtgtgcacctgtaatcccagctactcaggaggctgaggcaggagactggcttgaacccgggtggcagaggttgcagtgagccgaaatcacaccactgtactccagcctggtgacagagccagactgttttaaaataaaataaaaataaaaaattggcttttggaaaaaacaacaacaaaacaaaaaaacaaagaaaagaacacaaacaacaacaacgaaaaagaaaaccacacaacaaagacacaacacaaacgaaacaacacaaaagaaaacacaacaaccagcggcggcgccgcgcccccccgagcactcccccgccgccgcgcccccctagtattatcgcctagccccctttcaagtttctgtcttcgagaaaaaaaccagggcgcgcgcgcatcccataaaataaggaaagagtccagtgtgtctataatatattacaacggacaacgcgcagagctagccagcccatcctcggagttatataataatactactacgatcgtgtctctagtaggatgatggagaaaacaatagactgatagtcagcacgcgtgaggacattatttcttctactagcaggaagccagtccctcttctctattttgtgtgagtag

SEQ ID NO: 553622 - DNA, 242 bp, Homo sapiens
  misc_feature (224)..(224): n is a, c, g, or t
  misc_feature (226)..(226): n is a, c, g, or t
agtacttttcctttcctgaagtagacctcaggccaatctggaagttgaaaaaggaatgcatttaaatcttctatggctgctttaaactcttggagagactcatatgattccgctcagtaaatttttacaatcaagtcactgggttctgctcgcagcgcctcgcaggcggccgccagggcctcccggtagcgcccctggtgcagtagctcccacgagtgccggcncnggcctcgagtggcccg

SEQ ID NO: 553623 - DNA, 787 bp, Homo sapiens
ggacacttcggtgctctctttgtgtgggaccacgacacacgagttctcactgttagatggatgaggaggtagaatgaaaccgaactgcactgggttgtcgtggatgatcagacagatctttgcttctgtggcaacgtggtctcatcagcagcttatccagatcacttccagcatcgcgctgcacgtggttaggtctctctaagaaccctacatagctctgagtcatgtgaatggataagggagcctcagtgccaatgaacatcatgtgtgcgcctccttgcaatacgcaggcaggtggtggtgcgctctgtaggcagggctcctctacatatctgcagatccatcctcaggagctccggccacatcagcgcacgacaagagatgagaaacagttgaaggatggctgtgcttgagacgatctaacccctatatatgcgacgaccaagcaaatggcatctcggtgcccctcctctatgttgcgcatatgtgtccttcctcgtgacggcacattcgttcgcgactcagttatctttggaaccgttgcccctgcttttttgaaactagctgcgacataggggcagaatgcgtgggctggcatgagattcaattcgcttcgcctccactcctgtactgaccagccctctatgagaggtatggccattacctctctttgctgccttgtgggaagaactggacgcgcttctctctacttgtggggcatcaacgaattcgcgacaggtctggtgtgaagcgaaccggtgaaggaaggctgacttttggggcaccc

SEQ ID NO: 553624 - DNA, 273 bp, Homo sapiens
gaaaattgttccttgatgcacttgctggatacaagccctgtgccaataagaacgagaaaggccttacctgaaagtggggaatagctatatatgtggactgaggtacatgaaatccatgatgcacatagcgtgaaattccaacggggcggctccaatgcataacacaagctgttgacatgatttggaatagtcaacggaaacattctattcacgggcaattagaatcacgatggtatagtgtccatgtatgcatcaggatttggtatgttagag

SEQ ID NO: 553625 - DNA, 1791 bp, Homo sapiens
acacgcgtcctcccctcggcggggaggccggctaggggcaggcgggcagcgatgcctgcgtcggccacagctgcctggcactgccctcctttgtgcctgcctcctctgccagcctccgctccaacctccccccccaaccccgcaacgaggcctgctcctgggcccggccgcagggcccgttgcccacagagcgcccaccctgcgcccacccggggtgccctcaccttctgggcccctggctcctggcctcgggtcctgctggtgcccaggtcgcccggccccgtcctccgtgctccgcgtttgccccaccctgctgcccgagctcggcggcgagcctggcacggtgccaggctgcctgggagcccagcccgggcagggcgaactttccagcgagggttggtctcaaactcctgggctcatgcaatcttcctgcctcggcctcccaatgtgctggaattacaggtatgagctaccgcgctcagcccaaacccagggctcttaaccaccctactatgtactgtgctggcccccggtcaagggagagaactcacgtcaggcaaaaatgttttacagagaggcagctaagtcttttccacagtggatgacacagtccccctcacaaaccaccccacagatccaaccccaaggaactctgcttctacgtgtgcccttggggcaagggatgcaaagcaccaggcgatggagctcagaggatggcactcttccagagagctgtgtgtctctgggaaagctaacacgcctctctgagcctgtcagcagatgcacaggcctgtgcacagagctctgcggagaccacgccgacatcgccgcacacccaccctcctgctcatgggacagaccattcacacctgcttcaccaccagccacaggcttgtcggaaggagcagactcttctccacggacaagccactgcccctttgagggcctcagcttccttaccctatgagatgaggaaacagatcttcacttgccacaggacttggggggatgaaaaggtaacctccgtaaagctgcccctggtgtggggaagccaccccatagatgacattgcccgccctccccctaggcccagagctctacagagtcctcaagctggtgtccctccaggctaaaacacttccaccccctgggcagtgcactacagggtggtggggaaggggccatctgtggaagaaacacagggcctggcctggggtcctgggcaagacctctgtgacctcagtttccccagatccctccaggtgtgaccttgtagatggcctctattctggattcacagctgctgaggaggaggaagaggacactgaaggcattccttcagtcccctggggaggttcagatgctcagactccctgataccacctttcctgggcagaataaagtccccaagatgtccaagccctaatccctggagcctgggaaagtgttacctcccagaccaaagggactttgtaggtgtgtgattgagttgaagatctgcagtgagagggtagcctggattagccacgtgtgcccaaaagcagagactccttcccagccgtggtcagagacagaacaaggggacgctgctggctttaaagacggaagaagggacgaggagccaaggagtgcaagtgccgccagaggccagaaaaggcaagggatggatttttcccctggagttccaggaggaaccagccctgccaacacctggattttagttctgggaccccacctcagacatctgacccccttgactgtaaggtaataaatgtgcgttgcttaaaaaaa

SEQ ID NO: 553626 - DNA, 2160 bp, Homo sapiens
  misc_feature (330)..(330): n is a, c, g, or t
  misc_feature (334)..(334): n is a, c, g, or t
ccgtattgtttttctcctgcctttccctcctttgcttgttgtcctcttcgtttctgttgtgtgtcgggctctgtccggtgtgtctgtgcccttttctcccgccgtgttgtggttctccttttcttccctgtctttctttgccccggtgctgttgtgcggccgggggtgtgtgtgtgtgagtccctttgtgtgccctccctgtgtgttcgttgtctcctctcttctccctcgggattcctctgtctgcccctcctgttttgtgtttctttttttttctttttttttttttttttcttgttgttttttctcgttttttttttttgttgtttntttntttgttttttttaagatgaataaattgaagacatttatttcctccaagaaaaatgtctggcacttggaattttcaagctgcaagtagatgtacacattttcaaaagatctttcttttccttcgcttcctcacactgggcacagcaaaacatctctgccttcttttcacgggaagtgaccctcctccccatgggtcaataagttaacgccaaatcgcggcaaaacggcgaattccatctctgaggctctagaagctcaatcttctgggcccctggctcctggcctcgggtcctgctggtgcccaggtcgcccggccccgtcctccgtgctccgcgtttgccccaccctgctgcccgagctcggcggcgagcctggcacggtgccaggctgcctgggagcccagcccgggcagggcgaactttccagcgagggttggtctcaaactcctgggctcatgcaatcttcctgcctcggcctcccaatgtgctggaattacaggtatgagctaccgcgctcagcccaaacccagggctcttaaccaccctactatgtactgtgctggcccccggtcaagggagagaactcacgtcaggcaaaaatgttttacagagaggcagctaagtcttttccacagtggatgacacagtccccctcacaaaccaccccacagatccaaccccaaggaactctgcttctacgtgtgcccttggggcaagggatgcaaagcaccaggcgatggagctcagaggatggcactcttccagagagctgtgtgtctctgggaaagctaacacgcctctctgagcctgtcagcagatgcacaggcctgtgcacagagctctgcggagaccacgccgacatcgccgcacacccaccctcctgctcatgggacagaccattcacacctgcttcaccaccagccacaggcttgtcggaaggagcagactcttctccacggacaagccactgcccctttgagggcctcagcttccttaccctatgagatgaggaaacagatcttcacttgccacaggacttggggggatgaaaaggtaacctccgtaaagctgcccctggtgtggggaagccaccccatagatgacattgcccgccctccccctaggcccagagctctacagagtcctcaagctggtgtccctccaggctaaaacacttccaccccctgggcagtgcactacagggtggtggggaaggggccatctgtggaagaaacacagggcctggcctggggtcctgggcaagacctctgtgacctcagtttccccagatccctccaggtgtgaccttgtagatggcctctattctggattcacagctgctgaggaggaggaagaggacactgaaggcattccttcagtcccctggggaggttcagatgctcagactccctgataccacctttcctgggcagaataaagtccccaagatgtccaagccctaatccctggagcctgggaaagtgttacctcccagaccaaagggactttgtaggtgtgtgattgagttgaagatctgcagtgagagggtagcctggattagccacgtgtgcccaaaagcagagactccttcccagccgtggtcagagacagaacaaggggacgctgctggctttaaagacggaagaagggacgaggagccaaggagtgcaagtgccgccagaggccagaaaaggcaagggatggatttttcccctggagttccaggaggaaccagccctgccaacacctggattttagttctgggaccccacctcagacatctgacccccttgactgtaaggtaataaatgtgcgttgcttaaaaaaa

SEQ ID NO: 553627 - DNA, 320 bp, Homo sapiens
atgctctgccatactgatttgggcgtcgtcaccaaacgttgctcatcagactaaatgacagcaagcgaagtacaaggtttaaagaaaaggatgaaacaacccccaaaggcttcttaggactccattttcaacagggtcttgaaatcactcactaacatgaggtcacacaggcaaaaaaagacagaggcagagacagaatcctgaggacagggtgtggcctccactctccggttcttgggccccacacacccgtgagccacaaatcctttttcctggagaaataggatcgtacatgaatcttcttatacattctagtggtg

SEQ ID NO: 553628 - DNA, 1005 bp, Homo sapiens
  misc_feature (330)..(330): n is a, c, g, or t
  misc_feature (334)..(334): n is a, c, g, or t
  misc_feature (649)..(649): n is a, c, g, or t
  misc_feature (811)..(811): n is a, c, g, or t
  misc_feature (993)..(993): n is a, c, g, or t
ccgtattgtttttctcctgcctttccctcctttgcttgttgtcctcttcgtttctgttgtgtgtcgggctctgtccggtgtgtctgtgcccttttctcccgccgtgttgtggttctccttttcttccctgtctttctttgccccggtgctgttgtgcggccgggggtgtgtgtgtgtgagtccctttgtgtgccctccctgtgtgttcgttgtctcctctcttctccctcgggattcctctgtctgcccctcctgttttgtgtttctttttttttctttttttttttttttttcttgttgttttttctcgttttttttttttgttgtttntttntttgttttttttaagatgaataaattgaagacatttatttcctccaagaaaaatgtctggcacttggaattttcaagctgcaagtagatgtacacattttcaaaagatctttcttttccttcgcttcctcacactgggcacagcaaaacatctctgccttcttttcacgggaagtgaccctcctccccatgggtcaataagttaacgccaaatcgcggcaaaacggcgaattccatctctgaggctctagaagctcaatctagaaggagagattttaattgtaacccctaaacagcaaatgctgacatttgtctngctttcagatagtctccagactgggccagaacatgactaatttattttatcttatccatctatctaggcacaggattaaaatatttatatcagtctgttcactttaaaatgtgcagttacagacaccagcttcagggccactccttaatttttcacagtttnggcttttcattgtttccagaaatgcacagtccttgaatggcgaacactcgcaaatgctgatgaaatctttaagtgaggagcctctaaactaatatgaaaatctcccctttcaggctgcgtggacgctgccccggccacgggtggacggagcttgtcccaatgcctgcttccccgagacaggncccatgagtagg

SEQ ID NO: 553629 - DNA, 356 bp, Homo sapiens
  misc_feature (137)..(137): n is a, c, g, or t
  misc_feature (216)..(216): n is a, c, g, or t
  misc_feature (256)..(256): n is a, c, g, or t
  misc_feature (338)..(338): n is a, c, g, or t
cataagaccttgagcctcctaatggtcccctgtcccttaaaacaaagtgaccaaaatagaaataaaataaaagttagggtatccagccatgtgaaaaagaatccccaggcccggcaataccccaatatagtagctanctaccacaggtggcctactattaataagtatcttgaaatgtagcctaatcccaaatgagatgtgctagaagtgtaaaancccatgctggacttcaaagacttaatgcaaaagaaggagnaaaaaagtaaaatatctcattaatatttttaataatgattacctgatggaatgatgatattttgggtatattgagttaaatnaaatatattactgaatta

SEQ ID NO: 553630 - DNA, 753 bp, Homo sapiens
  misc_feature (1)..(1): n is a, c, g, or t
  misc_feature (243)..(243): n is a, c, g, or t
  misc_feature (718)..(718): n is a, c, g, or t
ngggctctgtaactttcaaacattttgcagattaaattgttagcttaagggtttaactctcaatgccgttgtacattcagtgtgtatcctgacttactctacagtctgtagaaccagttttagaaatcattaaaagattgatttatgaaggaatagcaactttagtatttcttgacacatcatacgttggttgaatgcctttatttctctttaaggtccacagccagtaatactatctcacanatcagtcggtgggttaccgcgttctaagcatatagctcagagttgctcttatggtttttaacttcctccatacgtaagcgtcaaggcaactagtctgttaaaaaggaggccatacttttttgtatttgacaactgtgacagttttggtagctaggatcctagggagggaaatgtttgcctggtaacttctttctgttatgagaggaattaggtaggtcattcaagtgttgatctcacagcttcaatcaccatatcccaagtataagctggtttcgttacaggtgtctacagtcccgatgttcttcggaatgtaacctaagttttggatcctctgagtccaaagcaggctggctggcataatatgtaatttgaaaaataaaatcttatcttgcagcacgatcaggatgttgaatttatggtgtatattatctctaatatccgttactaaatgcttgcttttttaagacgtgtgttntttttgtgatgcagctatcagatttttagtatcgg

SEQ ID NO: 553631 - DNA, 796 bp, Homo sapiens
ggggcctggtaggtcagcaagtgcagagatcgcccggttctacaaactgcatgagcgtaagtgtgatgcccattctgtcatgactgtgccaagaaagtcggacctgcttcacatggatgatctgtaccccgaccacagcatgggcccggagtgcagtccctggaggactgaggaggtgggtcgacgcgggcgggatgccgacccgatcctcatctcactgcggcgaggcctacagtgcccagcaagcagcgggacctgaagatcagccggcgcaacgtgctctcgtcgtgacagccaggcccgtccgagtggaccccagggcttccatcccgacctaggggcccccagcctcgcaccaaccactgcgtgcatgatgcctacccccagctggcaagccttggccagagccggggaggctgggaagctggaggaaggtgatgtcaggagctgacgggcccatgagggcgactggctcaaggagcagggcgaccgcatctgccgcctggaggagacagctgggccagcatggagaacggggatagcgtagggccacagccacacgccaccttcatctcctccgccgcccccttcaccactcagcttctgccagacgggtcgcaccgggctagctggctgcaccagagcctctagaggcagcgccaggggtcagttcccacccccacccgtcccaggcccaggccgaagccagcgcccagctttcctcactgttcctgtggaggatgtctacgcaccaggcgagctcctcgacctctgagggaccatctccccgaccact

SEQ ID NO: 553632 - DNA, 253 bp, Homo sapiens
caggctctttgccgtaaattgtggaatagtggcctggtgactgcaggccggggactcactaaagcatacttagaaagagtgggggcgaagggttgaaggaggaggttgcagagcggcagagtggcacatgcaagccacaggtggaagtttctcccgttctcaatcccctgccttaaatacttctctgcggacctatctccatctctgtaaaatggaaagacattaaaagcacgccccgtctccccaaaaaaaa

SEQ ID NO: 553633 - DNA, 225 bp, Homo sapiens
ccacccaggcgcacttctggacctgggtccaactcctggtacgaacttcagacagggcattgatttctgccctgggcagaacgtttcacggagtcacaaatcacaatctggaacaccacacgaagctgcccctgcatcttccacctggcgacgggacccaggtggagaggttccccctctcgctttgccagcgcccgcagtaccatcgaggccctcgagcaggat

SEQ ID NO: 553634 - DNA, 428 bp, Homo sapiens
gatatttcgcgtgccgggctgtccttctcgatgcagacggctaaggatgtcacggtcaccatcggtggcaaaactcagaagattaccgcggttggaaccgttgctgacgccctcaaggcggcgaaggtcgaggttgattcgagcgatgccgttaacccgggtctgggtacgccactgtccgatggcatgaagattaccctgacgatggttgaccagaagtctcagaagcgtcgtgtcgccgtgcccttctccaccaagaaggtcgaggactccagcctgcccaagggcgagatcaaggtcatcactaagggtgtcaacggcatcaacgaggaaacctggaccgtcgtctttaaggacggcaagaaggtgtccgagaagaaggtttccagcgtcgacgcggccgcgaatttagtagtagtaggggccgc

SEQ ID NO: 553635 - DNA, 350 bp, Homo sapiens
gatcaagacgactctctctgactcacctcatcactcgatgtgatgctgggcattacagacgctcaccacacgcctggatatatatgtggtatttgtatagatagagacggggtttcaccatgttgtccaggctgggtcttgacgttcctgtactgcaaggtgatacacctcgccttgtgcctcccaatagttctgtggattacgaggcatgagccacatgcacctgtggcttttcttgttttcatttcttgagacaggagtttcactcctatttgcccatggctggatgtgcaagtggcagcgatcgttggctcacttgcatacctcgcacctccctaggttcaacgcag

SEQ ID NO: 553636 - DNA, 357 bp, Homo sapiens
cttggaaggtggtttaggcccaagattgtgttggtttgttggttgaagggtttacaggagttgccccgggaaaagtactttttttgggattccgggggggggcccagccggggcccccccccttttgttttgaccagcattttgggggtggcagccggggattggaaaaagggggacccttttttttgcttggtgggccagggggccttgcggttggcttttacaaaaaagacctttgccggtttggggggtaaacccccccttgttattgtttttttttttttggggggggtggggggcccttgtttttgagccgcccgcttttccccccccttgattaaattccttgttccccca

SEQ ID NO: 553637 - DNA, 662 bp, Homo sapiens
  misc_feature (84)..(84): n is a, c, g, or t
gaccatctatcagggaggcgtgtggagcgctgatcgtcaggtgggtgtgatcactggagtacatgagcgtaggagtccgccagntgcacgtagctctgcgccgacggtgggacgttccctctgaagattccatctagtatattatattatagagttctgcgtcggggcctagaccgtcctgagaaacccgactattcggggcctggtgacggttaccgacgggcatgtggacctaagggggcttaacaggtagacaacagaagcggcggcggcggcagccaggagcagcagcagcagcaatctcttcccgaacacgagcaccacaggcgcccgaaggccggaacaggcgtttagagaaacatggcagacgatatgactattgaagcaatgcttgaggctccttacaagaaggatgagaacaagtgtgagcagctgccaacggccatgaagaacgtaccaaaaaaaaaaaaaaaaacaaaaagacgaaaaacgacatgtggaggcggaccagaggcctgaggaaaaaaggcataaaaacaacacatagtgagagacccgcggcccccgagagagagacagcacaccacgggagacaaaagaggggccacaagagagaaacacgaggacacaaaaaaaagagaggggaactcccaccacaaata

SEQ ID NO: 553638 - DNA, 230 bp, Homo sapiens
taacatgttctgagttcatatcccctgatgattgagtcccacaatacagcggatggcccaggagcagaatgaaggcagaggaaaagcctttggctgcggttccgaacaatgggctgtcaacctattgggacgggccccaggatgtaaggggcctgtctgcagaaaacctcagggtctcctttctatcccctggggacacgtctgcttggagttagtatggggtgaaagga

SEQ ID NO: 553639 - DNA, 528 bp, Homo sapiens
tatctactacaaatacaaaaattagccaggtgtggtggcatgcgcctgtaatcaggactactcaggaggctggggcaggagaattgcttgaacctgggaggcagaggttgcactgagctgagatagcgccactgcattccagactggaccacagagcgagacttcatcttacagaaaaaaattagctggtcatggtggcacaagacctgttatcccagtctatccagtaggctgaggcaggagaatcatttgaacctgggaagtgcaggttgtatgggtggacaacttccaagcctgggccacaagaaggatactccatctcaaagaaaaacaaacaaagcaaataggccacgcccggggtgtggtccgcgcagtgtggatcggccagaggttccaggaatttcgagaagcagcctgaaatggtcgaaacgctgtctctaacttaaaatatacaaaaattagccgggtcgtggtgcaacgtgcctgtaatcccagatacttaggagacctgaggcaggaaaattgctt

SEQ ID NO: 553640 - DNA, 139 bp, Homo sapiens
atcaaggaatatagcgcgttaatgttatgtggcaggaataaaagaatatttacaatagtgatgttagggcactcagctgctactacaaattatgagaggccccagtatgctagaaatccatcttggctcaccctgatgc

SEQ ID NO: 553641 - DNA, 553 bp, Homo sapiens
gagagagagagagagagagagagagagagagagagagagagagagagagagagagagagagagagagagagagagagagagagagagccatgataaatctgtgtatgatcatcgctcacaccggactacgacaaagcccatctggtaggcgatttccccccccctcttcaacgacatcctgcacagttacactggcctccataccagccctgtctctaaccctggcccgctcacttcagttaaccccgtatgtcactctcatatttactttctgttcaccaacctctccttatagtccacacccccccctcaacccttccctcctgcccccctccccaatttctccctcacctagccctttttcccctcactggccttttttcccaaacccctactccgccacccccgcgcgtctccatttcaaccccctcgatctctatttttcctcttttgttatttcccaaagtccttaacttttcctctttataatttttaagcttattgtcgattgaaactgttgcctttttttatgtaaatcctttaatatttgtca

SEQ ID NO: 553642 - DNA, 934 bp, Homo sapiens
  misc_feature (595)..(595): n is a, c, g, or t
ggacccggagctgctgacccagcgggtggcccaccgaaccggtgatccacagcggcatggcgttagtggctcgttgagccgcgagcctggcctcgtcctagagctcggccgagccgtcgccgccgtcgtcccctcgtcccccagtcatgcaaaccgccgcgcgggcgcgccctcgtgtctgcgctgtctctccgatggtcgtccgcctcagggccatggcgaagcacgagcagatcctggttcctcgtatccgcccacaagacctcaaattcaaaggccccttccacagatgtagtcactacaaatcttaaattgcgaaatccatcggatagaaaagtgtgtttcaaagtgaagactacaggacctcgccggtactgtgtgaggcccacacagtggaattcttgacccaggtccaactggtgcactggtctcagtaaatgctacaggccttttgactatgatccgattgaccagagtaaaccccacagtttactggtacagacaattttgctccaccaaacacttcagatctggacgctgtgtggaacagaggcaaaacctgatgaataatggcttccaaattgggatgcgtatntggaaatgcccaatgaacatgattacattgggaattcaggcacgttatatttcccagtccccttgcaggctttctttggtggagtctgtgaaattgtcgggtcagtgggctggaattgaagacttgtgtcactagtgtgcccaagcacgagaggactgggtatgagatgcataggtctctcctctacggggggaccagaggctccgtggatggcggccggagggaagccaataaaaatgcggggttcgaacccgtgctgaggggggtttggaggcaaagaaaaggggggaatccggggcggggcccttaagtctgggaaagagggaaagggagttgggt

SEQ ID NO: 553643 - DNA, 211 bp, Homo sapiens
tgggaagttggagacagtcagcacaatgtaactgagaatttagctaaagtctttcagtcatcttttgtctattggctccatgtttcacggatgcgtgtgaactccatgtcattaaatattccccttttttggtcattcctttttccctcttgttaaaactcatccacttcctcatctgtaaaccgatcccccatggttctccacatctcct

SEQ ID NO: 553644 - DNA, 1207 bp, Homo sapiens
gatacgggagttcctccttgctctcgcccctactctttctggtgttagatcgagctaccctctaaaagcagtttagagtggtaaaaaaaaagaaaaaacacaccaaaggctcgagagccacaaaggggatgaaatttctttcgggacatcctccgggttcctcccggttacggatcggtccggctccctagagtccttcgtgaacgcttttaattgcctaagagggaggacactcaggtcaccgggggaaatcgtggctggattacagggagctggggcttgggaattggggaagactggactggcctatgacatttgggtaaaacttacaaaagcgcaagccgggggacccacggaggagaatactaacagtaacgccagtgcgccgtgcggggcgagaaacagcagggctgccacagacatggacaagaggacccagggagttggcacaaggggatcccaataacccttatggcggggaacaaccggcgcacgcacaccggaggacaagaaatatttattaaacgagggctctcgtggcacaagagcaaggggggtgtaatgtggtcacaggacacaatttgggggcgagcaattgttcacaggcatcagtgtctagctagcatcaaaacataaaaggaggacgtgggttggtagaggaactattaaattaacacatgccaaggaagttagtggatagtggggcatgaacgaccgaaaaaggaatattccccgctccagagagcaattgtggaacacaacggggaacgcttttgtgcgacgaggctaaaaactgtgggctacctcatggtgggccgcgacagaatttgtcatcgtggggaagcatgtagaccaagaaggcggcggcacatcatcgactctgcgccccggttggccaaaatgttggtcacccagaatactaggaaaatcgtcactcccgccaaatgtggggcgaccacactatcattcgggggtctcaaacactttgtgtgatggcttgctactgttctccgagggaggaacatgacttatggtggaagaccacaagttgggttttacagaggggagatccacccccacctttactctcagtatcaaacgtggggggcattctaaccatgggggttcaccaaaaagagcagcaagacagagatttctatgcattggtagcatgagagtagggacagtttctagcagaactagcaag

SEQ ID NO: 553645 - DNA, 243 bp, Homo sapiens
ctagaggatcctaattattatttcttgctccacaatgtctctctgaggctgagcatataagaaaatgatctctgtccttttcattactgaaaatcgcctgcggttatttcagaacaacttccacttattttccattgtgcgcccaactccctaagttataagtattgtgaacccccgccccgcagttatgcatggaaagcacaaggtgactagttcggtatgatgtacacagccatttagtaa

SEQ ID NO: 553646 - DNA, 380 bp, Homo sapiens
gctggaaccttccatgggggtttggggtattggctggagccaggacattagtcaggggccccatggacctcacgtgccagggaaactttaatgtggctgtcccttttccggacgccaaggggtgcaggagggtgcttttggccctaccccccccgtgtgacaaaataggagccagcgactcagggctgctcccgggtcaggagggcaacgccttaagtcagacctccctataggtcaacaggggcaacctggggatttttggagcagggccctcctttttcagggttggccccctcccccaaacacctggacacgtggccccaaatttgggacaaggggcccccgcccagcattaaataaaaagggccttaaaagtgtta

SEQ ID NO: 553647 - DNA, 310 bp, Homo sapiens
gcggaacaccaagttaggctggtacctctttgtcaaacatctgaaagtcccccagattggcttcaaggttcctggagctgcggcgagtcatgaagacccaacagagggcgaacaaccttcgcctgactgctgcgcacatcagactaagacacattatatctttttttcagattacctccgagattgcatctgcttttcttacaaagagcatcaggggccatcatgctttgaccttttcaagcctcacaacatccctgtgaggcagacaaaattcagaaacacctccatgccccactgaggtaccgagctc

SEQ ID NO: 553648 - DNA, 575 bp, Homo sapiens
gcacgaggttaccatgggtgttataactggtgatatcttggtcaatggtattccccgtgataaatctttcccaagatccattggttattgtcagcaacaagatttgcatttgaaaactgccactgtgagggagtcattgagattttctgcttacctacgtcaaccagctgaagtttccattgaagaaaagaacagatatgttgaagaagttattaaaattcttgaaatggaaaaatatgctgatgctgttgttggtgttgctggtgaaggtttaaacgttgaacaaagaaaaagattaaccattggtgttgaattaactgccaaaccaaaactgttggtctttttagatgaacctacttctggtttggattctcaaactgcttggtctatttgtcagctaatgaaaaagttggcaaatcatggtcaagcaattctatgtactattcaccaaccctctgctattttgatgcaagaattcgatcgtttactatttatgcaacgtggtggtaagactgtctactttggcgacttgggcgaaggttgtaaaactatgatcgattattttgaaagccatg

SEQ ID NO: 553649 - DNA, 524 bp, Homo sapiens
atctttgtatgtcacggtagtgtcatcttactgacattatggtccacaccttgacacactatagggactcgtctaacaagatacgccctcgttaacgaatggccattgcagggatggggaacgagcacacgatggagatcaacatgagcccaacgagaaagcattgaggtcggcggtcgacatgaacaatacgactaggaagagcataacgtccaagcaacacagagcacggcagcggagacagaacccacggaggaaagcccctcgtctccgcttggaaacacaagaagatgagcagggcaaacagactaaggcctgcgtcgaagaaagatgggcatgaggaaggaggagaagacgacgaataagcagacggtaagtggaggcagctacttgagagcgagggaggtcacagaaagaagcaagcccgcaccccgtcagagcatccgggtggcagaaaccgcccccggcggggcacggaaccatgaaatatgccgccccggccgaggaacgcggcacgcagaaac

SEQ ID NO: 553650 - DNA, 191 bp, Homo sapiens
tcaccgaaatgcaagaagtacagacgctcaacaataatccgatatatacaagtcagacaccatacagtacgaagtgctcagtctaccagtaaaaaatgaatgcggtgtacaaaactacaaaacattatgtaagatctacagcagcactaaacgaactcatgcaactcttactagctcttcaaccttgaacc

SEQ ID NO: 553651 - DNA, 465 bp, Homo sapiens
tctggaaagggattttcattctttttccccgggcgggagtgcaggggcgctatctcagctcgctgcaacctctgcctcccgggttcaggcaattctcctgcctcggcctcccgggtagctggaattatgggcttttgccaccatgcctggctaattttttttgtattgttagtagagacagattttcaccgtgttagccaggctgttcttgaactcttaacctcgtgatccgcccacctcggcctctcaaagtgctgggattaaaatttgtgagccattggccccagcccaagccttgttttctaaaaaaaaacaaagtatttgtaattgcaatcagatttttcttactaaatatctatgatgtgtgggacactttttgaaacacctaatatacttaatattttttcctcaatatttggctattctaaaaaaataaagattacatacggattttctaaagctaga

SEQ ID NO: 553652 - DNA, 169 bp, Homo sapiens
cagttccttatgacagcagatctcattcttaatatttccctattcacagcatttagctgtactccagtctcagaaactttatgtggtgggatgggagggaaccaccgataaccgcctgcctgcctatttatttttctataactgttaattgttcatcactatttagact

SEQ ID NO: 553653 - DNA, 617 bp, Homo sapiens
agcggtacggtttattcttggttgttttttttaactttgagaagtaagattaactatggtacactagtggagcgtgcttggaaatttgaagactcatctgaagtatcacagactcctatttgtaaagcattccacctttattgatacagtttgtggcctatactacttttcaaagaattgattcttgctagagacggtggatcattagaacatattctgtatttgaacctggttgtgattcagtccgtcattcagtctaggtagctgctatgttgattagtgtctaagaagcttacgtgacgattcaaaactatttccaccgctggtgtagtattcgtggaccatgtactgaatcatatacacgcacgatggtacaatccgagtggttggtgctggctgaaatggtttacacgaacacgagtctttcatgagagcacaagaaaggcccatgattcggctcagcaatgttacttaagtaattctagtggtgactaagatcacggtgtctgtccatgggtcgagtttttgaccgtgcgcaatcttgaatggatccattcaaatgcaggttatcgatgaagttgagatagccataccagatgggctttccctaagccttg

SEQ ID NO: 553654 - DNA, 159 bp, Homo sapiens
gcactgtatggccggagtgcatggctggagacaggttaaggtcctctgaaatgacacagaggacaaatgacaagaaatgaattcaggctgggcacggggtcacgcctgtaatcccagctactcgggaggctcaggcacaagaattgcttgaacgggagg

SEQ ID NO: 553655 - DNA, 150 bp, Homo sapiens
acatgcaagcgaattggtagaagactgtgcacataggactgagcttcagatgcagttggtcagcaaggagagtggatattgagcaattacgtcctaaacttttggacctatgagattctacaaggtgttagctacgttgtgcctagctgc

SEQ ID NO: 553656 - DNA, 334 bp, Homo sapiens
  misc_feature (39)..(39): n is a, c, g, or t
  misc_feature (71)..(71): n is a, c, g, or t
  misc_feature (83)..(83): n is a, c, g, or t
aaagctcagaaagcaggggtaccaggaaaagggactaanaatagtcatcataaggtaggataataggaggnccgtgcacagtngactcacaccctgtatatcccagcactttgggaggccaaggcgggttagagatcagcatggacaacataaggagatctcgcctctacaaaaaaatgaaaaattagccaggtgtgatggcgcacacatgtagtcccagctacttgggaggccgaggtgagagcatcacttgagcctgggtggttgaggctacagtgaaccatgatcacaccactgtactctaacctggatgacagagcaagaccctgtctca

SEQ ID NO: 553657 - DNA, 2466 bp, Homo sapiens
gagtccaaacattcggtggagtcgcggacacttccgctcggggactgaggttgctgcagtttttccgcgatagtttggggcagttccgcgcgttgcaggcccttctgaatttcctggacctacgcattggatcctcaaagaactgctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctgggaaaaaattgcaagtgatttaaccaggtctcaagacttggtgataaatagctctcagttctccaaagaaggtgatttcccctgccagactgaggcaggactatctgtaattcacacaagacagaaatcttcccagggcaatggatataaaccatccttcagtgatgtctcccactttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcacaaattacacacaggagagaaaccttataattgtgaggaatgcgggaaggccttcattcacgattcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagaaaagccatataattgtaaagagtgtgggaagagcttcagatgggcctcgtgtcttttgaaacatcagcgagtccacagtggagaaaaaccattcaaatgtgaagaatgtgggaaaggattttacacaaattcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggctacaatagtaagtttaatcttgatatgcaccagaaggtccacacaggagagagaccatacaattgtaaggaatgtgggaagagttttggctgggcctcgtgtcttttgaaacatcagagactgcgcagtggggaaaaacctttcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctaaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatg

SEQ ID NO: 553658 - DNA, 258 bp, Homo sapiens
tagcgcggggcatgtgcctattatcccagctactcaaggcaggagagttgcttgaacccgggctgagatagcaccactgcactccagcctgggtgacagggcaagactccgtctcaaacaaaaaaaaaaaaaaaaaaaaaaaaaggcccccttccccggttaacacagcccctttctccaaggcaacgccggcgccccaagtgttttatacccattttctcaccccttctttgttccggtgtgcacccctcttccccc

SEQ ID NO: 553659 - DNA, 386 bp, Homo sapiens
  misc_feature (248)..(248): n is a, c, g, or t
aatggtcacagtgatgtttattatactaatgtctctattttctatacatttagaacatttcataaaaaaaaaagtaaaacaatttgaaaaaggaccatacaactaaatttatcccaaaacctccccaaagtaagcaggagcaatggctttgttctggcacaaagcattcagtaaggggccatttgacagttaaatttaattagggttcatttccagaaactttctgctatttttaaagaaacattcanagccttttatgattaccactttcttttaattttccttaacttcagggaatttattgaggaacattaattaattgacttttcgtgggaagtttgaagattgttagttttttcataggttccattctttgccccagtctt

SEQ ID NO: 553660 - DNA, 1481 bp, Homo sapiens
caagtgatgcatcgctatctagaagggctgggcgccagggcactagcagacaggcagctggctcccaggacataaggagcatgggtcctaaccagggaactaaggcttcagcacgcctactggcgatgtcaggccgaacgcccgtgggtccatggcagcgcgtgcaggcagttaattcggtgatccgtcaggcgcccagcacgccagcggggagcacggtgtacgttacctatccccacgttgcgctgactacacggaaggcacaaaggaagagtacgatcgcgtcagagtgtaagagaccaggcagataggaacattaatcatgatggtgatgagtgagctgctcacgagacgcccttatcacggccactggggtagccagggcacgctgtgctctcatagggggacacagtcgactgaacaggcagagggtcgggtcgtggagtggactggtgagactacaggaccgtccacagtctcgtgttgagctctcggactcttgcatgtcccagtccccgtgtctccgctaagtctgattcgaagtagtcgtcgaacgtgatgatagggtcaccacttcaacggggagagctgtcctcccgaagggctctcgagctttcggtacgccgaacttgttagaaagtaaaggggactcgcgtacaattataccaccttgtaccgggaggtctagaagcgattgggtccatcatagcacaagaacttaagcaagatgcgcccattggccaggtggtctgaagtcccagggacacgtccgtcagtgttattgtgcccctctgggtcctggtgaattgcgaaccttgggctttgccatcttcgtgttaagaacttggcaacgatccggatggttgagcaggtgtactaataatcgcgaattccgaaaacccacgggggtctccatcgcgcgccaaggaaaacctgccgctaaaggggccatgcgattttacaggaaaaggcagcacaagagagaggcgaactggggaacaatagcatggacccagagaggagcagcacaagcctggcgagcgcatcaagtgggaaacaacaatggagcagggaaaagatagcacgaagaacacgagaaaaagagagaccccgtgtcaaaagagcacccataaagatgaccccctccgacacaacaacatcagagaataaatctcggagagaacgcaagacagaacaaagcaatcggaggagcacacacagaaacaaccagaggatgagtaagagagcaaaaccaaaaacaaccgcaaagcgcagcgaataagaggaaaaagacgaaacgggagcacacacacgacgcggaccaaacagaagcgagatgctcgatcaaccaagcaagagcacagacgaaacaacagaaagaacgagcagcgaagcaacaacaggcaagaaaacagaacgaccaaagcaaagcaccacagaatcacacaagaccaaccagacacaaacacgccacccacaga

SEQ ID NO: 553661 - DNA, 245 bp, Homo sapiens
  misc_feature (12)..(12): n is a, c, g, or t
  misc_feature (74)..(74): n is a, c, g, or t
  misc_feature (76)..(76): n is a, c, g, or t
  misc_feature (88)..(88): n is a, c, g, or t
  misc_feature (97)..(97): n is a, c, g, or t
  misc_feature (115)..(115): n is a, c, g, or t
  misc_feature (161)..(161): n is a, c, g, or t
  misc_feature (185)..(185): n is a, c, g, or t
  misc_feature (187)..(188): n is a, c, g, or t
  misc_feature (191)..(191): n is a, c, g, or t
atgaggggtacnaaacaggccggtgaccccaacctccaccccctgcccctgagaagagactgggctgaggccananaccaatccacgnggaggaaangccaccagcacccatcangcttcccactggcaccctgaaacctgcccaggctgtgggccgccancgctcgtccacaggcctttgccancnntgnccctcatggaatcaacccagctcgcatctggaaggccatgcaataaaaagggtt

SEQ ID NO: 553662 - DNA, 424 bp, Homo sapiens
cggcgcacagcttctcccctccctcctctgtccctggtcagcttgctgccctaggctccgtcaggtgtctggcctgccagatggcacccacccagcacccacgctactcctacctaacacgtcactcacccccaaggggcagtctggtggggcatggtccgcagcttgcgttcgaatgaggaggaaggagagcaaggggagtgagggtcggggggctcctactacatcgccctccacatccctgattcctgttgttatggaaactgttgccagagatggaggttctctcggagtatctgggaactgtgcctttgattttcctcaggctgctggaggacaagtgagactcagacaggaaagggaaggcccacagacaatgttgccctgggctgaggcttgttttgtcttggggtaaatatgaggg

SEQ ID NO: 553663 - DNA, 808 bp, Homo sapiens
cgttctgtagtggcgctgcttgtgggcccttgcgcggatgtaagctgctggtttgcggctgggaagagcggcgagagcggttcgggcgtttcgtcgggatccccggcaaggatgagatgctgccagagagtctcacccggcatggggtgaagcgttcagcctccccagacgacgatctgggatctagcaatcttgggaggcagccacgacttgtggtaaaatgaagatgagcaaacaaaaagttcttgagacttatgggtgcatgtgactcagaaagaaccatactggtcgtcttgttataggacgatcacaaactcaacatctcacttccgaaccggggaagaagacaacgaacaaatcactgaagaactggagtctcaatatcagcaaagtatggacagtacaattatcaggacgatcatcgcgcgacattgtgcgacttggcttccgcgaggtaggacgcaccatgatggacgaacggtgatgtggctggagcatgatgctgattgacgctgatgattccacctgatcctgtcaagtccaacgatgaatcctgccaggcgtttgacgcgtacgatctaccgcggcacttggctaagaaactcccagctgctgagcgcccttgactcccagtggacggatcccacggagccatcaagatggcaaaagcatatccaccgctgcggcgcaatccgtggttcttagttccaccgcttacttgtgttaacagagccactgtttcgacgcccggcgcgtgcacgccagccttatatagtcaacaggctcatatcacgcgtgtgccctccgg

SEQ ID NO: 553664 - DNA, 103 bp, Homo sapiens
gatgctgtggtgctctcgaggattccccacctgcagaattttaaactcgcctcttgcaatatttcacaagaatttctacaccatattttacatcgttcaaact

SEQ ID NO: 553665 - DNA, 1394 bp, Homo sapiens
gaggggagagaggaagaggacagacataggagaggtagagggtgagtggggaacagagagagagtagtggaagagagcagacggaagcttgaagaggagagagaggggaggaaggcgggacggagagaagcgcggcaagagcaggtgcagaaagcaaagagagcacagaaggaaagagtacgtagcacgagcaggacaggggcagaggggggacaggacagcaagcggtgacgggcagccggcgcgtggcggggtcgaggagggcaaaaggtttgggggggagcgaagagaggagtgagaggggcaagagaggtgggcccaaccccggggagatgggggcaatacagcttgcaggaggcccgacttatgcgaagcgtgggagttgggtacagtgggggctatttgtgtgtgggcgtcaatatgcggtccccgggcaatgggaattctgtagaggggagggagcggtgaagggggtgtggtgcccctgcgagagggtgtgggacacgggaatagttgcgcctgggattaaggaggaggcggaaaggtagagagtccacgaaagagccctgcgtgtgtcgacgtatgaatgatgcccacgggggtcgaacccctgttttgggagcggacaaatgaaatgttgggtcccccacggtgagtggtgtgggtgccccaccgtctggtgttcggtggtgtgttagaaaaatgggtagatatttgtctatatgataggagagggggaatagcacatggtggtagattgtggtgaagattaggagagtgttgttggagtttatgatgagaggaggctgagagagacatgctgggtgccagtgagtgtagtgggagaaaatggtgtgatgagaaattggtggtgttggctgcgtgttgaatggtgtctatgaaccactctagattgtttgggtgctgaaggcacgtgatggcatgttgtgtaatggagccacaagggagataagatggagagcttaagaaagccccgcccacgtggaaagagggtgtgtatagtttgcctcatttttctgcacacaacgcacgttgtgtattgtgatagaatcatgtgagcctcttagaaaggcacctggtttatgaagaaaagccactaagacttaaaatataggtggttatataaaaataataatagtgcacgggtttaaacactaaaatttatgcgaaatatatggtagaaaggggaaaaagcctctcactcttttgacctccccctactgaataaattgtaaatatgaagtttgtcttttttgaaaactggcttatgtgattgagtattcacatgtaaataaattaataaatataatttagcttgaaagaatgctctaccacttatgacccattaaaagggaactgtatgttttgtttga

SEQ ID NO: 553666 - DNA, 118 bp, Homo sapiens
  misc_feature (43)..(43): n is a, c, g, or t
ccgatttggttaaaaatagtagagggatgatgctaactaattnaggctgtgttgataactaaaaaagggtgcacaaaagaatgttgtccaaatcggcaaagtgcagagaatcggcgga

SEQ ID NO: 553667 - DNA, 377 bp, Homo sapiens
aaaataaattcttagtagaagcaatatttgggtcacactacatcaaaataaaattcatcatttatctgaaatttgtgctgggccgagtgcccgtgtcttatccggcagccctaccaggtcctttggccatggacactgcagtgcagttcttgggaggcggtgctggccccaaggctccagagggaagcaagctggcacacgcctcttaggaggggccggagcacgccaaggagatgttctggggacattaggatgatctcaggaagctgagggggaaagctggccctggaatggtccagaaagcaggcaagggttcttcatgagtcagggccccctggaagggaagggacagaaaacagcccgggtgttagttcaaa

SEQ ID NO: 553668 - DNA, 217 bp, Homo sapiens
gtctgtaatgtcgggcggagtacggtatgatgggcagtgaggcggcgcatatgcatctaggctataaatattcgggagtatactgtagccgggctaatgtataacaacggggtacctctagaactatagctagcatgcgcaaatttaaaggctgatatcgatcgcgcgcagatctgtcatgatgatcatggcaattggatccatatatagggcccgg

SEQ ID NO: 553669 - DNA, 664 bp, Homo sapiens
ccggtggtctgaactcgctctgctccgtgttgttggttcgtgcccgaagttccccccggtagggggccgcgccctattcccctccccgtcggttatagtcctagggggcctcccgtccgtctcgccgtattctgtatgggcctgcggtggccgctagatagggctttcgtttattgccaaacgctcttctttccgcgcgttgtgttctcctctctctgcggctttctcgtggcacacaatatttcgcctccgggctctcacgcgcgccggttatccgcccgcgggctttacagcgctctttctttcccttgtactgcacgtgtgcgcctacccctatggtcgccgcgtggcgctaagtaccgcctttcccccgctgacccctctggccagcgcggtcccccctcagatctccacggttgccaccctcagccgtcgagtgctcccactccctcgtggctcaccactcgcgccctctcgttgccctcgtctcccgtcttcaccaccctatttatttcttctcgcaaacttatgttgtctccccctcctctggtctggacactcctctgctgcccgttataaccctctctaccctctcttctcaatcttctcttggaagccgctctaccggccttccgccaaccaccagttttacaataacaaaaca

SEQ ID NO: 553670 - DNA, 114 bp, Homo sapiens
agcaaacaaggcatcagcatttcatgttcatgcatgggagcacacgcatctccgtcccatcagataaccaacaagaggtcaatatatagaaatccgctgatgggagaagatgcg

SEQ ID NO: 553671 - DNA, 1075 bp, Homo sapiens
gtcctctcaagcttggcgttgtccggtgggggttgacaagcgggttcaacgtgcgtatcgaaaagagtgattactgtccggggcccagtatatcctggactacgtgcatgatgttcgtcactgcaagtgaattgcaacggctgtctcaagaattatggcaacagtgctaaattgtcactcataacgatcgtttcaacaacagaagacgcaagccctgcggcaacagttagggtggaaccgatatggcattccggaaagagcggctgggttaacagtgcaggcgtgtaccagtgggcacttaagtaccattatggacatttgaaaggacaggtagaaattatgagacctagtcaataataccaggctagaagacttagtgggatataaactcctatgggaatgggaatggagagaaggaggttggaatgaaacatcaacaccagtgagaggaggcatagcataatgttgtatatactggaaaacatgaatttgaacaggacataaaattatacagtaagctggcacggcaaagtttcacgtgatactcataatggaaagattaatgggaaatattatcaccatacgtattatccggagcctccttctttggcaagtgtgaaaagggaaaagcagtatgggaaaaggagaacaacatggtgtcaacaagagaagatatacggagtaaggagaatgggtgaggaaccatgcggacacgcaatggacgtcccctttaaaagaaacagtgcctcttggtaagacccagatggtacagtgtaagagtatgtagcaaatctgtgggaaagaaatgggccacgtgtttggggaaatcaggtgtggaaaaacgtgagtaaacaagtgtacatagaaaagttactaaataataattgcaaagggttcaagtattaagacttgtaagacaagggataattagggagaggaacattttggtgccgctggagttagggcattattacgaattacattaatttatgaaattatgtaacagagagtggataccgagatttgggacaatttgtagttgtgttaacagtgcttgtacaatggattagacatc

SEQ ID NO: 553672 - DNA, 206 bp, Homo sapiens
ggtcccgtctgataccagcttccttcagcagcgcaggggtgtccctgaggccgtgaaggagtcaattgcgggaatttgcagttatctgcgggtgtggttccagcaagaccaaagctagaaaaggaggaggaagaaactgacccgatcagtgccagaagtcattgtattcaaagaagaataagcaagaagagaacacagaaggaagc

SEQ ID NO: 553673 - DNA, 95 bp, Homo sapiens
ccgaggccacctcgaggacgcggacgccacgctgggccggatccaggtactgccgcagcacgtgcaagatgggatcctatagtctccgcggccgc

SEQ ID NO: 553674 - DNA, 388 bp, Homo sapiens
  misc_feature (17)..(17): n is a, c, g, or t
  misc_feature (24)..(24): n is a, c, g, or t
  misc_feature (28)..(28): n is a, c, g, or t
  misc_feature (30)..(30): n is a, c, g, or t
  misc_feature (32)..(32): n is a, c, g, or t
  misc_feature (36)..(36): n is a, c, g, or t
  misc_feature (38)..(38): n is a, c, g, or t
  misc_feature (58)..(58): n is a, c, g, or t
  misc_feature (62)..(63): n is a, c, g, or t
  misc_feature (73)..(73): n is a, c, g, or t
  misc_feature (75)..(75): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (89)..(90): n is a, c, g, or t
  misc_feature (92)..(92): n is a, c, g, or t
  misc_feature (97)..(97): n is a, c, g, or t
  misc_feature (106)..(106): n is a, c, g, or t
  misc_feature (108)..(108): n is a, c, g, or t
  misc_feature (111)..(111): n is a, c, g, or t
  misc_feature (115)..(115): n is a, c, g, or t
  misc_feature (118)..(119): n is a, c, g, or t
  misc_feature (121)..(121): n is a, c, g, or t
  misc_feature (127)..(127): n is a, c, g, or t
  misc_feature (129)..(130): n is a, c, g, or t
  misc_feature (136)..(136): n is a, c, g, or t
  misc_feature (145)..(145): n is a, c, g, or t
  misc_feature (152)..(152): n is a, c, g, or t
  misc_feature (156)..(156): n is a, c, g, or t
  misc_feature (171)..(171): n is a, c, g, or t
  misc_feature (190)..(191): n is a, c, g, or t
  misc_feature (210)..(210): n is a, c, g, or t
  misc_feature (223)..(223): n is a, c, g, or t
  misc_feature (243)..(243): n is a, c, g, or t
  misc_feature (247)..(247): n is a, c, g, or t
  misc_feature (249)..(250): n is a, c, g, or t
  misc_feature (252)..(253): n is a, c, g, or t
  misc_feature (260)..(260): n is a, c, g, or t
  misc_feature (268)..(268): n is a, c, g, or t
  misc_feature (273)..(273): n is a, c, g, or t
  misc_feature (277)..(277): n is a, c, g, or t
  misc_feature (297)..(297): n is a, c, g, or t
  misc_feature (316)..(316): n is a, c, g, or t
  misc_feature (319)..(319): n is a, c, g, or t
  misc_feature (321)..(323): n is a, c, g, or t
  misc_feature (340)..(340): n is a, c, g, or t
  misc_feature (347)..(347): n is a, c, g, or t
  misc_feature (349)..(349): n is a, c, g, or t
  misc_feature (352)..(354): n is a, c, g, or t
  misc_feature (360)..(360): n is a, c, g, or t
  misc_feature (366)..(367): n is a, c, g, or t
  misc_feature (380)..(381): n is a, c, g, or t
agttctggtcgtcgtcnaccgtcncgcnananccgntngacgggcaacgcaaggaggnaaannacccggccancnccncanccncnccnnantcccnttccacccncnccncccnccnncncccccncnncccccntgcctgccncgcccgncagncacggcaggggtccntggcgaaggccaggggccnnccccggccctccccacccnaccaagtcatccnctccccccccgactcccacncccncnncnncccaccncgtatccntcccncccnccccagcagaaggcccaccnagtggtgccccattctgtngancnnnaacccgaagaggaagtnaaacccncnttnnngaaggncagacnnaccatgggccacnnatacgtt

SEQ ID NO: 553675 - DNA, 874 bp, Homo sapiens
tccctcatcgactgctgccaaatgtcaccaacagcaatggggcccaccatcagacctggaccatggacgatggatgatgtggagatggagaactatgaggcacctcctgaaaccatggagcgagacggatgggagatgccaagaccaccggggatctcaccaaagcagacatagagcagactcccgtcgataccgcttataacccagggaccgaacgcctccgagagatgaccccagaggaggactgagatgaggccacgcaggaccgactgaccggagagaaccctgacatgaagctctggaaaccttgtgagatggggaccagggaggatggggagggagatggaccaaggacatgacccatatccgctcactggccatagcataatccattagactgagatgccaagggatcaagacccaagcagagagaagatcccatgagaataaggcacgcaatgcagtattgaacaaagcatcaaaaagaactcaacgtccacctaaatcatgccatggactgaccagacacgaacacaggaaacatgcaaatagttgataccatgaatcggggttcatcccatcacatattacaacccatcagagatcaccatccattattactggctgtcacagagatgcaaagggtaagactacctccaagcggggcccgagaggagcatccttggccacaggagaggcggcagacagagaaacaaacagggacaagaagggtccatgctctgaatggagtgcactccgcaccagggggacagggacagagcagacacaggagggacaaagccattctgcgcccaagcggaccccccaccgacccacacaggacaggaagcaaaatgagcagagaaaagtccag

SEQ ID NO: 553676 - DNA, 407 bp, Homo sapiens
ccagaggcacaaggaggattggggcgggagcgtgtgtgttggcttggaccgggactggcggtctgatctggctgaacactccaccgacgtatcctaaagtggctcagtgccaatccagcaaagcagtccattttccctgggccaagatggagaggtatggtttcagatacagaagagttctgggatgagccaaggacaagcgggggtgtcttatatcgaacagacctcgatgaaaatctggaattcaccccagtgccctctgtgggcaagggaaggtgaagatggaaaagttaaaaaagctttgggccactggagaggatcagggccgcaactctggaagaagcaaagggctcagggcatgggggtcagcgctggtacagctgaaggatgccggccttgtgcaggtc

SEQ ID NO: 553677 - DNA, 442 bp, Homo sapiens
tactttccacaggcacttaactattttacaatgagaaaaaataataaccccagtatacaagtgggcatcggacatgaacactacattctcagaagatagagatacatgtagggaaccatgatatgagagagcggagcccaacatgactgagtcatagagaaatgctactccatcgtacactgagataccatctcatgccagtcaaaatggctatttattaaaaaatcaaaaaacaacagatgctggcaaggttgaggagaaaaggaaacacttccacactgttagtgggagtgtaaattagttcaaccattgtgaagacagtgtggtgattcctcaaagacccggaatcagaaatactatttgacccagcaatcccattactgggtatatacccaaagtaatataaatcattctattataaaaatacaaccacacgtgttca

SEQ ID NO: 553678 - DNA, 133 bp, Homo sapiens
gaggatccctggcaggtggaaatcaggattttgatgtttgtcgcgcggtttctgagaacactatttgaagtgcatacgttagacgtgtctgccacgttgttaccatttgttgactattaaggagggtagaagg

SEQ ID NO: 553679 - DNA, 338 bp, Homo sapiens
  misc_feature (47)..(47): n is a, c, g, or t
  misc_feature (57)..(57): n is a, c, g, or t
  misc_feature (65)..(65): n is a, c, g, or t
  misc_feature (67)..(67): n is a, c, g, or t
  misc_feature (84)..(84): n is a, c, g, or t
  misc_feature (96)..(96): n is a, c, g, or t
  misc_feature (102)..(102): n is a, c, g, or t
  misc_feature (116)..(116): n is a, c, g, or t
  misc_feature (162)..(164): n is a, c, g, or t
  misc_feature (170)..(170): n is a, c, g, or t
  misc_feature (196)..(200): n is a, c, g, or t
  misc_feature (227)..(227): n is a, c, g, or t
  misc_feature (236)..(238): n is a, c, g, or t
  misc_feature (265)..(265): n is a, c, g, or t
  misc_feature (267)..(267): n is a, c, g, or t
  misc_feature (295)..(295): n is a, c, g, or t
  misc_feature (327)..(327): n is a, c, g, or t
  misc_feature (332)..(332): n is a, c, g, or t
gtgaaagtgaaaaaagagagagactcgtgacttttccggtttcaganaaacccatgnttaccctnancttaaaactgcttgaanttgtatatatantctccntatatatatatatncaccgacaagggaaatgtagacttcataaacatggctgtataattnnnattttntttgaatacattgtgtttctatattnnnnntgacgacaaaaggtatgtacttataangacattttnnncttttgttaacgttattagcatatctntntgctttattatcctggtgacagttaccnttctatgtagggtgtgacttgcgtgctttttnagggnacttgg

SEQ ID NO: 553680 - DNA, 499 bp, Homo sapiens
cccagtccctcaagtcatcatccgtcgagcttgtccattgctggcgtgagctgcgatcctttggaggagaagaggcactctgatttttagaatttcagcttttctgctctggtttctccccatctttgtggtttaatctacctttggtctttgatgatagtgacgcacagatggggttttggtgttgatgtcctgtttgttagctgtccttctaacagtcaggaccctcagctgcaggtctgttggagtttgctggaggtctactccagaccatgtttgcctgggtatcaccagcagaggctgcagaacagcaaatattgcagaacagcaaatgttgctgcctgatccttcctctgaaagcttcatctcagaggggcacccggctgtatgaggtgccagtaggcccctactgggagatgtctcccagttaggctacttgggggtcagggacccacttgaggaggcagtctgtccattgtcggatctcaaactctgtgct

SEQ ID NO: 553681 - DNA, 560 bp, Homo sapiens
cttgtcaccaaaagaaggacaaaattttccccgggttaacccaaaatccatgggcagcataagggcaggtccttttttgcaaactcggttccaaagtcccaggaaaaaacccaaaagttcaccttcccaagggttagggctccccccccaattttttaggtcaagaattgtgtttaggctggaaaaaccaaaaaaaattcccttttcccttccctggggttgaaaaccccagtcagtggaaaaatgtttggaaacccccgccagtggagcctgggtgggaccccggctttagcattattggatgtcaaaagccttgtttttgtcaaggaactgttttaaaaaatctggcccagggggttttcacctgttaaaagtccccccccctggccccaaggacgctgggaactgtctattaaaaatttgagggttttgtgaaattcccaaagggtttaattggcccccatgggatccttcccattttttgtaaaaaaaaaaattacttttttatcccaggattcccaacccggccaaataataaatattgggacccacccctggtt

SEQ ID NO: 553682 - DNA, 133 bp, Homo sapiens
  misc_feature (41)..(41): n is a, c, g, or t
tcgatctagaggacccattagagcacagcttcttctgcccntctactgttgccagccagaatgggctgcttgtttttgctctgccaaccaggttgcggtagcagtggatgttagcctgcaaacaacattaggg

SEQ ID NO: 553683 - DNA, 891 bp, Homo sapiens
gcaggagcagcaaaatctcactgcaggtgacttagattctaccacatttggtaccataccaccacacctccactcccaccgaccgatccatggtccccctggactagaggtcaccaaagtaatctgcgtgtgatctggtaagaagagcgagagaaagagccaatgctggcaaacgacttaggctcacgaacaactcccagagcacagccgaaatgcctacaatactgcatagacgatccttaaagagactgaacagtgtacaacttcggtcagactgacaaggtcagacgcaaaccgatgtgcaagccaacagacaagtgaaatgctacatagacccagacgcacactcactagccgaagcgcacccgacacaacagaacagtacagacccactcccgcgctccgcaacgaagatacgaccagaagaatgacacgacaaggacacaagggagacaacccagcggccgagctccagaggggcaccacacgacgccgaccaggacggacgccggcacaaacacctgacggaaacaccaacagcagggagcaaacaccgaaacaggagaacaaccataagaaacaagtgaacaacaaaaacaaaataaaacacaaaggaagatgcagaacacgaacaaccagacaacccccagaaagaacaagagaaaaggcacaaagaaagacaaagaagaaaaacgaggacagaggaagagaacgaacaacacaaaacaaaaagagcaacagcaaaaaaaaaaaaaaccaaaccaaacaaaaacaacacaaagacaaacaaagaaaagcaaaaaacacaaaagcaaaagaggaacaaagaaaaaaaaggaacaaaacaagaaagaacaacaacaaaaacaaggcagaaacagcacaagaaac

SEQ ID NO: 553684 - DNA, 145 bp, Homo sapiens
tagttgatgagatatggacatacattttgacaagaaatatgattttgattattggagaagttaatggtcaggcacaggtagaatcaaagtcctgtatgtatgttcacacagataattacatagataacatgtaatgtgtgtttat

SEQ ID NO: 553685 - DNA, 352 bp, Homo sapiens
tacttcaaaaggtaagccctaaaggaagctggaaatacaatgcaccactaaccagtggttctcaacctcatcagacccaggaggctccctttcttttatattttattttatttttaaatgacaaataataattgagtatattcatggagacagaaggccaacagctagaaagccaagtggaacacagttgaaagtactgaccagaagactcaggattttactgatgtaagtaagttatctccaaattgatctaaagatttaaagccgttccaaatcccagtaggtttttcagtggaaattgacagctgattgtgccatttatatggaaatgcatggagccaagataaacaag

SEQ ID NO: 553686 - DNA, 432 bp, Homo sapiens
acggacagtcgtactgcgtcctggagtgtttccctactcttcagcgtgaactgctgctagtgctgtggtcgtcaggcctagacttgatcgaacactggttcctggcgctcctgtctgctgcgtgtcttccttgattcgctgaatccacttctgtgtagcacctgggtcaggtgatcaatcaatgctagtcctcaggatttacaaaataatcttaactcaaagtccaatgcaaatacattaagtaggtaattactcttgatcttgaattacttccgatacgaaagtccttcacatttgacaaactatgcgtactatatttaaggccttccaaattcttctaactcttccaaaagccttctgccttaattatactatacattacaccagtccttctagtagcttattgatgtgcggtaaaagcttgggtaccga

SEQ ID NO: 553687 - DNA, 738 bp, Homo sapiens
  misc_feature (9)..(9): n is a, c, g, or t
  misc_feature (55)..(55): n is a, c, g, or t
  misc_feature (83)..(83): n is a, c, g, or t
  misc_feature (90)..(90): n is a, c, g, or t
  misc_feature (111)..(111): n is a, c, g, or t
  misc_feature (164)..(164): n is a, c, g, or t
  misc_feature (171)..(171): n is a, c, g, or t
  misc_feature (175)..(175): n is a, c, g, or t
  misc_feature (200)..(200): n is a, c, g, or t
  misc_feature (204)..(204): n is a, c, g, or t
  misc_feature (213)..(213): n is a, c, g, or t
  misc_feature (223)..(224): n is a, c, g, or t
  misc_feature (226)..(226): n is a, c, g, or t
  misc_feature (236)..(236): n is a, c, g, or t
  misc_feature (266)..(266): n is a, c, g, or t
  misc_feature (276)..(276): n is a, c, g, or t
  misc_feature (291)..(291): n is a, c, g, or t
  misc_feature (302)..(302): n is a, c, g, or t
  misc_feature (305)..(305): n is a, c, g, or t
  misc_feature (308)..(308): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (330)..(330): n is a, c, g, or t
  misc_feature (336)..(338): n is a, c, g, or t
  misc_feature (348)..(348): n is a, c, g, or t
  misc_feature (363)..(363): n is a, c, g, or t
  misc_feature (365)..(366): n is a, c, g, or t
  misc_feature (372)..(372): n is a, c, g, or t
  misc_feature (382)..(382): n is a, c, g, or t
  misc_feature (397)..(397): n is a, c, g, or t
  misc_feature (403)..(403): n is a, c, g, or t
  misc_feature (406)..(406): n is a, c, g, or t
  misc_feature (435)..(435): n is a, c, g, or t
  misc_feature (464)..(465): n is a, c, g, or t
  misc_feature (492)..(492): n is a, c, g, or t
  misc_feature (642)..(642): n is a, c, g, or t
  misc_feature (646)..(646): n is a, c, g, or t
  misc_feature (732)..(732): n is a, c, g, or t
ctgaaagancagcagaggcataaggttcgggaagaggttgttaccgtgggcaacnctgtcaacgaaggcttgaaccaacctanggatgantcgtgcatttgacccctaaanaagtttcccataaagcagttggagatgagtgggaacgaatgtctgaatcaggnattaaantgtngtgccagtgcttaggctttggaagnggtnatttcaaangtgattcatnnanatggtgccangacaatggtgtgaactacaagattggaganaagtgggacngtcagggagaaaatngccagatgaanagntgnacatgtntngngaaaggaaaangagaannnaagagtgacnctcatgaggcaaagngnnaagatnatgggaaganaaaccacgtagaganaacagnggnagaaggaatatctcggtgccatttgctcntgcacaagctttgagaagccagcgggagnnggcgctgtgacaactgccgcagacctnggggtgaacccagtcccgaagcactactggccagtcctacaaccagtattctcagagataccatcagagaacaaacactaatgttaattgcccaattgagtgcttcatgcctttagatgtacaggctgacagagaagattcccgagagtnaatnatctttccaatccagaggaacaagcatgtctctctgccaagatccatctaaactggagtgatgttagcagacccagcttagagttnttcttt

SEQ ID NO: 553688 - DNA, 896 bp, Homo sapiens
gaattttattagggggttagtctgcgtatcggggtcatggcagggggttttatattgataactgtcgtgactgaaacttgactggcccctacagactacgacggacgacacctgcataggtgtaaggacgaacgatggttaggtctacggaggctccagggctgggagtagttccctgctaacgggacgggtacgactgttcaacctgttcctgctccggcctccactatacgcagatgcgagcacgcgagctacggagagagggaggtaacgagtcagaagcttactgtcgtccactgcggggaacacgccactcactcgcgggcaccgcattacttacgcggacactacgctccagttgccacaaggcctccgacttactgactgggctatcaactactgcaagcaagatccactcccaacctgccctggccctgccgcccgatcaaccgtccccacaactgtaggtccggccacccctagaaccgcccagcctaggcctcggccccacccctcagcctcgaactaccgcacgcgcccaccacctcgtgcactacggaccccacgcctcactgccgcccgcaccacctcaggatcatccgagtcccacaccgctccaggcggtaccggcaacgacatccgtccaaccgccacgaccccgcccgcatcctcccaacccgccccgccccacaagccccacaccccgacacccagccgccaccacccgcaccccaacaccgcgccccacacccccagacacaccccacccactcaccagcaccaccacacgcacagccagcccccaaccgccccccccaccgcggccgccccccacccacccgcacccaccccgccgatccgccgcccgccacacaccacaccacaccaccagaaca

SEQ ID NO: 553689 - DNA, 146 bp, Homo sapiens
gaatcccgaaactttcgcggctccacaagcattgccttcttattttacttcttttagctgcttaactttgtaagatgcaaagaggttggatcaagtgcaaatgactgtgctgcccctttcacatgaaagaactactgacaacgaag

SEQ ID NO: 553690 - DNA, 580 bp, Homo sapiens
ttgaaccggcttcaagacctggcctatgacggaagtctgtgctaaacatcagggcaaagaagcgtctgccttaccaatgtccaatgtctcaacgcaattgccaattaatgaccgtgggttccctaacctcaacctggggcttgttgctgcccttggcttaaggttcaagcctaacctgttcttgttgccgctggggctgggcaatggcttcaagggcccccaaggttgaattcttggctcaaagcctcggggggcttgcaagggggccaattcttggccctcttgaagaagtaaacttggccaggttgaagttcttccgggttgggacgagggaaagacccattaactgcttcgttttcgcccctggtccagaactccacaccccagctagcagggatcctggccccggtgcctaattgagaagcaccttcctagcctaggcccctcctctgtgcctccccagaggacgtcagggccctgatgtacctgagagggcagctggagcctcagtggaagatgttgcagtgccatcctcacctggtggcttgaaatcggccaaggtgggagcatttacaccgca

SEQ ID NO: 553691 - DNA, 149 bp, Homo sapiens
gtcgtctacgtctatctcctacgtaaatatatatgtgtagctcacacgataaaacctaggaagccaattgatatcatagctacagaccatacctatgtacttcaaataggctctatactctatccggagctagtaacgtcacaactatg

SEQ ID NO: 553692 - DNA, 1298 bp, Homo sapiens
  misc_feature (881)..(881): n is a, c, g, or t
gattcgatggcgtgatgtctcacagcaaagttctctcggctcccatgacatgggtccctcgagcttcctgcctcggaagcgcagacagtcgagagcaatactgatgttgaaggtgaagagcttccctatacgatggacctcgtccaattgccgtgtccacctcatcagtccttcctggcgatacacaagcgtctggctagtgactcacatcgatgcggtaaagtcgacaaggccggtcatccaagtgtgaccaagaaggatgtggatgagaggctgtgaccatttgttagaggcacactccaaaccgatgggtgaatcggtggggcacatccgatgggcctgtcacgtcttgagaaacacaccccctcgggacgtgctgtctcgtggactcatctcataagcacttgactccttgtgactggcaaccacaaatcaaggtgcagtgcaaatggccaatgaggcggcttctcatacctaaatgaaagttttgtgccattgtaaaaatcctttataccgaccatgcaaacgcgtcccctgtttaaacgcgagaccgataaccctttggcaaagcagaacactagtcgcgacccaggggtagtcgtaagggggtaagttgagggcgaaacgaaacaccgaccaaggggctttcgcggtaaagaaaagggcggaaccattatcccaacgacgaggtcgaggttggaagccgcaaaatggttaagccatagagggccctagagggttgccaattccgccggtttggcatccccaattgttggtccccgtctcaaccggatctgcgccaagggaaatcgaccgtgtcccacctgtgaccgtttctccactatttccttgttgccaactccgataggggaaaatcgcanaaaaggcgggtctagcgccaagactgcactttgagaaactgggagaggaacgcacatttgcgccggaggagcggcttggttgagaaaaccgggggagaaaaacgcgccggctgtaaccagttgaaactggcgccaacagccggcaatggggaaaatagaccctttgaagagaaatcgatgtaagcggggccccccccggtcgtgcgaacaaaagaggcacaaggttgacttatggtgaaacgcacaaaagaagagcaaacagcaggcattgaaagctgccaaagaggtagacgacgaatccccctatattcagaagatggtgtggttcccatggagcgcggacgacacaaagcgcggccaactttggctcaagggacaaatcggtgtgaaggtttccggcaaacaagcgagcgtttc

SEQ ID NO: 553693 - DNA, 192 bp, Homo sapiens
ctcctacgcaagctgtatgtccccgctccggaaggtcacatatagatgccgaacttactgcggacacccgatcggcatagcgcactacagcccagaactcctggactcaagcgatcctccagcctcagcctcccgagtagctgggactacaggcacgcgccaccgtgcccggcgggggtttgtggagagcgg

SEQ ID NO: 553694 - DNA, 292 bp, Homo sapiens
caccagccagatgccggtggacaactggcacgaactgatcggcgatccgaccctggccgatgccatcctcgaccgcctggtgcacaacgcttatcggatcaatctggagggtgaatcaatgcgcaaacggacgcagaaattgacgacgccgggcacctcagactaacaatgccacccctgcgtcgctgcgctccgactgcctgtccgaatgatcgtggaacaggtgtccggatcagcgtgggctgagtgtccgaatggcgtggaatccgcagtgttcccgtcatcgtggccc

SEQ ID NO: 553695 - DNA, 248 bp, Homo sapiens
  misc_feature (1)..(1): n is a, c, g, or t
nctgccaaagcgttacccaaaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggtactacgctttggca

SEQ ID NO: 553696 - DNA, 153 bp, Homo sapiens
  misc_feature (85)..(85): n is a, c, g, or t
tatgctgggtgactctagaggacctctggcacattgaggggttgacagctcttacatatagcttggtttttcggttcgtgagtangcggtggtaccagacattgattcatggggctcggcagtcaatgaggaaagtctcctcagaggagcatc

SEQ ID NO: 553697 - DNA, 596 bp, Homo sapiens
  misc_feature (262)..(262): n is a, c, g, or t
tggcacgaggggcaggccccaactggggcactgattgtcactgccgacatcaagaactcacccaagagtatgacctggaccaacagggttttgtgtcttgactcagtttgctcatcttcattgaggtccacccagggatggggagatgtttgctctagggggttctctgtatatgtggtgaaagctttgttcataacctgtggatctacatgggaagactacccatattaggagggtctggtaatgccagcaaccaatcagncaccacccagagtcacccggccaaaccctcagtgaacaaccaaaatatctctctgtagataccgtccaggctcaggcccatgtgacacctgctgtccacccaccggacctgttcagtaggtttctcccacacccacagccccaggctttcttctttgaaattgcaggcgatctaggtgtggtcttgagcagctatttcctggcaggggccccccggtttgccttcctagagcctgaccagtggattctctggcagatggacatggtgcatttcaaactggagccacatgcccccacccatcccccttggagttgtcgttgttggcaccaagaga

SEQ ID NO: 553698 - DNA, 685 bp, Homo sapiens
catttcgtttgtttctagacggtttggtgggggggtgaagctgcattcataccccttcctcttgtaattctcccctgctctgacagcaccccttttcatcgcagttggggtggcctatggactcgtgtgcatcttcctgcctgcgcttgccatgcaccccgcaagcgctgtggtctgtgcacccctggaaatcttgcagcaagctgcatatctagaagggtgggtctcctttgccctgctgcctgccttcgctccccgtgctttagaggtgtatgtatggagtggcttcatgctgcatctgtgttgccccgcgtgtatatcacatacaaatccacacacaacacaacaaagagaacatacaccacatagcaaaaaacaaaaaaataaacaaccataaaaagacaaaaaaaaaatataaaaataaaaatataaaacaaaaaaatcgaaaaataatagcattttaacagataaaaaatcacaataacaataactacaaacaatacacaaaattgtaagactaacaacaacgaaaaaaaaaaagcataacaacactacacaaaaatacatatacaaacaatctaatataaaaaaataagatacaaaaacacatgaaaaataaaaaacaactaaacacaaaatatctaaaaaagaaaaaaaacatagacaaaccaaataaatacaaaca

SEQ ID NO: 553699 - DNA, 818 bp, Homo sapiens
tggcttggtgtacccgagtatggatatgtgaccaccgtcgacatatggccgcactacgttataacctagacggactccaatgctaaactaatcgtcccaacaaattatattactaccactgacatgactttccaaaaaacacataatttgaatcaacacaaaccacccacagcctaaattattagcatcatccccctactattttttaaccaaatcaggaacaacctatttagctgttccccaactttcctccgacccctaacaaccccctcctaatactaactactgactcctaccctcacaatcatggcaagccagcgccacttatccagtgaaccactatcacgaaaaaaactctacctctctatactaatctccctacaaatctccttaattataacattcacagcacagaactaatcatatatgactatcttcttcgaaaccacacttatccccaccttggtatcattcacccgatgaggcaaccagcacaggaacgccctgaacgcaggcacatacttcctattctacagcctagtaaggctcccttcaccctactcatcgcaaataaattacactcgacgacaaacctaggctcactcaacattctactacctcatctcactgcccaaagaactaatcagactcctgcagcccaaccacttaatgtggtagcttaccacaaggagctttatatagctaaagacaccgtcttaccggactccattatgaactcattaacgcacactgtcgaagcccgcatcggctgggtctcttcgtactgcggcagtctataactaaggggagcaggccaa

SEQ ID NO: 553700 - DNA, 389 bp, Homo sapiens
tttcccctattttcacaaaaaagtaaaaaatacacacacacacacacacacgggaaacacaatcctcatctacatacatatgtatatgtaaataatttttagagagagcacactgctggcttccaaggcggcaaacttgtagaatgtttcctatatggcagcaagaaccacaggatccatgaaaacgctaaggctttctggtgggctgtgtcatagtgttcccgaggtgctttgacagaatgcagtggtatgatcgtaggccctcttatcaaggattcacattaatgtggccaatatgtgtcttcacttgggatgcaaacagcgtgaaaaccagaagagcatcggagtttacatcatctctgcggtttgacccaactatactatatcaa

SEQ ID NO: 553701 - DNA, 633 bp, Homo sapiens
ttacgcccctgcacaacaggagaggtaaagtctgtctataaaggccccgtttcctttaacggtcctgtgaccctgtttctcaagttctgacacttcgcacagggtttcctacatcttaacccaagggtatttgagcatcatattggccccatcttatataaaatgattccatgtctcttgagatcccattaaaatatttggggctgaaaagccacagtgagttaattactggtattaccaaaatgtgccccatctcctcgaaaatataaactagcgtaaagccaaagcacagcgtgggtacaatacaaaaaatactagctgtgctctctatatctctagtaaccaatggccacagtcacaataggccccccaagtgtcggcatggtggattcaatagaccaccctctaccaaaataagccaggcctctgtggaggagaactcgaccacagggcagggccaggaataatccatgagcctggtggtgctaaaaagaaagaaagtgctcaaaacaaaattccagaataaataatgttgttgggtccctagaacccctctataggtttgtccacacctgtaacacctagagccacacaatatatggtgataatattgctcaacacccaagactcact

SEQ ID NO: 553702 - DNA, 694 bp, Homo sapiens
gtgcacggacgaaccatggggtcccgcgcacttcgaggggatttatgaccacggtggggcacattacggccgattccatgagagtcctctatttcatatgtgccttccagaacatctcttgtggtattcactacttggctactgggtgcatggtgagtcacccctcgtcatgtctgcaggcacccgcaggctaatgtgagtcaggatgtctccataatcacgtctaatcggagtttggaggacgaccggggcccatgtcgtcttcagtgccagacaagattatgttacgggctgcagtcgcagaatggtgagatctgggcagctctcaaggtgtacgcaggaacagagagggcagaagcacatcgagtttggcgctatgaatacactggcagtaagaaagagtttccttgtgtggatggctacttatatgaccagaagcacatggaaaagcactgcggtgacccagatggaacctggtctgtgaccgagaaatggcttgcaatgctgagtccagcccctatttatgttgtggagtcctactgggatcggtgacttaggctacttttctgacaggctaggacgccgggctggtcgttgtgggccacaagcaagttacgcatgttttggtgtggcctagcagcggcgtttgcagccgattattagcaccttcatggctgctcgcttttttcttgcc

SEQ ID NO: 553703 - DNA, 560 bp, Homo sapiens
  misc_feature (348)..(348): n is a, c, g, or t
gactcagctctggaactaaggactggacctcgggtcccaagccccagtcttaggagctgctacctccttattaaagtgccaggggccctccaggacgggccccatccaacgccagccgtctcatctctgtcccactctgttagaaaacacctccttatattaagctaaaatctgtcttttccacagtttctttgattcggcctcttggatctttttaagatgctgtgatcaatgactcactcaaatcctctctcaccaatctcaccaccagcatcctcaaattgactgaatttgctgtctatttctaaggtcaaatttgcagccacttcctgatacctcccacggagnttggcgctggtcctccatgcaaggaggtgactgcggccaagggactcaccaaacgtggaggtttgccaaagttatgtcgaagagcctggatctcaaagtgagccgtctcccgggaaacagctcgagacgttcagattctgacatccgctccagtgcggcaggggggcttgagactctcagcacgttcatgtgagagaagaatgcccacgagc

SEQ ID NO: 553704 - DNA, 325 bp, Homo sapiens
  misc_feature (26)..(26): n is a, c, g, or t
  misc_feature (36)..(36): n is a, c, g, or t
cctctctcttcagtcttctctctctngtgtatcgtngttccctgtctgtctctgtctctgtctctctgtctctctctctctctctctctctctgtctgtctgtccgtctgtctgtctcggtctctggctctcgctatctcccgccctctcttttgtgcaaaagacgctcaagtacatctaatctaatcccttaccaaggcctgagttcttcatttgtgacatcccagatttgatctccctagagaatggggtacagaactggcgagttgatttcggggacttggatacctcatagaaactacatatgaataaaagatccaatcct

SEQ ID NO: 553705 - DNA, 414 bp, Homo sapiens
tccctgaacgcagcctgctgagtagctgggattgcaggtgtgcaccaccacgcctggcttacttttaaatttttagtagagattggatttcaccatgttggccaggatggtctcgaactcctgacctcgtgatctgcccactttggcctccctgagtgctgggattacaggcgtgaaccaccacacccggccttgatttcttaacgatgtggataatcagctatatgagcacagttttgggaataaaagcaaacttttgtttcccttttaatctttgatgcttctctgtcgtcggtcatctccaggaatcatggatgttactggactctgttctattccattggccagttttcctaaaccagaactaataccatactcttttttttttttttttttttttttggggaaaaaatt

SEQ ID NO: 553706 - DNA, 451 bp, Homo sapiens
ctgcgtgagtatcccgaggagcacccgtgtgctgaccgaggcccctgaccccaagactaacgcgagaagatagacccagatcatgtatgagacctatcaacaccccatgccatgtacgttgctatccaggctgtgctatccctgtacgcctctgcgcgtaccactggtatcgtgatggactccggtgacgggtcacccacaactgtgcccatctaacgaggggtatgccctctctttatgccatcctgcgtctggacctggttggccgggaccctgactgactaacctcatgaagattcctcaccgagcgcgactacagtttaacccaccaacggcctgaagcgggaaatcgtgcgtgacattacggagaagctgtgcaacggtcggcccctggactttcgagcaagagatggcccacggttggttaccagctccctccctggagaaagag

SEQ ID NO: 553707 - DNA, 883 bp, Homo sapiens
  misc_feature (642)..(642): n is a, c, g, or t
agcgggtgtcatgttagttaccttatagtgactgtgtaattagtgccagttaaatgtatgttaccaaaaataaatatatctaccccagactaaaatgtgagtagtactgttccgtataagtgagaatttaccttaattactagtcatgcctgcaagagaaaagcagtattgtgtttgtgatgaaatagaaagaagagtgtatttgggaaagtaaagtcaagataggaaaattcatgattttagattgcccgtctattgtacactatgttatctcgataacaagatagggcagtgatgacccctgtgtgcggccccatgtatctcagtacccacatgaagctgggctaagctataagtaggaatttggattgtcacacctgaagcaagttgacgacggactttgggagaagatgtgcataacctgtctcacctgtgactgttaaagcaatctggacgtcataaatatcaacagttagctcgtgtatctccttctcgttcaaattgtatcgcaaggtgtacacacttcgccctaagaatggcaggcacagcactagatttactactaagtgggggttgtgtcaacttgcaagtgctgctttcatttcgtgcattcccaggcatgtaacttataaatcttgtatntttcaattcctggttaacccaattggtttaaactttttatttaccccaaaattttaaccttaacaattaggcaaaacttatagaaggggcaagatatatatccccaaaaaaataaatatatagacaccattaaaaaagactttcttcaccagagccgcacatgagaaaatccggggcccaaataagaggggcccgtagaaatccctttcgaagcggggggggggcccccggtttacccaac

SEQ ID NO: 553708 - DNA, 893 bp, Homo sapiens
gccgctcccagccacagcctccctgcgcctcgctcatgctccaacatggcaaaaatctccatgccctacagagacttgagctggtgcatctgagtccctgatttgcttgtcttccagagcgtatgcttggaacaggcatggttactaaactacaactcatcatccacagcaccagccgttccctacagcattccatgacatcaccagcaactcagcttgccattccacaaatgaaccgatgaagtgaccactgcgctgtcctctgcaccggcactgcatgcaagacacactggcaccacccaaccactgctgacctggctcacgtctacgacttatctcacgacactcctctctacactctgactctgcgctgggcctacgccctactcgcgctttgcacactgcacctcacattcacatacaacgtgccatgatccccatatcaacaagcaacgccgcgacccatggacgtgaaccacacatatgtagaccacatggcgccctatacacaaacacacaacacacggacatataacacatactcaccaacgcccatctcaaacgggtacaactcaaattcatcacaaccatcgcacacaaccccagatcacccacatggaagccaacaacattacaaccaacccatcaacttgccacgggaccacacccaaccctggccccaacacaccagctacctcccacaggcacacacggccaccccccagccaacaacaacagcccgcttcaagacaccagcgaccacagaacaccaccacgcccgcgccgcgccgaacaccacgcgacgtcaccgacggccgacgaccccggcccagggcgcgcggccggagaccgcggcacacgcgcgacgcgcccgcgcgcgcgccaggccgacc

SEQ ID NO: 553709 - DNA, 409 bp, Homo sapiens
agcacagccgcctcttgtgctgtggacaccgccaccgcctgtgtcgccgccgcctctggacacggtgtatgattaggccacaatcttcaatgagtgaacatattcctcaattctgtggtggtcttggtcacacatttatggaggttctgaagggcagtggagattactggcaggcacacgacgaactctatgcagacaagggaactgtagaaactggatactggttcaccaagaagcccccatatagagagggtattctggacacacgaagtgttgaattgaaatccacagagcattttacaagagagtctgacctggatggggtcctcaatgcacattttttctgtgggcctcagaattaccggattgaagaattgctgcgtcttgtgaggagggtcttcacttatct

SEQ ID NO: 553710 - DNA, 312 bp, Homo sapiens
  misc_feature (1)..(1): n is a, c, g, or t
nagaggatcccccccgatgagggccaaccccaaactcaaagaacatgaataccattttcaggaatcattcggaactatcttagaggcggtttaccacacctaactaacctgttaaaattaagtgaacgtatctacttaaataaactcaagccttattatagcatcacttaagtggtttctgtctcttcccgtctatcatgattgcccaatagacattcaaatataagataggattttgaaattctaccactcaaaaacctctaatacagaatgatgttcaaacttcccagtcatatatttggccttatcgag

SEQ ID NO: 553711 - DNA, 234 bp, Homo sapiens
tagaggttcccgactagtccaacataccgactaagtcccacacacccagctaatttttttgtatttttagtagcagtggggtttcaccatggtgcccaggctggtcttgaactcctgggctcaagcgatcctcctacctcagcctcctgagtatcagggactacaggtgcatgccacgacacctggcttgtatgtatttattctgtctaattgatttcttcccttcccttcata

SEQ ID NO: 553712 - DNA, 271 bp, Homo sapiens
tattaagtggaactaccagatccatgttgtgattcttcccagtatcattcagcagcccttggcagttgcgaggcaagtcatcaatggggtatggaaattttccaggtgggtgtggttgaaggcagggaagaacgcgtttaggagcacattacaagaaggtgactgtaaggtccaggctgagcaggaaggtaaagcaagaaggaaacatgaggttgtgaagagaagtttagagggatgaggaggcaggagaggtgaacagttgcaggatgta

SEQ ID NO: 553713 - DNA, 136 bp, Homo sapiens
  misc_feature (1)..(1): n is a, c, g, or t
nttggatgcgctacctagcattatcaaccatgaaccttcccgtctacacttatcatcattcacaagttctaagttctactgtaatatcctatgaaatctgctgtacgcgacaatccaacttgtcctgggggatcct

SEQ ID NO: 553714 - DNA, 151 bp, Homo sapiens
  misc_feature (1)..(1): n is a, c, g, or t
nagtgactcgtgtagtatcccgctgagtcgtatccactgggctagaatgtcgttcgggatcatctcaagaacttgatgtgcaactcagtgcatccccgtcaggacagaagtgagtcagactcttctccagattctaaagccgagacacgaa

SEQ ID NO: 553715 - DNA, 766 bp, Homo sapiens
gggcccttccccccgttgtatctccggggaatttttttgcgagcccccaccttgaaagggccttttgcccaattcccgccccttctcctcgtagggaacattcggttttgagggcaaaattatggattcttcccccccggtcaacacccgcggaattaaacataacatttggcgccccaagaagtccctctacaaatcacgagtcgtcacatatgaggatagcgctcctcatatgtatcccacgatacaccgtccccttgggaagagtcttaaagccccaccaccaattaggttcccaatacatttttattttctacgataatcataacctgcggtttatctcacccgcatcgtgtgataagatatagcataatatgtattctcccccctcgagccacatctctctctctcctgagaccccttgtgaaaaaatagactcaatacaaattccttaggaaagattccactcctacgtcctctgcccacaaataactcttcttattcgtacacccaaacaccccccagattacagaatctctacccgagtataaatttaaaagatcatcttactacccccaaccagtttattagacgtggtttatcatgtgttcttcgtagttatgtgtcctttatgattaggtcccccctcccccaacaacttctatatctggtactatattattgccctccaccaccccagcatactaaacccccccaaaattttccccgggcccccaaaggggtacccacgggggtctttcaaaac

SEQ ID NO: 553716 - DNA, 576 bp, Homo sapiens
  misc_feature (38)..(38): n is a, c, g, or t
  misc_feature (62)..(62): n is a, c, g, or t
  misc_feature (154)..(154): n is a, c, g, or t
  misc_feature (176)..(176): n is a, c, g, or t
  misc_feature (178)..(178): n is a, c, g, or t
  misc_feature (263)..(263): n is a, c, g, or t
  misc_feature (312)..(312): n is a, c, g, or t
  misc_feature (430)..(430): n is a, c, g, or t
  misc_feature (572)..(572): n is a, c, g, or t
atttagtagttatttatattgtaagttattgaaaaggnattaagtagatggagaagaattanaggtaaaagaaaaaaaaagttggggtgagaaaaaagagagaagatggatgaagaaataaaagagagggaggaataagagtaaaaatggatantatgagaatgtagagttgggangnaaagttgggaaggaggatgagtgtgataatatggggagagatagaaataaggttggggattagaggaaaggggtatgtgggaggnggggtgggagtaagaaggggaggtgatgaggttgtggaagggggtgtgngagggttagttggggagatttgggtaaggtagaagtagaggtgatgagtaagtgtaggttaaaaatgtaagggaaaggaaagggtaaggaatggaagaagagggttgaaaatgtgaanaaagaaaagtgggaggggaaatttgggatagaatgagagaggtagggtaggttagtgtagagtgaatgattttgttgttggataaaaggaagtgaatgtgttggtaggtggggtggtataagtgttaaattaagaaaatggnaaga

SEQ ID NO: 553717 - DNA, 409 bp, Homo sapiens
ggtggtgcagtttgttattcaccaattacacatttattttcttgttgaatccgtggcttagataccaagctaccttggcagctgctattactaacatgcagaagagaacacacacctgtcctgaattcacaatattcagaatctgactgaggatgatgcacgggtctgttatgtgcagtgtggctgccgtccatacaatgttctgttttcggaggctgctcacagattcaattacggattccacatactagttgtaacttacagtggtgatcactatgtcctctttactttatttttgccactccctcctggcttgttgactctgtattcagagtgaaccatgtatttccggaataaacataaaccactctgcaactctactggggatccgcatgtctacacctggccc

SEQ ID NO: 553718 - DNA, 218 bp, Homo sapiens
tcaggctgagcagtcctacatgtgagcttcccagtagcggggaccacaggtaagcatcgtgacactcagtgaagttgtggtttttattttatttggtagagatggggcctcagtatggttgccacgcgctggaccttgcaactccgtgcactgcaacgggattttccgtgcccgtggccatcccaaagctatgggctattacacggcatgtagccact

SEQ ID NO: 553719 - DNA, 201 bp, Homo sapiens
  misc_feature (138)..(138): n is a, c, g, or t
atgatctagaggatcccgatttcattgaggaattgacaattatgcagaatgggacttgagagacatggatttggttgaagatgactcggacattttacatgctctgaagatggctgtggtagatatctatcattccanggttaaacggacagacaaagacgaacaaaaaattataagcagaccagggtattaatcaaccct

SEQ ID NO: 553720 - DNA, 583 bp, Homo sapiens
tctggaatttataaaggaaagagatttaattgacttacatttttgcagggctgggaaggcctcaggaaatttacaatcttgacggccggggaagcaaacatgtcctttttcacaaggcagcagcaaaaagtgcaaagtgaaggaggaaaaatcccctataaaaccatcaaatctcatgactactccctcactatcatgagaacagcttgggggaactacccccatgatctaatcacctcccatgaggtctctccccaacatgtagggattataatttgtattacaattcaagatgagatttgggtgaggacacagagccagactatatcattctacccctggtccctcccaaatctcctgtttttcacatttcaaaacacaattatgcctttccaacagttccccaaaagcttaactcattttagcattcattcaaaggtcaaaattcctaatcttggtttgacaaaaggaaagtccttttgtccaccaaccttgtaaaataaaagaaagtgtggttctttccagaaatataagggaagaccggcgccggttataatggccccctttccaatgggagaaaaat

SEQ ID NO: 553721 - DNA, 1248 bp, Homo sapiens
gagcgggttcacgatgccgcggcgtgcggtgaaaaggggaggcagcggccgataaatgctattagagcagccgccgcgaagccgtccccgaggccagccgtccttttccttcgccgcaatttccgtccgccgctgatcgggcgatgcggcgctgaggggacccgggcggagtcgcgccggagaacgcgccccgctcggaatcgccttcgcctcgtcgcgagtttccggcccttcaagttggctctgcccggtgcggccccctgttccatcctgggtcccgggtcatgtgaggcccgtcgtggaatcggccgtcacaggaatcatcgccgcggcacgtggcgtgctctgagggtgtccctgcttggccttttgaccacagatccccccggagaatgggagaccggtgccctctggaaaagggcgccgcgacagggatgaaagatgcacccacaatcgcccacgataatccgtggggacggaaacgtgagtgagacaacgggccgcaacgctgggatgaggcgaccctcccaagagggaagagcaccacgcacctgaaaagccacgagaccccctgtggcagtggacagaacccactggggagaccacaccgagacgcacggaaaggcggcaaggcgcacaggtaccaggtgcacacatgtggggagggcacgccaccagtggtgaaagcacacgaccactgcgtaggcaaactatgaacaacatcaccaaaaagggcagggccaccctcgtggtcgtcatacacggcgacctcgtcgtcacacaagtcctgagggtgccaggacacaaaacaacaacacagtcgcaccgcagcaccagtgtggaaaaacagcgaaaacgccacccggtgattgaccagtcaacacgcccgtatgcaggagagtcaacccccgccccagtgttgcagcgattggggcaaccacgacaagagaaaagagccaccaagcgtaggtgagggcacgcacctggtggacataatattgcgagccgcaacaaatagttggtgacgatagatgacaccggcagtcagacaaacaagggcaactaacaagtgacacgccacccgctctagtactacatggcaaacaacgtggagtagagcacgcggtacagatgcaccggtgcccgtacgggaacacacaggggtgagcacccccatctttcgacgaggacatggatgtcacccctagtgcagtggagttgagcaagacacagcacggcggcggaaca

SEQ ID NO: 553722 - DNA, 520 bp, Homo sapiens
ggtccgcccctcggagtcatggtactctcgcctttgccgatccgccgtccgtttgacagcctgagcggcaacgtcaccgagtggactgatgatatccgctgccgctcgcttgctccgacccacggcctccggctgtgtgcaggggtcgagcttcgcgaggcgcatcgatgccccctggtggccggtcattcccctcgcagtcggttcggcgcgcgcccaggcgaccatcggccgtgactgggtgcggtcagtgcggtccgagatcgcgagttctgttgtgtgaggctgagttatgtgcctcgaggaggcagagaggatgcgccactcactcagccgctgaacgttccactcagttccgaggcagggcaattagtacacacaaggctgttgatcgatcggtggatgaaaactctagaggcgactcatactttctaccagatgaagctgcgatgatggacatccctagggatgcatcaccgttgctgggctgaaccgcatggcaccccactgtggaaatccg

SEQ ID NO: 553723 - DNA, 959 bp, Homo sapiens
agcgttggggagtggatgttgctagaacccacgcggaggaagcgaagagacgcaggcagtgctgcggttacccaagcggccacccgggcctcagggaccccttccccgagagacggcaccattgacccaggcaaagctctccgtggctaacaaggcccctggagaccgaggggcagcagcaggtgcatggcgagaagaaggaggctccagcagtgccctctagccccaccctcctatgaggaagccacctctgcgggcaggggatgaacggcacggtgccttccccctaagcccccacctgcggtgcctctcctccctagctgggcctatgtgtgaccccagcaggcagctcgagctatgacaacggtttccccaccggagatctatgagctcttcaccactttctagctggtgagtgacctgaacagttcgtcgagtctttgtcagatagcggtcctacaccatcctgcgtgattcagctcgctggtgaccttggcttgtcgtggctctctttcctttctgtgaccctgtctatgactatgtccaggccagcccaggctggtactgggcatcctatgctgtgttctttgcaacctacctgaccctggcttgctgttctggtacccaggagggcgttcccctggtaccctgattctcctgtaccgtctttacccctgtccatgggcctacctcactgggatgctgtccagctagctacaataacacctccgggctgctgtgcctgggcatcacggccttgtctgcctctcagtcaccgtcttcagcttcccggaaccagttcgactttctcctcctggcagggcgtgcccctttcgcgcttcccatgactcttttcttcagggactcatgcctggccatcctcctaccttccatatgttgcccgggtccctgcgttatgccgcctggagcggggggtttcttgtcctgggctgaacccg

SEQ ID NO: 553724 - DNA, 324 bp, Homo sapiens
gaggtagtgggccaacggatcttgcccctgcgaaggaccacgggtctcggcaatctgcccctgtaccaggcgggagaacgttcgggcctgcaacttaacgaagtcgacctcccaactccgctcgggccagggaagccttcgagaacaggtagtcgcccaccatgatggccaccgagttgccccaccgcaggttcgctgaaggggcaccgcgacgcctagacgcctcgtccataacgtcatcgtgatacagcgaggcaacgtgggtgggttccatgacaacagcggcacgcaccaggtcggcgtgtcgacgcggccgcgaattta

SEQ ID NO: 553725 - DNA, 497 bp, Homo sapiens
  misc_feature (497)..(497): n is a, c, g, or t
aggctaggtacgaggccgggtgttaatcggccgagggtgaaacccgtctctactaaaaatagaaattagccgggtgtggtggcacgcacctgtagtcccagctacttgggagcctgaggcaggagaatcgcattgaacctgggaagtggaggttgagtgagccgggaccgtgccattgtactccagcctgggtgacagagcgagattccgtctcaaaaaaaaaaaaaaaaagcccacctgaaagcctgtctcttcccactttgtgtgggccctcccaggtggggattatcagcgcattagttggtttttcctcataggttgccttttccccttattttcaaggggttggcttcttgacgtggcgtggttttattttattcttataaattttcggtttgggtttacaacaattagcagttataaaagagaccaaggcccagagaggctattccagcgccaaatttttggtcccactaactctggggtacaattatttn

SEQ ID NO: 553726 - DNA, 537 bp, Homo sapiens
ctatgcgtccccagtgtctcttgtacacatttttatggacatgtgtacccaatgtttagctcccacttttaagtgagaacatgtggtatgtggttttctgtttgtgcactagttcccttaggataatggtttccagctgcactcatgtggctgcaaaggacatgatttccctccttttcacggctgcgtagtattccgtagtatatatacaccacatttctttatccaagtcaccattgatgagcactagggttgattctgtgtctttgctattgcagatagtgcggtaatgaacatacgggcgcagtgccgtagaacgatttattttcctttgggtatacacccagcagtgggattgctgggtcaaatgctagttgctttctcagttctttgagaaatctacaaagtgtgccccacagtgggtgaactcgtttacattcccaccaacagcgcataagcgttcctaagcgttccctttactccatagccttgccaacatgggtttatttttattttttatttattttttttgggtgg

SEQ ID NO: 553727 - DNA, 124 bp, Homo sapiens
cgtaggtgatcctccgatctcggctccaagtagcggggactaccggcatgcaacactgtgcctggctcattttgtatttttagtagatacggggtttggccatgttgcccaggcgggtctcgaa

SEQ ID NO: 553728 - DNA, 1310 bp, Homo sapiens
  misc_feature (1040)..(1040): n is a, c, g, or t
  misc_feature (1310)..(1310): n is a, c, g, or t
cgtgacgcgtgggttcttgtttattgtgtaacataaaatagaaactaactttatttctctggaggaagcagagtactgaactgccggagcagcaacttcgaccaacaggacgtggtgtggaaaaccatggaaccgcgtggggtgaatggggtggaagaggaagcacatgatgtccgctccagtggcggctgcccctgtggtctccttccagcccgtggaggccatggggacccgtgggtccccgccagagaaagtgggtcgtggcacccgttatcatccgacatgccgtgagccacgcatcagggctaatatccaggcacaagaatccgtgaggccagccaagtcccagttctaagtccagggtaaggcgacacaagtcacattctgcgccgaaacgcccaagctgctgccaggggccccctggtgaaaaagggccagatccatagagaggtcccacacgggtagccaggtccaaccatctccacaggatggccatacaacattcccaggcagtggcacaggtccacgccagggatattccatcaccaaggtcatgggacaacccaagggcaagggcctgagaggggtacatacgtcacagacacaaaagggccacgaccatggagcacaggggccaagacggcagggaccatacaccaagacgacctgcatggggagcagagcactcaaagccatgtacatatcacccgggaccactatccacaatctagggcaggggcgcaccagggagagtgagaccaaacgctgttggccgggacacggccgcatgcgctgcaaagggaggcgagatggggaccacgcgagaagaggactccccaaagagctcaccagcaaaccatgggtacctttgcgagcacatccccaaggaggaggcagaagagaaagaagcggagagaccaaccacgacatcgggatcgagagggattttcccccgaaacctgggtgggaagaagggacaggagcacagggaaacacatcaagagaaggcgcccacctagagacatccaaaagaaggacanatccaacagacacggagcaagcggaaatggacacagaagaagccaagaaaagggcagacagatggccgtagcaccaaggacacacagcgaagaacgtaccaacgacacaataaggaagaccaccaggaggggaaaaaccacaccagaaaaagtgaggctagcaagaatctggcgaaacaacagcaagaaagagaagaagacgcacataccacacagcacgcgcaaccagcgaatacaaacgaaggagaaagaaaaacagccaacctacgn

SEQ ID NO: 553729 - DNA, 937 bp, Homo sapiens
  misc_feature (911)..(911): n is a, c, g, or t
cgtccagcttaggttcctttcttttctgggaacgttcaagcgattctcctgcctcagccccctgagtagctgggattacaggcacgcgccaccactcccagtttacaccccgccactcctgagcaccgcacaccggcttcctcccagtccctcatctgagaactcatgaagccacttggaatccctctctgctttgcctggctcattccatgtcaatttcagatcttcacttcaggtcagctccaaggaggctatccttgcccatcttcctaaaatagagctctcaaaacctggctgttttccttcagagacactggcctccaattgctccggtagattgcaaatgacctgctttctttctgttcccgggcgtttggacccctgtcttggaccgctgtcggatagtaaatcccaagtaaggtacctgccgtcggcagatttgagctttcttcttggacacctaatacccagagtcctccaggctccggtagattgcaaatgacctgctttctttctgttcccgggcggcatcggacccgtcggagagtaaatcccaagtaaggtacctgccgttggcagatttgagctttcttcttggacacctaatacccacagtcctccaggctccggtagattgcaaatgacctgctttctttctgttcccgggtggcatcgacccgtcggagagtaaatcccaagtaaggtacctgccgttggcagatttgagctttcttcttggacacctaatacccacagtcctccagtaaatcccaagcaaggtacctgccgtcagcagatttgagctttcttcttggacacctaatacccacagtcctccaggctccggtagattgcaaatgacctgctttctttctgttcccgggctgcgttcggacccctgtcggatagtnactcccaagtaaggtacctgccgtcg

SEQ ID NO: 553730 - DNA, 345 bp, Homo sapiens
ttatccaataaggcacaaaacaaactcagcaatgaaacgaatgcctaccgaacgcgataattctgcagctatgtccgtagtcttcttttcctcgtgcaaattctgtgtccagactaagtcttcgaacacggcgcgcgagcgcttaaagccggtcgtgtagacgttcgccaggatgttcgagatgacatccagctgcgattgctgggcgtccatcccggtcttggaaatccacagggagcgaatcatgttcgagtccttggttgattcaaatcaggccagccttcaggcgtggcgcagcagttcattggccgactgggcgttcgtgtcgctggcctacagcacatg

SEQ ID NO: 553731 - DNA, 415 bp, Homo sapiens
  misc_feature (188)..(188): n is a, c, g, or t
atcgtctctagaagtggtataaatgtggtatctcactcagtacaacgtgccactgggcggttcatctcccccaggtgctctgcaaactccgttcttcatagcgctggctttctacatcacaggtgcttagctgaagtaatgacgggttaacgaagtcaactatccacggtttatagtccatttccatnctaaactccttgtgcttctgaagaagatgtttaacttgagaatgaggattgggtgaatgcgcgggagtctccattggaagttggatgctccacatggtccatccagctaatcatttcggtgatggcttaacgagacggcaatttctccattggaagcgggtgaagtttttctggaatatcgggaagttgagttatgagcattgtccatttttgttcaaactgtgcat

SEQ ID NO: 553732 - DNA, 519 bp, Homo sapiens
agccaaactcatctatttatcaggaacccttcttatgatagaaacccactcccatgaaaacaggattaatctgtttatgaggacagagtcctcattacctcatcacttcttaaaggtctcacttctcagtactgctgcattggggattaggtttccaacacatgaacttcggaggacacattcaagccgtagcattcttccttgactcccaaaatccatgtccttctcatgtctaaaatagattaattccatcccaatagccccaaagtcttgactcgttccagcaccaactcaaaattccaaagtccagagtcccatttgaatcagacaggagagactccaggtgcaattcatcctgaggcaaatttctctccagatgttagcctaagaaaatagcaaattactttcttccaaaatacaatggtgggacaggcataggatagacattcccattccaaaagggagaaataagcaagaagaaaggggtaactggtcccaagtaagtccaaaatccaacag

SEQ ID NO: 553733 - DNA, 695 bp, Homo sapiens
gcacgagtccaggtcctcaaatgctcatgacagatagttcagttgatggcatagcctccgagaaacagaagggcactctgaatctactttctgtaaaatatcagttcaaaaccatcagctcagggcttgtatatgcaggctgcttgtctggtattctactaaacacctatcttttctgcaaagttgaccagctttgctttgtgggcaaaaggtattcatttcaaagagctaagacacaaattgatgccatctaaagtgaattccttagagaaatccagtagtgatagcagctcccattccaggcatctagggtgatggtaagtagctcaatccacaggaaacacttagcattattaaaaactggtgatcagagacttccttccagagtattatttaagcctgctgttgttccaaaaattgtcctgcttctaaaatccttaactgccccttttttttgtatgaccaatatttaaaacacatctggtcttgtacaaaattaaattgtgcagacaccttgcttaggaaaaaagaaccttaaagttggggaagccaagaacgacttcctgttttcccctgggaactggtgtaaacatcacctagggagtggtgttaagtctggggcaaaaggcttttttatcccaccccgaatttaaaaattgactggacaaaggtttatttttttttccgtccttaat

SEQ ID NO: 553734 - DNA, 573 bp, Homo sapiens
  misc_feature (412)..(412): n is a, c, g, or t
tttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttncaatggctaatgatgttgagtatctttttgtgtgctaaattgccatctatgtatcctcttccggggaaagacttcatggctttttggctattttcttatttaaggcaattgttcctttttcctattgaattttgagaggtttttttatttttcctaaataa

SEQ ID NO: 553735 - DNA, 1101 bp, Homo sapiens
ggagagaactagtctcgagttttgtttttttgttttttcccctggggtaacgtggtcccgggggctcaggtttagtgggatcaattggagttatagtagtttgcgctatggatgggtgagagttctatagcgagtgttacggctctcgggaggtgtggggttctcgtgctctccggaggttcgccaccaacgcgaaattttaaagtgcggggtgtggggatagtgttgtagcgagacactggggggtgttgggtacaggggatacgtggtggggcgatttaattacgagtttaaaaggcctccaaatagggggtactacgaacggcacttggggctggtggctcatggcgcccgcgccttctcttccgcgggcgcggtcgtcacaagttacacacggctggtgtgtaaaagtgtacaagaagacacggtctggaacccctctcgcgtgggaggcactattgctatacacaggggtccctcttattataaaggggatacgcaatgtggacttttatggctaacctctttggcacgcggtataggggggatacccgggggcgcgcgtgataaacacttggtgtgtccacgcgggggccaggggggcgggggctctccatacaaatacgcgggaggagatgcggcctaaagaggggtgagaatgggaaaggggggaaaaaaacagggggcagggggataaagagaatttacgagcccacgacagatcacccagtataaacacactgttatgcaaagaccagcctgtggccacatcaaagtgagaaacgccattagcccagagagagatcgcgcggcattgcagaacaaaggagaaacgcggggacaaaataaaacgggaaagtgggatcgagggaaaagaaagggaagaaacactgagagagagccgtgatacaacaggggagcacagaacccgacgttgctattcaaccaccacagagcaccacagcgccgacaatagcacggaaagggaaaacaacgacgccacacgagtagtaaccaatacatatatcaaaacacgcgtgaggcacccaccaaccatacaagagcgagcgaaacacaaaaccggaggccacaaccacgagg

SEQ ID NO: 553736 - DNA, 476 bp, Homo sapiens
  misc_feature (52)..(52): n is a, c, g, or t
  misc_feature (120)..(120): n is a, c, g, or t
  misc_feature (184)..(184): n is a, c, g, or t
  misc_feature (189)..(189): n is a, c, g, or t
  misc_feature (213)..(213): n is a, c, g, or t
  misc_feature (282)..(282): n is a, c, g, or t
  misc_feature (365)..(365): n is a, c, g, or t
ggctgcgacatctgtcaccccattgatcgccagggttgattcggctgatctnggctggctaggcgggtgtccccttcctccctcacccgctccatgtgcgtccctccccgaagctgcgcnctcggtcgaagaggacgaccatcccccgatagagaaggaccggtcttcggtcaagggtgtcccncagancaggtgattgctggcttcaacctncttcggaggaacagcgaggcctggcatccaaagcagctgagttggagatggagttgaatgaagcacagnctaagtgatcgatacactgaaggaaggtaagatgaaactccgtaagtgctaccgcatggtttggaaggagttcttggtggaancgaacttgtcaaaagaggttgcttgccccgcttttggaagaacaacaaaggagcaagatacagaagatcatttgagacactgacacagcagcttcaggcaaagggaaaaga

SEQ ID NO: 553737 - DNA, 505 bp, Homo sapiens
atgaggctccctccctccctgcctactcccccgactctcactaccagctgttcctccccctgctcccaggcagtgtatcggcgatggttgaactgggctggttgctccatcattgtcctgctgggccagagcgtcgtttgacctgttcgacttctgttaccacctgctaaaagtgcagaggcaggacgggaaggctgaaatcattaagaatgtgcccctgaagaagatggcgaccggatcaggaagtatcagatacttgaaccaaatgaggttaagaccatcatgaacaaatacatgaagtccgctggagaccagacagtaccactgtggagcatgtgcgcatgctataccagccacccatccaccagtccttggacaacactatgcataagcagaagatcctgcaagaccctaatctgggaggaggacagagaagccaggagagagaaagccacagcaccgcctgacatcaggctacaccctggacaacgagtgcgatggacca

SEQ ID NO: 553738 - DNA, 593 bp, Homo sapiens
tggactcccaaatctcttttatggggggaaatgggcctctgtgggggtctcactgcccggtttgttcattggcactgtttcccgagttcctggggcttcatcacttcgggcagttctggcgggctggaaaacggttcgatgcacagggcctcaaaggttgtcatctgcccgaaaggccaggattgttgggttgttgttggtaaagctgcgggaccgtcaccgccaccctgagttgttattgttgtgcactgactgtggcaccaacctgaaacagaagggccatttcttgtggtggaggactcaattctacgtggtgagaagcttgcccgggagcgagttcacaccaccgtgagggtttatgaaggtggctcacgtcgtgtttccccaagttgagccagcagattctgaccacgtgttctccagcaggcctcgtgcgtgcagtctttttctctcagggttctgggccctctcctctcttgaaagttctctgctaaacttgggttatccctctgtttgtaaacactttgagtcccgctccctgcctgggttaattggactcacaccagttgtgcgatgcccgtttttacaattag

SEQ ID NO: 553739 - DNA, 171 bp, Homo sapiens
gcgctgtctttaaggcagggaacattcggcaagatgggatcgaccgcaggcgtgaaacgtttcagtttgttgcggcaaggataaagcgccttctcattttgagaaagcgtaattagagagatgcatcatttcagatctggtaacagtgacagaacgtcgctgcaggaatgc

SEQ ID NO: 553740 - DNA, 215 bp, Homo sapiens
ctagaggatcctcgacagacaccgactctgagggtgacagacgcgcgtaggttgcaagtaacggtcgttgcgtatcaccgacagacattagtacgaggcactgcaggcacgtaccgaaaggtattcgcgcgatgtccttggatcgagtgcatgcacaactgggacacgcgtattgttgggcaaccgggtggtgacaacgggtacctgagctcgta

SEQ ID NO: 553741 - DNA, 680 bp, Homo sapiens
  misc_feature (28)..(28): n is a, c, g, or t
  misc_feature (55)..(55): n is a, c, g, or t
  misc_feature (118)..(118): n is a, c, g, or t
  misc_feature (152)..(153): n is a, c, g, or t
  misc_feature (174)..(175): n is a, c, g, or t
  misc_feature (204)..(204): n is a, c, g, or t
  misc_feature (290)..(290): n is a, c, g, or t
  misc_feature (309)..(309): n is a, c, g, or t
  misc_feature (316)..(316): n is a, c, g, or t
  misc_feature (324)..(324): n is a, c, g, or t
  misc_feature (331)..(331): n is a, c, g, or t
  misc_feature (334)..(334): n is a, c, g, or t
  misc_feature (350)..(350): n is a, c, g, or t
  misc_feature (363)..(363): n is a, c, g, or t
  misc_feature (390)..(390): n is a, c, g, or t
aacttgaaattatagggaactatgaganacaatcactttgccaagccacctatanatactatgaataattacttgaaatcaggttgtgtagaatctatagttctcttaaaaccaagtngtgattctcaatattgcatgtgtataccatatannaggatgtagatctaacgtatnntagtagcatacttactacctgcagattanattcatttctcaagtactctaaagaacttcatatagaacatactgtatgagatgctataacttatcacaaaagagatattagcatntatagaattaagataatanaatgtangagctaanaaccatnatntgccattcatatatanatataacataganacagttatgtggataatatgaaaatanaattgtataggtgaactattcacttgaagacactcactgtttctccttctgagtaactaaccattatagctttttattgatgaaacatcattatctcacatctgaaattctttggctggaatgttttagtaacataagacactcctgtatataacaactctgacagaacagaggagttgcaaaataaaaaaagtaggagtcatattttaaagcatttgataaatttttaaataaattttttaaaatgtagagccaatctatcaccataaatgctcgtgccgaattcctgc

SEQ ID NO: 553742 - DNA, 118 bp, Homo sapiens
cacgaggcgggcttgtcctgagcctgtactgtcctcgcctgcacactcacctgtgcacgcatccccgcacactcttgactggcagggcggtcacgtcacctgcgggctggctccgagt

SEQ ID NO: 553743 - DNA, 738 bp, Homo sapiens
tccggcgagcccccgagcccggcggcaggcgagccaggcagcagcggcgcggacgcggccgccggctccagtgcagaccccgcgtgaaccaggaatccgtgccgcaagagcgagccgtctgccccggggcgcagacggagctattccagcaccagcagcaggtatctcgaggtaacgaagagagacacgtacatctcatgattgaaattattccagtgccagatctgtggagactagtcatcaggagatccattatggtgtcattacatgtgaaggctgcaagggctttttcaggagaagtcagcaagagcaaggccgacctactcctgtcctcgctcagaagaactgtttgattgatcgaaccaggtagaagaccgtggccaacactggtcgagttacagaacgatgccttgccgtagggatgtctcgtagatgctgtagacatttggccgaagtgtcgaagggagccgagagacgagcttgtatgcagagagtacagaaacgccggagtgcagcagcagtagcggcgagcaccagtagcagcctggagaggctgagccgatgacgcgcaactacaacgatctcggcaacgggggtgacggaacttcgcgacgacctcaggaactacgtgacgggcacaccctggggggagtaaggccgactcgccgcaggagttctccggggcatgggcctgccagacggcaggctggatcaggaataagcgaccattgggatgcc

SEQ ID NO: 553744 - DNA, 184 bp, Homo sapiens
aggaagctagggttagaggcaaccgtgagctagaacccgaacgtggtcggttggagcaatatgtccctccgagcacattgggaacctgagtatctgatgaaagggtaccacagaacccagataccagcatatcaatcaagactggacactggtaacagtatgactaaatatactcggaggctcg

SEQ ID NO: 553745 - DNA, 408 bp, Homo sapiens
cacgtgcatcatataggaatcattgtcttatgcgccgaattgagacctttggaatgagtggctctgttatttccttttcttcccccttgtctgtcctccatatcccattcagtctaagccatttattttattttttttagaccgagttttgctcttgttgcccaggctggagtgcaatggcgtaatctcggctcactgcaacttccacctcccaggttcaagtgattctcctgcgtcagcctcccaagtagctgggattacaggcacctgccaccatgcccagctaattttgcgcatttttagtagagacggggtttcaccatgttggacaggatggtctcgaactcctgacctcaggtgattccaaccgcctcagcctcgcaaagtgctggtattacaggcatgagc

SEQ ID NO: 553746 - DNA, 948 bp, Homo sapiens
  misc_feature (160)..(160): n is a, c, g, or t
  misc_feature (190)..(190): n is a, c, g, or t
  misc_feature (230)..(230): n is a, c, g, or t
  misc_feature (235)..(235): n is a, c, g, or t
  misc_feature (250)..(250): n is a, c, g, or t
  misc_feature (277)..(277): n is a, c, g, or t
  misc_feature (369)..(369): n is a, c, g, or t
  misc_feature (631)..(631): n is a, c, g, or t
  misc_feature (697)..(697): n is a, c, g, or t
  misc_feature (756)..(756): n is a, c, g, or t
  misc_feature (776)..(776): n is a, c, g, or t
  misc_feature (790)..(790): n is a, c, g, or t
  misc_feature (850)..(850): n is a, c, g, or t
  misc_feature (863)..(863): n is a, c, g, or t
  misc_feature (879)..(879): n is a, c, g, or t
  misc_feature (893)..(893): n is a, c, g, or t
gcgcgcgaggttcccctcgtttggcggcggcggcggcttctttgtttcgtgaagagaagcgagacgcccattctgcccccggccccgcgcggaggggcgggggaggcgccgggaagtcgacggcgccggcggctcctgaggtggccactgtctgcatgcntcccgtggaagatgtccactccagacccancccctgggcggaactcctctggccaggtccttccccgggnccctnggcccttcccctggnagccgatgctgggcccttagccctggngtccctcgccgggctccgcccacagcatgatggggcccagcccagggccgccctcagcaggacaccccgatccccacccaggggcctggagnggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggccgtcttcggggccccagatgtcttccgggcaggangtgccccgctgggatggtgctgtacccccaggccttgggggcagcagaaccgggggcccaaccccnattttaaccagaaaccagctgcaaccagctccagagctacagatcatgggccttacaanatgctgggccaagggggcancccccttccccgcnccactagccaataggcggtgcaaggcaaacggccgctagcccggggtagcaaccacaaanagccaaagctaantaccacactacggtcntccgccaaaaagtnaccggccctgggccctgggcccttggccccggccccggttccccggccccggccc

SEQ ID NO: 553747 - DNA, 411 bp, Homo sapiens
  misc_feature (40)..(40): n is a, c, g, or t
  misc_feature (279)..(279): n is a, c, g, or t
  misc_feature (376)..(376): n is a, c, g, or t
gagactgggtctcactctgtcacctagactgcagcccaanggcacaaacatgactgactgcggcctcaaactcctgggcacaatcaatcctcccacctcagcctcctgagaagctaggactacaggtgtataccaccatacgcagctaattttaaaaaaacttttttagagacagggtctcactatgttggccatgctggttcttgaactcctgggccttaagcgattctcccacctcagtctcccaaagtgctgggattacaaacgtgaggacactgncacccagccaaatggctatctttatagtgggatagtctttcatacatttattaaacttcttggaggaggcccttcattattattaaatgactctttncacctgaccatttaaaatggcctttaattttggaa

SEQ ID NO: 553748 - DNA, 410 bp, Homo sapiens
  misc_feature (17)..(17): n is a, c, g, or t
  misc_feature (29)..(29): n is a, c, g, or t
  misc_feature (85)..(85): n is a, c, g, or t
aacggaaaacttcggcntccccaaggttnaaagctattctcctgcctaagcctcccctagtaagctggaattgcaggcatgtgcnacaatgcttggctaattttgtatttttaagtagagacagggtttctccatgttggtcaggctggtctcgaactcccaacctcaggtgatccgcccacctcggcctcccaaagtgctcggattacaggcgtgagccaccgcgcccagccattcccatgattttaaatagcatctatagctgacaactcccaaatcagatgtctggccctgcagcttccccttttgccaactgactgctctccatctccacctagatatctgggaatctgggaagcatctcagactaagcatgcataaagctatgtactactcctctagcagccttc

SEQ ID NO: 553749 - DNA, 267 bp, Homo sapiens
aaaaagcccttttttcccttttcccccctgggaaaaaaatgggggggaaagggtttttttttaataaataatccaacctggtccccttttccggaaaagggccaccttttggtgttcccggggaaccccttttgggcctccccttttacccggtttgggggcccccccctttttggggtgtttttgcccccggttttgtttttgccaaaacgttttcccctttttaattagggttcccctttttttaattttaaattaattgggcca

SEQ ID NO: 553750 - DNA, 976 bp, Homo sapiens
ggtcgccatcatcccgccaatcagtggaggataatgcatctgagccttctgggaaagatgtggacgatgtccaggagaaacctaaagacataatacagttcactgccgagaagctctctgtgggggaagtgtcacagttggtggtgtcccctctgtgtggtgcagtgtctctcttgtagggactacaagaaataactttgaaggcaagaaagtcattagcttagaatatgaagcgtatgtaccgatggcagaaaatgaaatcagaaaaattgtaatgacattagacagaaatggcccgtgagacacatagcagtattccatcggcttggttggttccagtgtcagaagcaagcacagttatgctgtgtcttcagctcacagagccgcgtccctcgaagccgtgagctacgccattgattctttaaaagccaaggtgcccatatggaaaaaggaaatatatgaagaatcaacctcatcttggaaaagaaacaaagagtgcttctgggcagctggtgactagtcaagtgtggtgcgctaagtctaaaatttgataatctcatagctaacacaaacggagaatagccaagtgcatgagtgtgtgagatgaggggctgctaggacttaaagatggggagaaagggcttgactttaacctgtgataagatgtctgcaattagactcagcttctgtgactaactccttaataaccagctcgcaggtgcgctgcagccttcctttacttcagctgtctcaggagaacttgctgtccagagtgtactgggagcatcatatcagctgtgttccaaagatgggatcgaaatccttctaggacgggactcatatctggttaacgttaattaaaaaaaggggcgcaaatacccgggacattcacactctgtaaaggcataggaataaagaggggcacaggggaagacggtgtgtgactctcgtgtgaacacacacggaaaatagggcg

SEQ ID NO: 553751 - DNA, 262 bp, Homo sapiens
tttttcatgcgtcatgagatacgtgccgacacgctgcccttcggcctcgaagcgtttcgcgaggcgtttgcgccgatcgctgaagagttttcgatgacctggcatatcaccgacaccgagcagaaaaaacgtgtcgtgctgatggccagccgtgaatcccactgcctggccgacttgctgcaccgttggcacagcgatgagctggactgtgagatcgcctgtgtgatttccaaccatgatgacctgcgcagcatggtcgaat

SEQ ID NO: 553752 - DNA, 216 bp, Homo sapiens
gtcgctctagacggtccccggcgggtctcttctaccttccgggcgtgtctggaggagattcagagcaaactccagattctggcagcctcggtctggtggatgggcataaacttcagtgaactgggcggcaagtgcggcttcctcttccttcacttgggtggcaggagatgggagccgggctctctggctcacgtggctgctccttccattctccaa

SEQ ID NO: 553753 - DNA, 341 bp, Homo sapiens
  misc_feature (333)..(333): n is a, c, g, or t
tggaggtcaaaaggacatgttgcattaagcacatgatttacagctgtgatggtttagcgtttatatggaacatgttttgctacttgagataatgggagtaggagcctaggaaggctagaagcaaggagccagcaaggctagacacattccagaggacattatgtcagatatgcaagccctgcctcagtttctcccaacactcagctttttcctaacatgccccccttcttcttttttgttaaaaggaggaaagtatttatttactaggctattcattaggcaagggtgatttgcagggctgtgcaggcccctttaatttgcccggtttgggtngatcccag

SEQ ID NO: 553754 - DNA, 100 bp, Homo sapiens
gaagcgctagcagtatgagaccgagaaggtgctggctgctgtctacaaggctctgagtgaccaccacatctacctggaccagaaccccactttggaccga

SEQ ID NO: 553755 - DNA, 487 bp, Homo sapiens
  misc_feature (19)..(19): n is a, c, g, or t
caagagaagaaagtagaanaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaac

SEQ ID NO: 553756 - DNA, 140 bp, Homo sapiens
ctcgtggtaccgggcgactgacgtgtggggacggaactggggtgggtttcgtactgttcacacctgtacttttactttttaccgtctgttacgactactggtggacgtacgtgatgacttgacggatggacgtacgactt

SEQ ID NO: 553757 - DNA, 473 bp, Homo sapiens
gctgaggaggagaatcgtttgaacccaggaggtggaggatcgtttgaacccaggaggtggaggttacaatgaaccaagatcgcgccactgcactccagcctgggcgacagagagatatcctttctcaaaaaaagaaaaaagaaagaaaagttccatgtcaccaaactgaaactaagttgttatctgaccttaggagaaatcagaaaagagacataacagccaatttcccaaggagaatcgcttgaacgcaggagttcaggactagcctggccaatgtggtgacactccatctctactaaaaatacaaaaaaaaaaaaaaaagaaaaagccaggcgtggtggcacacgcctgtaatcccagcttcttgggagactgaggcaggagatgcgctagagcccaggaggtggaggttgcagtgagccaagattgtgccagtgcactccagcctgggtgacagagtgagactctgtgtc

SEQ ID NO: 553758 - DNA, 3142 bp, Homo sapiens
agcgggtcctcacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtgtgggtcggcgtccgtcgggcgttggcaaatggggctctgcgagggtccgcgcagggcgccagggcgcgcggcgacctcgctcctccgcgggcccggggcattcggccgattgcctcttgaccgacgatgcagcccggccgagtgggccacaaggcctgagtcatgaagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553759 - DNA, 1029 bp, Homo sapiens
  misc_feature (142)..(142): n is a, c, g, or t
  misc_feature (149)..(149): n is a, c, g, or t
  misc_feature (211)..(211): n is a, c, g, or t
  misc_feature (214)..(214): n is a, c, g, or t
  misc_feature (218)..(218): n is a, c, g, or t
  misc_feature (231)..(231): n is a, c, g, or t
  misc_feature (240)..(240): n is a, c, g, or t
  misc_feature (263)..(263): n is a, c, g, or t
  misc_feature (309)..(309): n is a, c, g, or t
  misc_feature (330)..(330): n is a, c, g, or t
  misc_feature (359)..(359): n is a, c, g, or t
  misc_feature (370)..(370): n is a, c, g, or t
  misc_feature (435)..(435): n is a, c, g, or t
  misc_feature (455)..(456): n is a, c, g, or t
  misc_feature (459)..(460): n is a, c, g, or t
  misc_feature (463)..(463): n is a, c, g, or t
agcggccggcggctgcattacagagagcctgagctctggagcctcagcgagcggaggaggaggcgcagcggccgacggccgagtactgcggtgagagccagcgggccagcgccagcctcaacagccgccagaagtacacganggaaccnggcggcggcgtgtgcgtgtaggcccgtgtgcgggcggcggcgcgggagcagcgcggagcggnagnccgngcttggggcgggntggcatcantggacgagaaggtgttcaccaanggagctggacccagtggatccgagcagctgaacgatgtgcaagcangctgtccgagtcccaggtcanagagcctcttgcgagcaaggctaaagaantcctgacaaanaggaatccaacgtgcaagaggttcgatgtccagttactgtctgtggagatgtgcatgggcaattncatgatctcatggaactgtnnagnnatnggtggcaaatcaccagatacaaattacttggtatagtgggagcattattgtcgaccagaggatattatccagttgaaacagtttactgctgcttgtagcctcttaaggtccgtcaccgtgaaccgcatcaccattcttcgagggaatcatgagagcagacagatcacacaagtttagtggtccctatgatgcgctgttcacgaaaatttggacactgccactgtttgccaatttttcaccagatcttttggactatcttcctctcactgccttggggggatgggccagatcttctgtctacggtgggtggtctcctcgaccattttatagattcggctgggtccatattcggagccttggatcgcctacagggaagttccccatgagggtccactgttttacttgcgtggcgcgatcccaatacggcgggggggggggaatttccctcaggggggggttacacctttgtgggcgcgaatttttcgcggcttaatcactgcggggccccgtgtgcgttacaccaccccacgggggggtacatggcggcgcggggttagatggcgcca

SEQ ID NO: 553760 - DNA, 4606 bp, Homo sapiens
  misc_feature (2299)..(2299): n is a, c, g, or t
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcantggtaccagcagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcaccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagcgttttttctttaattaatttttttgagatggagtctcactctgtcacccaggctggagtggtgatctccgctcactgcaagctccgcctcctgggttcaagcgattctcgggcctcagcctcccgagtagctggactacaggtgcaccccattaccatgcctggctagtttttgtatttttagtagcgacggtgtttcaccatgttggccaggctggtcgtgaacgcctaacctcaggtgatccacctgcctcgggctcctaaagtgctgggattacaggcatgagccaccgcgcccgacctgcatcaacgtttgctcagggggcaggtggtcaggctgatggcccagctgcaggcagggtcatttccagcctgcccctccctgaggctgcgtgccagggttcatgtgtgccctccgcggctctgcactgaccccgccggtagctggggaggagtttgggcttggcgcctccttcgtgtagtggctgaagcttcccgggtgctcctcattcctgggaagggagtcgggtgatgggaacggtgggagctcagcgctccgagtctgcggccgggggccagcggggctgaaacgcgcctcctgagtgttgaaagcggcaggcgccggcctttgcacccagaggccagggcgtctcactcaccttcacatccaggcctcttaggggagcgcggctttggcttttccaggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacctggcgggacgagggtcgcccgatgtctagctgccgccacagacgacgcttttgcgtctgcgcagcgcgccgccttgtgggtaatctcagggtgagacgaggctagcgcgaggtacggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgcaagcttatc

SEQ ID NO: 553761 - DNA, 3218 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacctggcgggacgagggtcgcccgatgtctagctgccgccacagacgacgcttttgcgtctgcgcagcgcgccgccttgtgggtaatctcagggtgagacgaggctagcgcgaggtacggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgcaagcttatc

SEQ ID NO: 553762 - DNA, 272 bp, Homo sapiens
ccccccggggggttgggcccctccctggggttccttccccgggccgggggggggggttttttaaaaaaaaattcccccccttcccccttttccccctggggttggaaaaggggtttcccctcccaaggttttggccccccggggggttccccttgggggagcccccccgcccccccccccttttttgggttttgggggggttaacccccaggggggattttttccccttttttttgggccgggggggggtttttaaccccccccttttttta

SEQ ID NO: 553763 - DNA, 2241 bp, Homo sapiens
cgggcagatcacgaggccaagagatcaagacaatcctggccaacatggtgaaatcccgtctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553764 - DNA, 2374 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553765 - DNA, 2025 bp, Homo sapiens
agcggaaaaaggcggaagcggaagtcggggggcgcgccagctcgtagcaggggagcgcccgcggcgtcgggtttgggctggaggtcgccatggggcgaggcagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553766 - DNA, 1571 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgccagggccgataagggggttggcccccgcgaccacggggcctcggctcaggggcagccaggtgttgagtacctggaggtgcagaggcagtggcc

SEQ ID NO: 553767 - DNA, 319 bp, Homo sapiens
agacaaatgtctttgttctttatatttagattaagtcctcagaaaacctgagattgcttccactgagatatttgctcaacgaaaaatcctatttgacttcacactcaattaactgatagtttcatttagatttaaagttttcacaggtaaccaccagaataaatttttagaactgtgcattgaacacaaaatgagctggttttatcatgtcagcaaaatgagagtaacagagtagtatattttaattggctaccatagaaattttgtaaatctttatccaaacctatatgttcgggtttgtcgtaaaactgaagtgaag

SEQ ID NO: 553768 - DNA, 255 bp, Homo sapiens
ctggtggtgatctattcagcaggtacacaactactatataaagggtatattatatatacatactcattatgattcaacaatactatccagtaccaataattatgcccatataattggatcaggaaacacacaattaaaagcctggtaacttgatctagggaaactacctaataaactattgttccaggattctcaacctagaataattccaaaccttttatcccttctgtcctgtcagctaacatttgatataac

SEQ ID NO: 553769 - DNA, 1154 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553770 - DNA, 132 bp, Homo sapiens
gaggatcccctcattatgcaattcctcgtgactataaccatgtctgtctgtctgtccatctgtactccctcgtttactattaaccatgtctagtccgtccatcggtactccctcgttaactatcaaccatgt

SEQ ID NO: 553771 - DNA, 841 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553772 - DNA, 314 bp, Homo sapiens
  misc_feature (204)..(204): n is a, c, g, or t
  misc_feature (310)..(310): n is a, c, g, or t
gaggcgccggcttcccttgatccgccggccgttgtcgccgagtcggtgtcgttctttaacatcggcgacgggttcaattcaggccgccaggacttaagttccaaccccgcggggccccgcctttccaaggaggttaattttttccttccctaattgacagcgccatttacagacaaagcctgggaaggttaacgcgcacctttnacaagcacacggggggagagaccatttgtttttgactattgagggtgtggcaggccttcatcaggctctaccatctgagccgccaacattctgactcacacagagnagag

SEQ ID NO: 553773 - DNA, 767 bp, Homo sapiens
ggtgcttgccggttaccccttttcagaacgcggttccttccttaaagaaacgacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 553774 - DNA, 609 bp, Homo sapiens
  misc_feature (7)..(7): n is a, c, g, or t
  misc_feature (72)..(72): n is a, c, g, or t
  misc_feature (87)..(87): n is a, c, g, or t
  misc_feature (90)..(90): n is a, c, g, or t
  misc_feature (98)..(98): n is a, c, g, or t
  misc_feature (107)..(107): n is a, c, g, or t
  misc_feature (119)..(119): n is a, c, g, or t
  misc_feature (132)..(133): n is a, c, g, or t
  misc_feature (138)..(138): n is a, c, g, or t
  misc_feature (140)..(140): n is a, c, g, or t
  misc_feature (152)..(152): n is a, c, g, or t
  misc_feature (156)..(157): n is a, c, g, or t
  misc_feature (159)..(159): n is a, c, g, or t
  misc_feature (161)..(161): n is a, c, g, or t
  misc_feature (164)..(164): n is a, c, g, or t
  misc_feature (204)..(204): n is a, c, g, or t
  misc_feature (226)..(226): n is a, c, g, or t
  misc_feature (228)..(229): n is a, c, g, or t
  misc_feature (231)..(231): n is a, c, g, or t
  misc_feature (280)..(280): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (349)..(349): n is a, c, g, or t
  misc_feature (352)..(353): n is a, c, g, or t
  misc_feature (600)..(600): n is a, c, g, or t
gcaggtntcacccttgatggtgcaaggccctgcgtggctattcgggttctcccccttaatggagttgctgtnaggagatgaaccttnttnggggaccngcagaggcnggctcagaaganactgctcttaagnngtttngnggactaacaggntatnntntnttntggtggcctcagcacagtctgtcagcttggggcctaagtnaagttcacaggctgatagggcntnntngagcaggccattcaccttccggggccactggctgggctgatcatcagancccctctggctggtcttggggctgttattcaccttgtcagcagcngntntnagctcagcaaggtgctgnttnngaggctgggtgggcacaccaagggctgggtgggagcaggtacagggcgctgtgggcaggaccctttggactcctcaagtttccgactcgtctgtttcttcagtggagccatcactctctccatccacttttcgggaatgatggagaggtctccagggagagccaacccggggaggggtccgggaaggcaggcaactggcctctggactggctgtgaccgagttgaccaggcctgggacctgggccancagccgttc

SEQ ID NO: 553775 - DNA, 234 bp, Homo sapiens
ggtgttatgtgtcttgttgtgataactaaccgtcgggagttttgaataccagccgggccaacgtggtgaaaccccgtctctacaaaagaaaatacaaaaattggccaagctgtggtggtgcatgcctgtagtcccagctactcaaacacctgtagtctcagccaccctgaggcaggaggatcgcttgggccagggaggtcaaggcagcagtgagccagaattgctccactccag

SEQ ID NO: 553776 - DNA, 520 bp, Homo sapiens
  misc_feature (520)..(520): n is a, c, g, or t
gggccccggagctgctgcagtccttcgcgcctcctcgcctccccagcgaatcatgctccagttcctgctgggatttacactgggcaacgtgtgggaaggtatctggctcagaactatgatataccaaacggtggttaaaaaaaaaaaaaaaaagaaaaaaaaaaaatatttttttgggcgcggcttaggcgcccaaagaaaaaaggtttttaagacacaatttgtttttggggggcggggggcccaatgttggtataggtgtcaaaccggggcgacacacggcggtggtcccaaggaaggagacaccggggggtccactggaacaagaggttgcgtggggacttcccaccacccaaaattaaaaaaacgcgcgagggggaacacaccgccgaggaggtgttttgacgaaaacaaccaccgaaagatgggactccgagaggcaacccagagggggacctcacacaaagggggagtcacacgagagggcacgaatttataaattaagcccccgacgtgggan

SEQ ID NO: 553777 - DNA, 950 bp, Homo sapiens
ggaggatggggcggctgagtcactcaggctgttcatggtaaacccctcgtccaatgaatagggtcctactcctaagactgatggggtgtcgatctctctacgacatcaatggtctgattcaagtcggacccgccaaacacgagcagatattctgctcctctaagtgactgtagcagttgatccttgaagtctctcctggtgtcatgtcagaatacaagcctgtgtgactctggtggttcactgtgattggtctaatgtgagctcttcgaatcagacagatctgactagatgaaatgatctctcgcgccatggtttcgtaggctataatctgcttagcctctgtcgtagtgtccaagcatcttagcatgttcaagaggagagggctagcataacttcctgaccaccggttgtcagatatcaggagcattctggactcctgagaggacagtggcctcttgcagttgaacagggagagggcagtagatgccccaaaatccagagccgagggctgaaatccagcaggactaaggaggggacaaacacagaactcctcatccgatgtgtcattaccaagggtttgcctagatgtctcagctcattctgggcagaggtttgtcttctgtcctagagatttggagcgactcggggactctggtgaatgggtgccttgacttggccttacaaccagttgggtagacttatacctgcggccaacccggcttagtcagttgtgttatccagaagaagtcctaggtaactaagcacgagaggccagtccaataactagcaatggctcttttgagtcgtaccacactggaactcatgaaggatagccccaagaagacgcgatgtgtttcaggaagcacaaggagcctatgaatacgtctctttgtcgtccgtctctcacacgttttcactttaacaaaatagttaaaacaaataacaaactt

SEQ ID NO: 553778 - DNA, 183 bp, Homo sapiens
cgcccgtctgtgtgatctcctcccttgagaggatctgtccctagtatcgagaggacgggattgacacacctctgttgacctgtatggcgccagctgtgcagcaggtagctaagtgtggaatagataaccgctgaaaccatctaagcgggaaactaacctcaaaacaaggcttcgccgagagcc

SEQ ID NO: 553779 - DNA, 994 bp, Homo sapiens
gatggaggcgtgatggcagaggcagaggcagagccctggtgcctgagaccaagcgacagacctgtgcggggctgtggcctcgcaaatgccggctcggcgagcgtctcaccgacaacaccgatgcctgtgggatgtgaaaatgcatgcgacatccttcgctctgcatcccctggtgatgcctgcacgtccatgacttggccctggtaagtcgagggtgctcatgtgatgcatgatccctgaaggcagggcattttgctcaggccatcctgactgaggtgcttggcccattatggaatgtgctgccattcaaacatgcactggtaccatgacatggccaaccaatgacctgacgaacttccacagttcctgaccccttgtcgtgccaatgaccacaaagcaggagcacaatggctctcgcaaggcaacgttccaacagtaaccagcacccaagtgtatttcaagcacagttgaatcatgctagggccttagcctaattctcaagtggcactgcagacacgaacaccctgactgctttggcgccttctcataccagcagcacaatgttcccaagtgtccaacgacaagtcataattcgaacatgaacgcccgaacttaaccacactgggataggcgagactggaggaacatcggcccatgaacctatccggacaagagaagttccaaagcgtttagagttcccaaattcaataaggcagacacgttgcggtttcaaccctaaccacggaagcatagattccccatacaaaacatgccaagaaacccccgaaaaaacgacgggacagcgattggccgagcggagagacacctatcccggagtgccgatacgcactattacaccaaggaggaccacataagcacccactaacaagggcaaggtacgaaacaccggcaacaagtccgccagtaaaagggcaacaaggatttccacaaggtctgtggatgacacatttatacaacaacagcggacaacgga

SEQ ID NO: 553780 - DNA, 528 bp, Homo sapiens
ctgcagcgcacttgagtaaagtattctacacttcatgcttgcatcttcttatacctccccagctaaaggacacaaatgagattcttttttagggctcagattttgcccctaaacagttaaacagactcatatgattctaatctacacaaaagggaaaaaaccaaagcatttcaaaagtttctgcagattttcctcaaggtttggattgccaattcatgaccaccatgaccagatgttagaatccatcaagacaaccaccaaaatggctgctgaacttgaagatggcacacagaaaacaaatgtaaagtgttaccctggagaaaactatctctaaccagactctccaaaggcaaaaaatgggcttttgttgtcctctggatcggtttgggttagcagtacaagggtaaaaataacccgcttaacggcctcaacaagtcatgcctattccaactcttttgtttaaaggacataaaaattatgaggctataggaagaaaaatttttaatgaaaaacaaggtaaaattattt

SEQ ID NO: 553781 - DNA, 251 bp, Homo sapiens
ttatgtatatagcgaacaacccagagataacacaaactaagcatacatttggctacagattggttctcctagtttaaaaaaaaaaaaaaaagtcttcttacccctgatgctgtctcccgaccatagattagggaagcaagagggggggatacggaatcaacttacttaacttacctcagaagtaacagggtctacggggctatgaacaaaggaactagagggaaacattggtgcaaaaacaaggtcggata

SEQ ID NO: 553782 - DNA, 323 bp, Homo sapiens
gcaagctttcttcctggtggcagaagccataatggattcatcccttacccgccggggacagatttgttggtatcaaaacccgggggtgggtttggatcccatcaatgatgctaccctcctggaagcatgtatctcccccctgctgaagctttattgccgggagcagccctattacctgaacctgatcgagcttttcctgcaaagttcctatcagactgagattgggcagcccctggccctcctcccagccccccagggcaatgtggatcttgtcagattccctgaaaaaaggtccaaatttattgtcaagtccaagaccccca

SEQ ID NO: 553783 - DNA, 119 bp, Homo sapiens
gcggccgcctactactactactactgctcgaattcaagcttctaacgatgtacggggacatgaggtcaggagttcgagaccagactggccagcttggtaaaaccccgtctctacaaaaa

SEQ ID NO: 553784 - DNA, 721 bp, Homo sapiens
actcctcttggctacactcatgtgctcagactatatttcaaataaaaaatcttctcaccacaaaaaaaaaaaaaaaaaaacaaaaaaaacctggtggaccgccacgcgggcgccacgaacaacgtctctcaagcaccatcgccgtgggcgaccacgcgggcccccaccaagggacacggacgacacggggtcacacagcgagtccccaaacgcgaacacccggagacacgagaaccaacgagccatggagactacactaacccaaattaaacaaacgcccgggcgaaaaccgcagacggcgattctgcgaaacaccaaattccgcaaagagggaaccactcaggaacggcacaaaagagcggggactactcaaacccacgagggacacatccccaagacgacacacccaaccaatcaaaaattgcagccgcccacccccgcgggccctcacacacgaagcacagagcacgaaaagacacacaaaagacaacaaaacacacacagaagacacaaacacagaaagcgaaacacacacccaaccgcagggacgcggcgccggcgaacaagagacagcgccagaggacgggaccaaagaccgacgaagacagcacaagaagaacagaaagaaccgaaggaaaccgccagcgggaacaacaaaaagccgaaacgaaaccagcaaagagcaacaggcaggagccgaccgcagcgcgacacgcaccca

SEQ ID NO: 553785 - DNA, 165 bp, Homo sapiens
ggtcctgcgactttcaactgcggtagggatatctgacctggaaggctatagtcatttacagaagagaaaatcaatggccctgagcttcacaggcctcggcttcaacaccttgtgtccactactttgcatttctctccaacaagtagcccatagttgtgtggatgc

SEQ ID NO: 553786 - DNA, 314 bp, Homo sapiens
ccaggacttgcagaatgagtcctagaaatcatgtcttctcatgtatctacaacaagcgtgtgtctctgaacaactaaaatcagactttaggattcctctgaaaacagttcgtggttcccacagcatccgcaccatggatacccagcacatgctccaaagatgtgctttcccgttatctttacaaaacccaccaccaggacaaccaaaacggaccccactctgagagtaccatgaggaaggtgtataagaatcacattaaccccaggtaaagggcagtagatgacattctccatttctttactactttcattaat

SEQ ID NO: 553787 - DNA, 434 bp, Homo sapiens
gaggacccttttatagcacgctggagtggaatgggtgatctcggctcactgcagcctccacctcccgggttcaagcaactctcctgcctctgcaaatctgtagtttacattagggttcactctttgtgctatgcattctattgtgtttgtttgtttgtttagaggcagggtctcactctattgcccaggctggagtgcagtggcgcagtcatggtctacttcagcctcaagctcctgagcctaagtgatccttccacctcggcctgccaagtagctgagactacagcatgtgccaccatgcctggctcattctatgggttttgacaaatgtaaaatttacatgtagctaccattaaagtatcatacagaatagttgcactatcctaaaaatcccctgtactccagcgtgctgatacaagggtaacgagctcgaa

SEQ ID NO: 553788 - DNA, 401 bp, Homo sapiens
ggtgcacattataactttgggtttggagtaatgcacctcgtatgaactgttaagtcaaaatatagagagaaacaaatctctaagtaaaaaaggttttatttagaacgaatatataagtaggattgcaatccaggacatacatacatacacatactagggtagcctcctagtgtgtccaaagcacacacaaagcaaggttgggagtttcattcagcacacaagcacatgtgcacctcattgttttgcaaagcaacaactcactggcacctcactaaagcttttgggagctggtcagctctgcattggtgcagtgaccacggttggtaccactagcacttagagtcacaagcagtcatctcaacagctagtaggtaaaactggatttaaggttccagcatgtc

SEQ ID NO: 553789 - DNA, 141 bp, Homo sapiens
tagaatgttagtgagcctgggtgttgtagtgtaactagtgcgatgagtaaggaacgggagcctactggggtgtacgaatacggacagtactgtgcctcagtccacggcgtactggctggattgcctcactacgggtgatga

SEQ ID NO: 553790 - DNA, 226 bp, Homo sapiens
  misc_feature (39)..(40): n is a, c, g, or t
  misc_feature (133)..(133): n is a, c, g, or t
  misc_feature (217)..(217): n is a, c, g, or t
cgccaggttgttcagacacttcaccttcaactgcagganntgtgcctcctcctcgaacgtcatgtccactttggcgctggaggtgatagccttgatggcgaggtcgtaggagttggcggccaggacgaacgcncacagcatggtagtggggtctgcgcactcccgcttccggttggccagggcacgcgctcctgccccgtgagcatctccaggtcangcccgtccc

SEQ ID NO: 553791 - DNA, 248 bp, Homo sapiens
taggctaagccagtggtgcgacctatctctgtgttagaatctagcatgccacctagtctgtcctcaggtacctgagcacaggtgtgctgtgctccctctggagttgagtgagcaaagaggatagcagtcagtcgggtgacccacccggtgagcgggcacccccagtcagcgtgcaccaccgtcctccatcctcatcctcgtcctcattactggaggagggagtgcatgtccagggcagggcccgcgag

SEQ ID NO: 553792 - DNA, 165 bp, Homo sapiens
aaagtataatagatatatgcatgacaggagcagcataaggttagtcctggaccattattccatgcatctggcaaggaagcagagaaggtgaacttggttgttcaaaaacattctttgcaagatgctgtctggctgagaaatgtgttttgggcattgtcttaattg

SEQ ID NO: 553793 - DNA, 685 bp, Homo sapiens
  misc_feature (10)..(10): n is a, c, g, or t
  misc_feature (70)..(70): n is a, c, g, or t
  misc_feature (80)..(80): n is a, c, g, or t
  misc_feature (90)..(90): n is a, c, g, or t
  misc_feature (94)..(94): n is a, c, g, or t
  misc_feature (100)..(100): n is a, c, g, or t
  misc_feature (109)..(109): n is a, c, g, or t
  misc_feature (132)..(132): n is a, c, g, or t
  misc_feature (147)..(148): n is a, c, g, or t
  misc_feature (151)..(151): n is a, c, g, or t
  misc_feature (162)..(164): n is a, c, g, or t
  misc_feature (174)..(174): n is a, c, g, or t
  misc_feature (182)..(182): n is a, c, g, or t
  misc_feature (184)..(184): n is a, c, g, or t
  misc_feature (209)..(209): n is a, c, g, or t
  misc_feature (211)..(211): n is a, c, g, or t
  misc_feature (237)..(237): n is a, c, g, or t
  misc_feature (272)..(272): n is a, c, g, or t
  misc_feature (408)..(408): n is a, c, g, or t
  misc_feature (471)..(471): n is a, c, g, or t
  misc_feature (578)..(578): n is a, c, g, or t
  misc_feature (601)..(601): n is a, c, g, or t
  misc_feature (645)..(645): n is a, c, g, or t
catttctctncaattcctgaatagctccaaattatgctaactctgggcattgatgtttactctgggtttngggtttggtntttgggaatnatgngttctnggcctttgngatcgccatctatgtgtccaacntcaacactgtgatgnngtngttcctgtttnnnttttttttcngttttctntngatcagccattaacacgcatgtttntntttttgtttactcccactcaactgtntgttctatgtagggcctgatacagatgttacttgntgttatttaatagctactggggtcagacaatccaagaccatcattatactaaaattaaagttatttatggaagttcatagacacttccagaattggttttacctcctacacgggaacatgttcaaggaacccaggncgggcttactggttgtgtctcaactcttcccattcatcaatccctattcaccagtggcacggnaagggggttctttaacaaagcattatacataacacctctaccaaactaaacataaactttttttgtagttaaatgcgagaaagtcggtttttttccacccctttccnccttttacacggcaagtaaagcncactggcctgggagttgcctctatctgccaacctttggccagtnaagaggattcagagaaaataatacaaccatcaatcagaaa

SEQ ID NO: 553794 - DNA, 355 bp, Homo sapiens
  misc_feature (27)..(27): n is a, c, g, or t
  misc_feature (62)..(62): n is a, c, g, or t
  misc_feature (75)..(75): n is a, c, g, or t
  misc_feature (111)..(111): n is a, c, g, or t
  misc_feature (116)..(117): n is a, c, g, or t
  misc_feature (147)..(150): n is a, c, g, or t
  misc_feature (157)..(157): n is a, c, g, or t
  misc_feature (171)..(171): n is a, c, g, or t
  misc_feature (254)..(254): n is a, c, g, or t
  misc_feature (276)..(276): n is a, c, g, or t
  misc_feature (351)..(351): n is a, c, g, or t
ggggtgtccacgttcatgttcacgggngtggtgatggtggcagcggctccttccgacatggngggctcgctcggnggtggctgtgcgactcctgatgcaatagagtcaggncaaannctctgggctggccggttctgagcggttttnnnntttgtgnggggggtctctgancaacttgaatccaacattggctgaagaattcgtcttctggcattgatgaaccagttgttgacttggggtggtgtcaaatttgngtgggcggcaatctgttttttntcatcctctgttgggtagggatgcccgatgtgctggaagagccaggaccgcatcacgttcgtggcatgctttggnagga

SEQ ID NO: 553795 - DNA, 104 bp, Homo sapiens
gggaacattcacttggagttatagcataatggaaagatattagaagaatacagcagggtacagacatacttaaacggggatcataacctcatagtcgattttgc

SEQ ID NO: 553796 - DNA, 563 bp, Homo sapiens
ggcattcctctgcctaccagaattttagggacgcccgccgggccatttgaaattaagattgggcagccccctgtttccttcttcctgaaggcagcaggtgggattaaaaagggggcccggcaaacagggaaaaaggtggcgggcctggtgcccttaaggcatgggtatgaaattgcccgcatcaaagctcaggatggggcatttgccccgcaggaggcacccctgtggtttgtggtccgccccatcatggggttggcccgttttttgggcattgggggggggaaggcccccagttcaaaaggggttgcggctttccaaaaggaacgagccttttttcgggggggtcagaagggggcagatttgggggcccaaaaaaaaggggccaaaaagggccccttgcccccccccctccccagattttaagggggggggttgcaaaagcggggcccaagggggggagggggggccccccaaaatgagggggggtttcatgcctttgaaggaaaaattttgggacatctagggggatggggggaccgggccggaaaaaaccccctttttta

SEQ ID NO: 553797 - DNA, 181 bp, Homo sapiens
gtcgcaaccatcatgccttcttctctccatcagagccgaatcagggtgttgaacttgtgcccatcaatgtcatacagcttcttcacagcctgtataatcttgagtgctctgtggctttaacatccacaatgaacacaagtgtgttgttatcatctatacttacttcatggcagaaacagtg

SEQ ID NO: 553798 - DNA, 206 bp, Homo sapiens
tctcgtgcgcgtcccagattcacaatgtcgttcctcgacccacctcgcatgcacatgcgacgacacacccacacaaacacacacacacacacatccgaggccctcacagaacagagaggtccacagctttatgacaccagaagagtcagaaagttgcaactcttctatgcagtgccggcctcaataaaacggtgttagactttggg

SEQ ID NO: 553799 - DNA, 379 bp, Homo sapiens
  misc_feature (5)..(5): n is a, c, g, or t
  misc_feature (124)..(124): n is a, c, g, or t
  misc_feature (152)..(152): n is a, c, g, or t
  misc_feature (158)..(158): n is a, c, g, or t
  misc_feature (168)..(168): n is a, c, g, or t
gcagnaacagacctgtctgaccgatcagggagaatgatgatatgagtagtcgcttgatgactggaaagatatcgcggacctcatgacacggctggggtggagaatggaagtgaaaacagatacngccacgcaaagagttgaggttgctatanttatanggaactggcnccagccagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcatc

SEQ ID NO: 553800 - DNA, 880 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccacagaatatctgcccacacgcccggcagtggtgcttacgggtcatcaccccgaactgcaccctgcagcggtggcattcctcagcgtccaccccgtcgggtggag

SEQ ID NO: 553801 - DNA, 235 bp, Homo sapiens
gtctctacaggatccccgtgcgccactagcttctcttcactacagccctgtgacgtatgtaatgagccctacttcccacatcagacactgaagcgctcaacatctcccctaggcctcagggttcctgcggggtgggcagggcctcttccgcagtttctatccgcagttcttcacccgacccagccgggccacggcccacgtgtcctttgtgagcgttcttccaacggagcttgat

SEQ ID NO: 553802 - DNA, 817 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagcttctctgcttctcagctgccatctccagtgccccagaatggtacagcgataataaaatgtatttcagaaagca

SEQ ID NO: 553803 - DNA, 351 bp, Homo sapiens
gtcgttcagatgcgcacaggtgcgcgtcatctcttggcggtagatcatcgtatgagagagggatctgtcgggcgcgcgtgtcggcaatggaacagagcccagaacgcaagcgcagacggcaatgtcgcggtgtgagtgtcggggcaagcgtgcatgcgcgattcacagtgatagaaagacttgagcgtcacacgcgaggttacacgggtaaattcaggcttgatgaagtttggttgcagtttggctaaacattctgtctggaggagcgagcttgctcgcgaagatcgttaacgataacgcgggtgcctggttcacagcggcgcacacagctttttcgcgagcaagctcgtt

SEQ ID NO: 553804 - DNA, 428 bp, Homo sapiens
  misc_feature (415)..(415): n is a, c, g, or t
acttattcatcatcattgcctctgagcagttcagctcgaatcatgtgaagctgtccaaaattatccagagcatgggaaagaggttctatattgtctggaccaagctggacagggacctcagcaccagtgtcctatcagaggtccggctcctacagaatatccaggagaatatccgagagaatctgcagaaggagaaagtgaagtacccccccgtgttcctggtatccagtctagaccctttactatatgacttcccgaagcttagggacacacttcataaagatctctccaacatcaggtgctgtgaacccttaaagaccctttatggcacttatgagaagatcgttggtgataaagtagcagtctggaaacagagaatagccacgagtccttgaagaattctctcggtgtcagngatgatgacaaca

SEQ ID NO: 553805 - DNA, 859 bp, Homo sapiens
agcgggtcctcacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtgtgggtcggcgtccgtcgggcgttggcaaatggggctctgcgagggtccgcgcagggcgccagggcgcgcggcgacctcgctcctccgcgggcccggggcattcggccgattgcctcttgaccgacgatgcagcccggccgagtgggccacaaggcctgagtcatgaagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcagccacagccaagggtggaggcttcaggtctccagcttctctgcttctcagctgccatctccagtgccccagaatggtacagcgataataaaatgtatttcagaaagca

SEQ ID NO: 553806 - DNA, 375 bp, Homo sapiens
  misc_feature (43)..(43): n is a, c, g, or t
  misc_feature (61)..(61): n is a, c, g, or t
  misc_feature (63)..(63): n is a, c, g, or t
  misc_feature (135)..(135): n is a, c, g, or t
  misc_feature (152)..(152): n is a, c, g, or t
  misc_feature (159)..(159): n is a, c, g, or t
  misc_feature (252)..(252): n is a, c, g, or t
  misc_feature (282)..(282): n is a, c, g, or t
  misc_feature (289)..(289): n is a, c, g, or t
  misc_feature (303)..(303): n is a, c, g, or t
agtgaccatttcaagcatccggcctatttcagaaaaagccccnaaccggagggaagtggananccggagctcaggcctttgcatcattttgggcttggcctggacagcacccgccagttaaaactgtgggcctcnccctttggcaagttaanccaagcnctgtcatttttggtgccatcttcccctgccgcaccggcagtttcagcccagcccccccctttgggttgtaggttgggctcccaaacaacacanaccccttttccccttgcccctcccccaaanggacttnactttctttttggnctgtttgtatttaaacaaaatggtgtcaaaataaagcccctgcagggcctggctccctgttggtttgagtta

SEQ ID NO: 553807 - DNA, 321 bp, Homo sapiens
  misc_feature (84)..(84): n is a, c, g, or t
  misc_feature (236)..(236): n is a, c, g, or t
  misc_feature (258)..(258): n is a, c, g, or t
cccaaattcatgtgttgagtttctaatccctaccacctcagaatgtcaccttatttgaaaataagatcattgcaaaagcaattnctagttatgatgaggtcatagtggagtaaagtgggcccctaaaccaatatgactgatgtccttatgaaaaggagatatttggacatagacatatacacagggacaaggctgtgtgaacctgatggttgatattgagtgtcaacttgattganttgaaggatgcacagtattgtncctgtgtgtatctgtaagggtgttgccagaggagattcacatttgagtcagtgggctgggaga

SEQ ID NO: 553808 - DNA, 632 bp, Homo sapiens
ccggtgggagccggagtcccgccgaggggggctggaggtggaggggcccggcgaggcctggatgaagccgatgcgggaggaccaggcggcgctgtgctgggcgagcccctgggatgagtgcttccaggcggctgtgcagctgtctgctgcgggcaggactaggatcatcagaaaagcccttactgaggaacaaacgtgtctcaaacaaaaaacatcagcttgcagatctttgtgacacgataacagtattcaccctttggtgggaacgaattttacactttactttcgtgaggttttgcgggaacgaaggaggggtatatccttttgcacaacagttgtttcaattttgccagtaaagaagggcccgtcgtgccttatcctgggtgtgcccaaatgttgtttggtggcgtcaaacacacaacctaaggtccctcggaagcggttgtggaattcctatttccgggaagtcacccacaatatactggaacctgtgtgtcctaacctccttgggtccacaatgttttatatgggattggccccaccagtagtcaaatttatcctcccctgggaacatttgtgtttggcgcacgtgtgtttctacacggcgcgacttttgtgtggggcaccatttt

SEQ ID NO: 553809 - DNA, 544 bp, Homo sapiens
  misc_feature (538)..(538): n is a, c, g, or t
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtaagcagacccccgtgcctcagtggcccccagggtccctaccccctactagtcacgacagcatgagaagagtttgtcctgtggccttgcccacctccctgggcatacatcaagcaggagagtttccactcagccttgagtgcctgtgtgaacagtgccccctaggagagggtcacgctgagggagagacaggagataggggagggagtgggcaccacttcttcagccggtcctgcgtgagtaacaccagntaactc

SEQ ID NO: 553810 - DNA, 496 bp, Homo sapiens
  misc_feature (457)..(457): n is a, c, g, or t
  misc_feature (483)..(483): n is a, c, g, or t
  misc_feature (496)..(496): n is a, c, g, or t
tgcctgcagagagactctataggagcccccgcgatccgctgtcatatctatgactattttttaaaaaagatgccactcttatggcagcgtcattcactaagtttgccacggctaatcattcatgtactatccgaatggcataggctgtccaatacgaccctccccccaaagattacagctgtcttatttaatttttgtttttttaaaagtcatattctaatgcatctaatgttcttgctgcatggctcaaaaaaactataaaaacatgcaaattacaacctacctgtatgcatcacttaatgcagtgctagcatgacaagacactcagccatttttatgtaaagcgatggagaccaactgattttcctgtcttcttgctcacaagttttagaatcaattgtcacatacacacaaaaaccatacgcagaacagcctgaatgaactgtgatcacagaanctgattatcaacaggaaaacaggatngaaaaaagaagtn

SEQ ID NO: 553811 - DNA, 234 bp, Homo sapiens
  misc_feature (230)..(230): n is a, c, g, or t
cggctgacctgaggatccagaagatactcatatgaggaggctaggagtcgaggtcagctggccagcatagcgaaaactgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagacttngttt

SEQ ID NO: 553812 - DNA, 776 bp, Homo sapiens
ccccctatgtggcggactcaaccgcctgtatcgtttgaggcggttaactgggagcgaaccactgtctgatgcgcctcgcgcgtttgtcgtgggtgcattcctccccggaacaaagttcgtgcccgttggctacgaaggagtatcgctcgacgttatagaaatgtgtagtttccgcggcgtgtagagagaccacatatacatgtgtatacacagcagtgtgtgaatagggtgcaagagacacaccccacgttggcaatagttgttgctccccaaaaataccttcgggaacacaagcacaaggagtaatatattacgtccatcaatcggtgccggtgctcgccgcaattgttcgcgtctcaagctccaacgccggcgcttgtgattaaaaacatattttggggggtgaaaacatggagagcatagagataatggaagatagatgtatttagggcggggttatggcgggacaaccctccatgagattgcttctctcaaaaagagatgccacagtcacacttgttggagacacacaacacgggcgcgggatagacaacaactgatgcgcggaatttccgtcatcatcatgtttctctaatgtaaacatagaggtctgtggttcttctacaagggagtaatacaccgacaggtgttcatctcttggacagcactgttcaggacaggaattgggccgttccccgatctagtgagcgactcactgtgttggagcatggtcgactaaataacaaaacggtttaggatgccccccccacatggac

SEQ ID NO: 553813 - DNA, 497 bp, Homo sapiens
cagtcttctcccatcagccttccaaagtgtgggattacaggcatgatccaccacacttggcttttttttattatccctttccttaattttttctgtagagacaggctctctaatgtggcccaggtgggtcttgaagtccgggtctcaaggcgatcttctggctctgacctcccaaagtgtttttttggttggttggtattaggaaacgagtctcattccattcacccaggctgtattgcagtggcgtgatcccagctcaccacaagcctcttcctctccagttcaagcaaatttccggcctcagcctcccaagttagcgtgggattacaggtgactgctaccacgccgggctaattttggtattttaagtggagatggggttcacggtatgggccaggcggtcctcgaactccggacctcatgatcggccggcctcggcctcccagagggcggggattacaggtgtgagcccaccgttcccggatggggagcaagat

SEQ ID NO: 553814 - DNA, 249 bp, Homo sapiens
ctgatgcgtgtcgccgggggctcatcctctgggtggggacacacagcccagccgtctgctatcctaccccgccagtctcctgctgtccgcactccttcgtgacttccctatgccacaaggagctttaaagtcctctaccaacacgccggcacacatgtgcacgcacacgcacatacacatccacacacacacacacacacacacaccctggatctgctctccatgcctcagaattatctcagtatacac

SEQ ID NO: 553815 - DNA, 127 bp, Homo sapiens
gcatttctgcgagccaatctctgcatttgcaatgatttgagttaaggagaatacacataggcttacaagacagaagtcaatatacagtactgtttaaccaaaggtaggtgttgtactgatagggtag

SEQ ID NO: 553816 - DNA, 188 bp, Homo sapiens
aattgtggaaaggcatgacggggaatatggaaatggacattacaaccagtgatgtgtacagtcctgtgctggattctggcacatggaatgtaggaatataaagcagctctcactgtggtcacttccaggcacgtggatgcctgccgggacttggagggctttctgtaccacaacttcgtaaggttaag

SEQ ID NO: 553817 - DNA, 324 bp, Homo sapiens
catttacttccgagcgaatatccatttgaaaaattcgacttattttagtcattgaatggctcgggacattaaacttaggtatttgttggtagtctgtttcccccattattggctggatagtgttgggcttcgtttttaaaggtcgctgattctcgttgtaagcacgtaccccatcatttctcttgaggccggacacgttgaaatcaaccagcttatgatgttttttcacgttatctagcatttcctcaagtgatgaaacatctatcgtatttgatgcattaaattgacgatatagaccactaagcaagacgctttctaagatct

SEQ ID NO: 553818 - DNA, 580 bp, Homo sapiens
tcttcagcttacatctcaagtttgaggccaacctgggctgtatgataccttgtctatatgaatgccttgtctctaagtaagttaaataaatacatgaatgaatgaatgaatgaatgaatgaatgaatgaagcaagcaagcaagcaaacaagtaagtgcatgtacttggcactgcagctttaatcatgtggtagtaggtactttctcctgtcttcaagtttatagccttataaagttgctccttagcagaggtcagccagggctacacagagaaaccctgtctcaaaaactagaaacaaaaccaagaaggaatatatagaactagtgttgggaaaataggtcagagataaagtgtatacataggactctcagttcagatctcagcatccacagaaaactggctcagaagcactcatgtggaaccccattctagcaggcgtgggaagcttcagggtcagtcaagagaccctacctgaaaaaataaggtgaagaacaacataggaagacaacccctaatcccacaggcgagaacatgtgcatacacaaatacagtatgtgtgcaccccaaattatagagtgct

SEQ ID NO: 553819 - DNA, 166 bp, Homo sapiens
tgtagagtatcccctccccgtacgcccaaaataaatatggatggcgagctactaggcctctgtcttcctggtagagggcggcatgccgaagggggtgctgggtgtggattggatgctgcggtgtgggggttggaagctgtctgtggcccacttgggcgtacgggga

SEQ ID NO: 553820 - DNA, 859 bp, Homo sapiens
  misc_feature (370)..(370): n is a, c, g, or t
tcacccagctgggagtaaacaagatcaaagagattgctgtgaccgtgaacaaggcatgataaagtggagcagagcgaagctgctgggaaaagtgtgccatgaccgctctgagtctccaagctgatctcccagcagaaagcttcactttgctaagatggtggtgtggcatgcacggtgatgagtgctcgatgattagctgcagcttaaaattgattggcatcaagaaggtacagggtggagccctcgaggattctcagctggtaggctggtgtggcattcaagaagatgtttctcttacgcgtggcgtttgaattgcaacccaaaaaaagtaccaaatcccaagattgcccttttgaatgtcgagctcgangttgaaagctgagaaagacaatgctgagataagagtccacacagttgaggattatcaggcaattgttgatgctgagtggaacattctctatgacaagttagagaagatccatcattctggagccaaagttgtcttgtcgaaaatccccattggggattgggccacccagtactttgctagacagggacgatgttctgtgctgggccgaagtagctgaaggaggatctggaagaggacaaatgatgggctgtttgagtggtcaaatgcaagaaccagtgttgaaatgcgtctgtacaggagattgtgctggggacgatggccagttgtttgagaagaaccgagattggacgggagaggtaaaaaatattaatgggtggccgcaagggcaagagaagacgttaataacaggggggggcgaacacattttggtaaaaaagggccgtaatgagcataaagtgagggcgcaaaaaaaagggggggggggggtaa

SEQ ID NO: 553821 - DNA, 170 bp, Homo sapiens
tgtggagacggggttactggtgtcagataggcagggtgcagtagctcatgcctgtaatcccaggacttggggaggctgaggcaggaggactgcttgagcccaggagtctgacaccagcttgggcaatatagtgagaacctcaactccacaaaaaattttaaaaagataat

SEQ ID NO: 553822 - DNA, 566 bp, Homo sapiens
  misc_feature (370)..(370): n is a, c, g, or t
tcacccagctgggagtaaacaagatcaaagagattgctgtgaccgtgaacaaggcatgataaagtggagcagagcgaagctgctgggaaaagtgtgccatgaccgctctgagtctccaagctgatctcccagcagaaagcttcactttgctaagatggtggtgtggcatgcacggtgatgagtgctcgatgattagctgcagcttaaaattgattggcatcaagaaggtacagggtggagccctcgaggattctcagctggtaggctggtgtggcattcaagaagatgtttctcttacgcgtggcgtttgaattgcaacccaaaaaaagtaccaaatcccaagattgcccttttgaatgtcgagctcgangttgaaagctgagaaagacaatgctgagataagagtccacacagttgaggattatcaggcaattgttgatgctgagtggaacattctctatgacaagttagagaagatccatcattctggagctcgacattcaaaagggcaatcttgggattgtggtactttttgggttgcatttcaaacccagcgtaagagaaag

SEQ ID NO: 553823 - DNA, 714 bp, Homo sapiens
  misc_feature (56)..(56): n is a, c, g, or t
  misc_feature (87)..(88): n is a, c, g, or t
  misc_feature (705)..(705): n is a, c, g, or t
tacccgcacgcccactactttaaaaatgttagaaggaaacctagagtaaactcttntggacattgatctaggcaccaaattaatgannaagagctcaaaagcacaggcaacagaagaaaaaatagacaaatgggactcaattaaactaaaaagcttcttcgcagcaaaggaaacaatcaacatagagaagagacaacctgttatatgggagaaaatattttcaaactatcaatccaacagaggactaatatccagaatatacaaggaactcaaacaataaaatcaaataatcccatgtgggacaaaagacatgaacagacatttttcaaaagagacatacaaatggccaacaggtatatgaaaaaatgctcatcattaatcatcagggaaatgcaaatcaaaaccacaatgatatttcattttaccccagctagaatggccattattaaaaagacaaaaaagagcagatgttggtgaggatatggagaaaagagaactcatatactgttgctcggaatggatattagtacagcctttacggaaaacagtatggtttttcaaagaactaaaagaactatcattcaatccagcaataccactgctaggtatctactgaaaggaaaaaaatcaatatatcaaaaacatacttgctcttgcatgtttatcacaccactattcatagcaaaagggaatcaaccctaaggngtctatcaa

SEQ ID NO: 553824 - DNA, 184 bp, Homo sapiens
ctaattcatttgatgaaaccagtacacctgataccacaaccaggacaggacataacaaaaaaaaagcgaaaagtctacagacaaatatcacctgatgaacacagatgcaaaaatcttcaacaaaatactagctaattgaatccaacagcacatcaaaagataatacaccaatagtttatgctgt

SEQ ID NO: 553825 - DNA, 551 bp, Homo sapiens
  misc_feature (370)..(370): n is a, c, g, or t
  misc_feature (526)..(526): n is a, c, g, or t
tcacccagctgggagtaaacaagatcaaagagattgctgtgaccgtgaacaaggcatgataaagtggagcagagcgaagctgctgggaaaagtgtgccatgaccgctctgagtctccaagctgatctcccagcagaaagcttcactttgctaagatggtggtgtggcatgcacggtgatgagtgctcgatgattagctgcagcttaaaattgattggcatcaagaaggtacagggtggagccctcgaggattctcagctggtaggctggtgtggcattcaagaagatgtttctcttacgcgtggcgtttgaattgcaacccaaaaaaagtaccaaatcccaagattgcccttttgaatgtcgagctcgangttgaaagctgagaaagacaatgctgagataagagtccacacagttgaggattatcaggcaattgttgatgctgagtggaacattctctatgacaagttagagaagatccatcattctggagccaaatgttgtcttgtccaagactcccacatggngatatgtggccaccgcagtactttg

SEQ ID NO: 553826 - DNA, 119 bp, Homo sapiens
atctagaggatcccatcaggcgaatatgtgtgctacgaggaccacacgggtaagccgtggggccggacagactacccccatcttccgggggcatcaaccctctcagatggcattgtgtg

SEQ ID NO: 553827 - DNA, 454 bp, Homo sapiens
  misc_feature (45)..(45): n is a, c, g, or t
  misc_feature (65)..(65): n is a, c, g, or t
  misc_feature (74)..(74): n is a, c, g, or t
gggccaaacgaagtcgtggaggtggcgaaacgaggaggagataancgctggcccttttggtgggncctcctgtngtgtctcccccagtctgctaaagccctaaggccatcacaggacttccagcatgcccggggcagacgggacggggcgggctcctcctccgagagcaaccgtgacgaggagcgcctccggcagcggccggagaccatcgaacatcaacaaggacccgtactttccaattgcaaaagggaaaaaaccgcaacgcgtgggggctcccgtatgaaagtgcaaactctgcctgacattcaaacagaggggcactggccatacgcaggggaagaaagcaccagaccaacctggcccggcgagcagcaagaggcaggaggcccctgcccagcccgcgcctgagaaggtcaaggtggaagggtggacaagcgaaaacgttaaaaaaagg

SEQ ID NO: 553828 - DNA, 106 bp, Homo sapiens
aaggacgaacagctaaagcaggaaaataaaactcttagaaaagatgtgggtcagctgaccaggtagaggattcaagactcactgtggaaaaaatattttaatacta

SEQ ID NO: 553829 - DNA, 193 bp, Homo sapiens
tgctcctgaacccggcgagcatggtcccacacacctttgtcattactgttaccggtggtgaggatcttcggcacatcgatatagccgtacaactcaaaggggcccttgcgcccgaagtactcgtattccaggtagacgtcatcttgaggcttggggccgaaactgatgtctttgctgccaatcagcgtgaggt

SEQ ID NO: 553830 - DNA, 1641 bp, Homo sapiens
  misc_feature (775)..(775): n is a, c, g, or t
cgcgctcggggttgtatgacattgtcgcgcggaggtgatattgcttgtttcttccccagtgagctgcgtgtgtccccacttgtggctcctagttttgggagcccctatagatggacaccctggtggtgacgcacaaaacacccaccgcgctgtgtggtgcccaccgcgtccctcgggtatgtctctcccccgggatatatttgtctgtgtagggaatccacatcaagcgtgggtttgttcgctcccacatcctggcggttcctccggaagaggtatgcacaccacccgctcgtctcgttcgtgttgacacccacgggcagcccccctcctttttcccgatgggtatagaacgtggcccccaccatggggaagggaccccaccctcctccttcctcaagaacccctgcgttggaaaaaaacggggctgcaccacccttgggtgaaaggggggaaactcctcctctatatgaggtgtcgacgacgcggttgaactaaaccccccacatgtagatgggtggggggtggcgacaacagtgaagaaatcgaccccccagaggataaaaagcggcgggtgtatagacagaagagcccccctccccaaaaaggggtctcccccctcttatattccccccaattttcccccagcaaacagagttgttttatagatggcccccccatatattataaatttgggcgccaaatcccccccctctcccacaagagaagagctttgcagagaggtaaaaccttctccccctcgttgtttcttgccaancaacaacattcgccaccacatgtgttttctgtgtcttcctttcgtagaaacaccctataatataaaatatggggtatattatagggaaagagaaattcttttgtcttctatcccacagcagaagaaaataagaagaaatttcttctcggagagagcgttatgatgagagagagcccccccccatcaaaaaggagagacagatgcattgactatgagacaccacccccacacatatatttatgaaagagcgccacggagatgttctccccctcatagttgtccccctccgacacacaggtggtctacacaagaggttttataaagagagagagaagtattacaccccggcgaataaatacgatatatagagatggagatctccctacatagtagagatagagagagagaagagaagagaggtttttggagaagagacactcccacacacaggcgggttgtgagacccccgcacccacttgagagagaactatagagaaatccacacggtgtcgcaaaaggaccacaccttttctcataatatatgagaggagtgtagactctctcgaaagagaggaggccacacaagggcacgcctcgttggttctgagaagaacaccctcttttgataactttgtgtggaactcttctaagtatgagggaagagagttcccagaaagttgacccgagaaaaggccacaaagctaaatttataattggttggtaaacctggatcccacaaatatgtttatacttccacaaatttactaaacccacggtaccaccttaaggaataatatagaactaaagcttttgcttcctttctactgtggtggagtagggaaagttactcccccctgatttcccca

SEQ ID NO: 553831 - DNA, 321 bp, Homo sapiens
  misc_feature (283)..(283): n is a, c, g, or t
acccaaaaataccaagtaaaacactacatcatcttcagctttgtcctcttcagcaagcagcactgtaacaacacaatcaccatataagggagcttgctgtggattaagtttcatgacccaggacactcttaataagccagagaaacagtgtgtctccttaggacagacgcggtgcacacgcctgtaatcccagaattttgggaggtcaaggcaggctgatcacttcagataaggagtttcagaccatcctggccaacatggtgaaactatacatgtcccgtgnggctcccggggctcccccgcgggccgagctgggacaac

SEQ ID NO: 553832 - DNA, 428 bp, Homo sapiens
tgctcgctgactattagttgcagaaagaagcacggatcaaaatcattattacctaaactatcttgtggagtaaaaaacagactgcacattcgaaggaaacgaattgtagggaggagagcgagcacaactaggaatgactccaatggcaggtggcaattaaggatgccagtagaatcaccctgtgggaaaacataatcattggtggctgttggattctgactgctgcacattgtctcagagccagtaaaactcatcgtaaccaaatatggacaacagtagtagactggatacaccccgaccttaaacgtatagtaattgaatacgtggataagaattattttcccatgaaacactcacaatgcaggcacttaccatcaatgacatcgcattatgaattgaaatgcaaaaaagccggcagaacataacac

SEQ ID NO: 553833 - DNA, 168 bp, Homo sapiens
  misc_feature (130)..(130): n is a, c, g, or t
acccaaaaataccaagtaaaacactacatcatcttcagctttgtcctcttcagcaagcagcactgtaacaacacaatcaccatataagggagcttgctgtggattaagtttcatgacccaggacacgtgnggctcccggggctcccccgcgggccgagctgggacaac

SEQ ID NO: 553834 - DNA, 860 bp, Homo sapiens
gtttcaaacacaaatgcagggatgctgccactttttaactattaagaggcagaaaatgcacaatattgaactttttccactgaagtagtgtgcagttctaggtgtgcattcctgatatgatttaaaacatgtaaatataaagatgttaaaaaacaaaaaccaaaactgtgcagagtctacgaagtggttggtcatcttcagcttatgcacaacttctgttttaggttaacaaaaggcattgttcgagctgtcccatctccacggtttatcccttgggggtttctctcaacttataacttattagttcacatcatttcgtatctacatctttttcacaacaacttggtcatgtgccttttattaacgttcctgtaaccaaatataccttcacatggcaaacacaatgaatgttttcattcagatggaaacaacttttctccagactggacttgcctaaatgggcttcaatcctggctgtcacatactgacgacaggtgcctcacagacattttgcatgccggggacttaggcttcaccacagggatcctaaattccttcggtgactaaaccttgcctgtgttacccaaggacaccatatgcaccaacgaaacaaactgggtcaactaccaggaaacatcctttagaacactggtgactaaaggtcccttattgccccggtcaacgtctccatggtgctcccctataccacacttaacctgtagtcctctcataaccggtacaatggcttcaagcactgtacgtcacttggacaggcacggacaactgggcatggcaatccactaaaggataatgcaacatgcctggagataaacgctatcagtgtgggtgtaactaataca

SEQ ID NO: 553835 - DNA, 457 bp, Homo sapiens
tttgaaatagcgtaactagattttctgtagaagctttaactccccctcttcttaagagaattttaatgaagctgagataagaagcatatttactttcagtttgccccattgttatcctggattcctcccagcacacaagctaaccgcaaggctgactgtggacgtactcgggaatctctcatcggctgtcctcaatgctcacgttcttagcgtaccttcaccctagagaagggccccacgctgggctccagatgaaggggtggtctgcccctccacacctgtgggtatttctagtcaggtgggatgagagacggagaaaagaaataagacacagagacaaagtatagagaaacatcagtgggtccaggggaccagcacttagcacaccaaggacatgcacaggcaccggcctatgagttccctcagtttttattgattatgattttcattatttcag

SEQ ID NO: 553836 - DNA, 232 bp, Homo sapiens
gagtcttactctgccaccaggcgggagtcagtggtgtggtggtctcggctcactggaaaccttcacctccggggttcaagcaattctcatgcctcagcctccccagtagctggggattacagagcacgtaccaccaggcccgcgctaatttttggtaattttgagtgcagatgggggtttcgcgcatgtgggccgaggcgtggtctcaaatctccgtgacctcagggtgatc

SEQ ID NO: 553837 - DNA, 128 bp, Homo sapiens
gcggccgcctactactactactgctcgaattcaagcttctaacgatgtacggggacatgaaacagtgtatttggatgaatgctgtgggaggatgtaaatatcttgtttctcctcaaactgccaaaaaa

SEQ ID NO: 553838 - DNA, 173 bp, Homo sapiens
gtcccattccacatcaacccctgatattgggacgtctacaaatggatagggcaaaacagacctgggagcatcgtccccagcacagccggtcttcaagagcccagagccatagtcacacaccaaggcagagctgtcctacttcttcacacatagctggagctgcttcacaggat

SEQ ID NO: 553839 - DNA, 538 bp, Homo sapiens
cggggcgttggggagtggcgcgtcttgacctgcggggctacaagaatggcatgcctggacccccgcacctgcatgcccggatctgacagtgacctgcgagcctgcatgctccgcgtcttcccttgtaacagtgtagccgtttcggcttgctgatgcgacgcttgccgctagttctaaccactaagcaacataatcacacacagacacctatacatcgcagatagacaaatcagcatgtaaagctattaaaagcatcggtcataatacaatcacattgagagtgcatcgacatgtcccagtaccacatcatgtcgaacacaaatacagatgcacaatcacaccatagaaagcaaatatcactaaagactacacaacagcagatgtaaaacgacacaacaaaacgcatatccagaagttaattccgagcaatagatgagaagtatatcaaaaccaaagaaaacaaaccagttcgaatagcacattcatagacaaacttagatatcaaacagcgaaataaaaacggacaacaaatcattag

SEQ ID NO: 553840 - DNA, 118 bp, Homo sapiens
gatcccctggccccacacagtgggttaaggatccagtgttgctgcagctgtagcttacgttcacaactgcagctcagatctgatccctggcccaggactgccatatgccatggggtat

SEQ ID NO: 553841 - DNA, 169 bp, Homo sapiens
ggctgatggagtggcggtgggagatcaggaccttttccagttaggttgccttacctgtgtggggtcgcgtgtgtctgttaacctgacacggttgcagacctcgctctttggcaaggaaccgactcttgttgcgggcagggacacgtcctgacttttctccttggtactc

SEQ ID NO: 553842 - DNA, 295 bp, Homo sapiens
  misc_feature (283)..(283): n is a, c, g, or t
tgcgtggtggcttgtgatctaggatgcttatcttctatcagtgtttgatgtgtgtttttgagatggagtttcactcttttgccaggctggagtaaagtggcacaatcttggctcgctgaggctccgccccctggggttcatgccattctcctgctcagcctcccgagtagctgggactacaggcgcccgccacctcgcccgggtaattttttgtatttttagtagagacggggtttcaccgtgttagccaggatggtctcgatctcctgagctcgtgatccgnccaccactgcct

SEQ ID NO: 553843 - DNA, 775 bp, Homo sapiens
ggtgctgggcgctggagctcttggaacagtgctgccgtggggccctgccccggactcgctgcagtgtgtcggctgcagcctggcggagcagtgagctgctgtgctgtgctgctgtggagtgagaactgatgctgcctccgcagggagctgcgctgctggtggccacatgtgatgtgatgctgctgctgctgcatgcgtgcatgctcaatggagtgtcactggacctgacatgcgtggacgcaactccgtgtgcgcacaacctgctgacactgctggcagctgcgtgccagtgagacccgagtgcgtttgcagtgagcatgctagcagctgccatcctgcttgggtgaacggctagagctgctgtgcacaatgcttggcgtgcacatgcaggaccacatgctgcagcgcctgccgcatggacccgcgacgagggaggctgccaggcaggccctggcggaaggcctgcgaactccgcatggctaagagagctgagctgctgggggcagtgcctgggctgtgcccggagcaccgagcaccggacagtgagcccagaatgggctgacagccggccgcagtgcgcccccagggaaccctgaaggacccggcggaggccgcgcagacagctcggggcgcccctcgagaggcagggcagtgccgcttcagtcggggaggagtttgagcaagatccttcaggacgcggaatgaactcaaagccaaagtgttcctgctcaaggagaaactgggctaattccagcgggagctgtcacaaaccacg

SEQ ID NO: 553844 - DNA, 512 bp, Homo sapiens
  misc_feature (129)..(129): n is a, c, g, or t
gtaatcataaacatggggcagtgctaaggtttggatgtttgtcaccttccaaaattcatgttgaaatttagtccccagtgcaacagtactaagaggcgggaccattaggaggtgatctgaccgtgaggntcccacctcgtggatgggattagtgccctcattaaagggcttgagggaatgtttgtcccttttccaccttccaccatgtgaggacatagcaacaaggcatcatgcttgaagcagagagggcaagcccacaacagccactaaatctgctggcatcttgatcttggacttcccagcctccagaactgtgagaaataaatctctatttacaaattacccagtctgtggtatttgtaacagcagccagatggactaagacagggagctcccaggagctttccttaaaggagacatgatacatgcctctgttagttggcaggggtgggggaattatgaacctttatttaaagatttatttttaaaaataaaataagtaaaacaaaaaa

SEQ ID NO: 553845 - DNA, 1038 bp, Homo sapiens
ggaggcttccattctggctgtggctaccggggtcgtggtcggggaggatgaatgaggaaaccagtcggggtaagaaattgtgatggtggagccgtatcggcttgagggtgtcttcatttgtcgaggaaaggaagatgctactggtcatctacgaacgctggtccctggggaatcagtttgatggaagtagaagagagtctcgaatctctcaggaacgtgaagaatgacaataactatgacgtaacgaagtctggaacctcattccagctccagatgcatagacagcaagcaactctctgggtgagtgtggaccgagatccacatcgtaatcggggggctaaggttctctaccttcggggcgtgtctcgggcaccacggtctctacatgtctctgaaattcgtagagtccggatgagtctagtatatgctagtcgagttctaccaacggatctggccggtgacacctcaattaacttgggcactagaaagatggacctaaaaatcaattccttgtgaatctgcagggaatgcctcgaccacccaataacagataccgaatggatcgatcagtaactcgggtaggaatgttgaatcctttgcctagattgtggccgcatacccagaccaggaggcctggtattgtggcctgagatgtcgcacatcctgtgcgtgcgttaactggaggacaactgtgtgatgtccatttaatgggactactgtttgaatcctatgagactcaggcgaggatcgtgtttgtcatccgaaggtgataaagatgctagagggcgaacatgaagccgcaggagcagttgagccttgaggcatatgaaagagagcgtggcggggttcgtggactggtaggcaaccccaggtgagaatgatttagggctgtccggatggagagatgtgtgtggacggggggggggtttaattaaagatgtcggaaagaaaaggggggggaaatttcgggggcaggaacacgtttggaaggcaaagaggttaggaggggtaaggagaaaattttaaattggtgcaaga

SEQ ID NO: 553846 - DNA, 100 bp, Homo sapiens
cggctgaccggtgtggatctgaggtactccagccgcaagctctggtacgccatcttccccaccgtcgcctgccgcggcgttggatgcagtcgggtaccga

SEQ ID NO: 553847 - DNA, 376 bp, Homo sapiens
ggtcgtcacaggatcttctttggtcagctctattctgtgcgacctgaatgtgtgatatatagccaaacaactggtttgtttgttacattttgagacagggtctcgcttagtcgccgagattggagtgcagtagtgcgaacacagctcaccacagccttgacttcctgtgctcaaatgattctcctgcctcatcccctcatcctgtgtaactgggatcacaggaggatgccaccatgcctagctaattttttttgatcttttggtagagacacgatttcactttgttgcccaggccggtctcaaatttctgggctcatgcaatcctgccttggcctcccaaaatgctgggattacaggcatgagtcactgtgcctga

SEQ ID NO: 553848 - DNA, 282 bp, Homo sapiens
ccgatgtcagatcccctaattgcatgagtgcacgattgtagcccggggaccttgtgctgaacggtggttcgagtagccaacttttagtgctcagatggcgatcttgatctgaacgcaggtccagggctcacacgttgtgccgtcctcttggtcgagccgcggctcctcatccatcgatctggatctttaccgtgcttctagtaagccaggatgtctccaggccacttggtgattgtctgcttctcacagacccaaatttcctgtgcaacctgctgaatgagt

SEQ ID NO: 553849 - DNA, 124 bp, Homo sapiens
tgcaaggaaattgtcgacagattcgatcatggcagacatctcaccgaagagtttggacttattggtttttcaagaatgttcaaggaaccaatcgccccgaatagggcgagatgtcgtttttcga

SEQ ID NO: 553850 - DNA, 902 bp, Homo sapiens
  misc_feature (5)..(5): n is a, c, g, or t
  misc_feature (20)..(21): n is a, c, g, or t
  misc_feature (205)..(205): n is a, c, g, or t
  misc_feature (418)..(418): n is a, c, g, or t
  misc_feature (494)..(494): n is a, c, g, or t
caggnaagcgcgcactttgnngtggggtaactccgggggatgtctggcccattaatgtgctcagagggtccataaggaatctagcacaagggagaacacaacagggaccagacgcctggtcatattgctgtctccgacaacgtcctaccaccaacgtcactcacaaatataatgatcttagtattaaacaagaccttgatagctnctaacatctctgtaactccctgcgaatctcgaacactacatagacgatgcgaacaagtacataaccgccctacccgccacacacatctttctttctctacatattaatcacatgtacatgtgtttctgtgttgtcgggattggcgtttgtagacaaataggaggaagaaaggtgagtggagcaagggaagggccgagtagagatatacaatantacaccacaccccacaccgcccacccaccatcatccaaagacgcacgccgtcacatacataaacaaacgataaganaaagaacgagaagaacttatgtagcgagaggaagagaggatgcagataaattaagataggccggggagggtcatgcgcgttgagggggtttgtgcggtgaatgtcatagatgttagagtgtgggagttcggttgtattcgagagaagcaagcgtagcaaacgcatacgcccgtggacaaatatagcaggaggaacgaacaacgaaatggtgtaggtgaggatggatcgtatttactagataaattgcgcatccacctccacagcatcacacggacaaggacaccgtcaacatgatacatcctagaagttaggagaatgatcttctaatccgtgcactaccgccatcattatgtgagctagtcaataaacaatcttcgcactatcctacgtcacgactgtaccattctg

SEQ ID NO: 553851 - DNA, 887 bp, Homo sapiens
ctgcaaccgctgaaattccgcgcccacagacgtgactttcagcatgacacgtgaatgacacgtgcataccaatattatatgactgcctgccactgcactgcctccgacccgacatcattgccgataatacatcccaccaatactcaaccaccatacccacacaccccacaactcacctcacatccatgacaccccctcgcactcgccatcccctctgcaacgccaccacccctcacacacacctcgcacagcaacactgtgccgcattatgtagatggcgcccttctttctacacacagcacatggcacactcatttgcagccatttcgtgatcaactttggcttatttgtatgtcaatgcgatttgctacaagactggtgtaaaaatagtagtggcaatgacactaaaaaaaatgattgggtgataatatcaagatagagctatagtattggttgtgtgaccaaagcaatggatctttgccaaagcgcaacaatgtagtgagtggaactgtggacaaggatttatggttatttataaatagacaaatgagagtgctacagaaataaatggaattggacattgagtaggaaaacataagcatagccgttggattataattcaccatggtgattgaccagcaaattttatgaaaaaaatccatatggatgaatacaatttgaatccatatggagcaggaaaacatattgttatagaagacacacaattatattggaaacgtaaaataataattttggtaaaccagattaaagatagaaaaattgtgatggaacggagatctaacatacagatatgacatgaattagattctttcgatagttaaattaatagaaacaaggaagtgtacatgagtgtgtgtgattgtgtt

SEQ ID NO: 553852 - DNA, 596 bp, Homo sapiens
accacctcgtatactattgtcccacagttgctgcgctagtaccttctagccacctttcccagtcccaggacgggccgtggagggagaaaggagcctgtgccccgctgatggctctggctgtcctgatcctgtcttccactcccctgaaggaaagtttgcactggatataataggagcctcatctaccccagcgggcatgcgggctggagcctgtatatatctatatactcagtgctctcagttcagcttcctccacctcgcttccatctgcataggctcaggaaggagaatggcccaagccaaagtgggccccaaccctgcccccgtcgtgcctcatacttcccttgccgggtcctgctggcccctgtaaaggtcccgcccccaaagaccctggggccagcggggccgaagcggagttgggtttgccttatttgctccttggttccgttctttgcatagtttcttctacccctgttggagtccgggctggagaaaggccgattatgcgctatttcatcattccctgtcagagtggggaggggtctcggcgttccgatcattctccccacctcggggtggtggctgctgtcccacgg

SEQ ID NO: 553853 - DNA, 123 bp, Homo sapiens
  misc_feature (13)..(13): n is a, c, g, or t
  misc_feature (16)..(16): n is a, c, g, or t
  misc_feature (20)..(20): n is a, c, g, or t
gtgttctagaggntcncgtnctggatgaggataagcggatcatggcacccgtcagaccccagcggcccggaacaagacccgtgtggtcagctaccgcgtgcccacaaccaagcgctatctctt

SEQ ID NO: 553854 - DNA, 385 bp, Homo sapiens
tatagagctgctcaggggagtgggctgctcttagtccccgcctcgcatggggtgcctcctctccctgcgatgggggccgaagagcgagaggtgaacgaggggctggctctcagtccctgcctcacggggggtacctcccccactgcgatggctgtcctaagacacgggggggaagaggagctggctctcagtacctgcctcgcgtgggagtgccaagcgcctgcgatgggggtcctaagcagccacggggggaagaggggcaggctctccgtccctgcctcgcggggggtgcctctccccgctgtgatgggggtccttaatagccagggggcgcagaaggggctggctctcagtccccgcctcgtgtggagtgctccccccccgg

SEQ ID NO: 553855 - DNA, 382 bp, Homo sapiens
tagctgccaccatctgtgctgggcccagccgagacgcagaacctcgtggacatgacctaggaagacccagacagtgtgccccacggatgtcctggatcaaagggacccaggttggtgattacttctactcctttggcggctgttattggcacgcaagctaccggtagctgcagcaagggccatcctggacaagcttgtgcagtccaccctctcggacctcagggtgtacctgggggcatccacgccagacttgtaggagcagtccccatggcaccgactgacacttctaagagcccagaagatacatctggcccccgtaggctgggctggcagaagggatagctgagatgcgttctctttgcacttggtggggagggtctga

SEQ ID NO: 553856 - DNA, 234 bp, Homo sapiens
atccgcaagaaaattctattcaccaaaaatttcatctaccatttcattcatgttaaaggcttcagcatcacttaggtttacaaagaatacaccgtcttctgttaaaagggttataagccagtttccaatctagggtacatcatattaaaccaatctgtatgatagcgtccacttgtttcagaattgacattcagtttgtaaccgtcgttgtctacttgaccagtttgatgaagg

SEQ ID NO: 553857 - DNA, 364 bp, Homo sapiens
agtattcgttccgggccctgttctaccccattgagggatacttgtagcacgatccatatgcattattaaaccagaaccagacctggtgcttgaataccgtacacatggacacagtagcactccaagaatactcattctcatcccgacttccctctgaatttatgccgcgatccgtcattaaagccgacacggagcgacatgcttgttatggatcacttctaccaaactaaagtctaccacagtcagcttaccacgcacatacctctatgcgggacgtctgggctaagctcccactatccgcatcgatctctacggctacgacggcatattaacctaggcgtatccgactattgaccctatgggt

SEQ ID NO: 553858 - DNA, 443 bp, Homo sapiens
  misc_feature (82)..(82): n is a, c, g, or t
  misc_feature (90)..(90): n is a, c, g, or t
taggagtagcgttcctggaggaaaggagggaggatggggtgagacaaagatagggagggaatcaacacagatcctgctgccntcccatcnccaccttctcccacacctacttccagtttgttccctcacttttagtagaatttgagcttaaaaagacaggattagagtgacttactgtaattttcagtgtcatacatacacacatattactattttttcctctagaggaggggaaaaaaagaacatcataaagaataagtgctatgttagccgggcatggtggcactgcctgtagtcttggcctcacacctcagcctccccgagtagctggggaggctgaggcaggagaatcacttgagcccaggagcgagaggttgcagtgagccatgattgcactactgtactccacctggaagacagagcaagactcttgtctcaaaaaa

SEQ ID NO: 553859 - DNA, 1237 bp, Homo sapiens
ccgcctttttttttttgttttatacaaaaggatttattaaaaaaccagtaagtacactactacatcatgcacactgctcacacgtgggcttttaaccacagagaacgttgctctcacaatactgggggaaagggcataataacgacaaatgtgattctgaagcatagcgaagttaagaaataaacacaagtgaagagcaaattttcttttctaagtgagaaacctcgagaaattaaactttcagacagggcacccaagcgttcatactttcacattcgagggacacgttgcatcaccaaacaatatttaggtgtgtgacacgtggctatatagccacggtgtggcaccgagcccaacctttcaaatgtgaatctctttcaacattgtggaacacatacgtggctctcagccacccgtgtgtggcgggatataacgctgtgcacaatgtggaaactacacttctacgctacgtcggttgtggtaaggcatattcttggaggtgaccacctgtcgcccgtgggaataccctttgcccattataccaacctcgtggcgtgggtgtgctacataacatcaccatatattctcactagatagctgtggtttgataaccccaggtgttagggtcattaatcctacacatacaccacgcggtaacctgtggacgtgtaatattccataagttgccattagccttggattcgcaatagttcactatatcccgtggtctcccagttttggcactcggggccaccaacctcttcccaccgacgctcttcctgccaaactcctcctctagatccccagtgttgcctgtcgccgactctggtgtcctctcgcacgtggctaacttttacttccccactttcactaagaccacccttgcggccacttcctttcccatcatcttctccctggatcaatcttccttaacagggtcatcaagccgaaaccaacggccctttattgggcctgcgtcgccccagaggacgcccaatggggttcacacgccacctaaaaccagaaaagacgatcccctaacatgcccctcacggcgacttgcgagacacagggccccaccaaaactatctaacacgcgcccatcgatcacgaccatgcccctgggaacacacgcccgcacagcagctgtccgaccaccactactacacccgcgtatccagaccaacaccggccgcgcaacaaacaaacgccagcacgacacccccttgctcgcaac

SEQ ID NO: 553860 - DNA, 140 bp, Homo sapiens
aagacaggtttcagagtgagagagtgggaagggagccagctcagaaaggaaatctggcgtgtgtttggggttgggaccccacaaaggggtccttgttggccctggctgcctgaggagtctctgaagaagcatcaggaatg

SEQ ID NO: 553861 - DNA, 135 bp, Homo sapiens
tcttgcgtacgttggccagtgtccagtgcctgtagcctggacttgatctccaccgtggtcacgccgtcacgcagccacactgcgccggcgcttttcagcgctcacgcccagctcatcttcgctcgccgcacgggt

SEQ ID NO: 553862 - DNA, 256 bp, Homo sapiens
  misc_feature (8)..(8): n is a, c, g, or t
  misc_feature (247)..(247): n is a, c, g, or t
  misc_feature (255)..(255): n is a, c, g, or t
gaacccgnaagcggacttgacagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccgctggcactccagcctgaacagagtgagnttcctgtnc

SEQ ID NO: 553863 - DNA, 123 bp, Homo sapiens
gcggccgcctactactactactgctcgaattcaagcttctaacgatgtacggggacatgcatttagatttatatttttgccagaaaatacaaggttataataaaactaagaactaccaaaaaa

SEQ ID NO: 553864 - DNA, 206 bp, Homo sapiens
gtcgaccgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaat

SEQ ID NO: 553865 - DNA, 359 bp, Homo sapiens
ccctggagtgcgttgaatttgccgtgttccccttcaaccatcgtggacaagctcatgtctgtggaagcacagccgcctaccgtggctgggccatcatgcgcgccattcccacggtcctgctcctgacggtgctggtggccctcacctacatagtgggtctcctatacaaagagcccttcaccgctgagatctaccggcagaaagcctccgggtcccacaagaggagctgattgagctgcgacagctttgctgaaggcctggccagtctcctggcctgccccaagtggcaggccctgcgcagggcgagactggtgcctgttgctcagggctcgcccccggcgtgtgctgccccagtgcct

SEQ ID NO: 553866 - DNA, 104 bp, Homo sapiens
tggtgactctagaggactccgggactggagattgtctgagggactggagactgtctgacgggacccggagatgtctgagggaccgaggaggccgccgcggggta

SEQ ID NO: 553867 - DNA, 991 bp, Homo sapiens
gggctctgtgtgctgtagtggcgctgcttgggcccgtggcggatcgtacaactctgtgtggctttgtgtggctgggaatagcggaggagagggttcgggattccctcgtacgggatcgcccgccaaggtatgaagtgctgccgagaggatgtcttcaacctcgccatgtgggtttggaagaacgtacagtcctcctccagacagacagatctgggatctcatctagattgggaaggtagcagcaccttgggttaaatggataggagaggaaaccacatgagttcttgaagacttatgggtgctggtctagagaagagcatactggatcggtcttggttataggagaatcacacaatcgatcatctcagctttgactgatggcgggggagagtaagacacagggaataattagatgaggagacctgagaagatcttcaattgattcagcggagctatggagcaggtaagactgtagcaaggaagaataatctgggtgacatggtgtggacttttggggtgaagtgaggttagtaagaaccatgatggaagagctgtgagggtggcggggacgtagtgatgagtcgagtgactggttgtattaattccaccgtgtatctctgtaacatgttccgggatgcatggttgaagagtcgacttccagtagtcagtaggagaagaaagaatctgatgaagaagttccgaaaggcgtgttgaagataatgttgtattgaagttggagggattccggagtggtgttggctatggcaaaagaggcaacttattacattgatgttgtggtaattgccagtggatgtataatttctcaaagtgattaggcggttgtttttacaggcaagagctgtattgttccattgcccaagttgggtgggtgcttatagggacagaggctgggtatagtagttcgtagaccggccctgttaatacatacctaagggttggttcaaaggccgggtccttaattggatgacat

SEQ ID NO: 553868 - DNA, 285 bp, Homo sapiens
  misc_feature (1)..(1): n is a, c, g, or t
  misc_feature (142)..(142): n is a, c, g, or t
  misc_feature (185)..(185): n is a, c, g, or t
  misc_feature (212)..(212): n is a, c, g, or t
  misc_feature (237)..(237): n is a, c, g, or t
ncgacctatgatgggaaaggtttccgcgggagccgcacagaacaggatgcggctgagagggcatattcgccgaccgctttcacctgatgcgggtcatgccgccggagggaggacatgctgtgggcactgctgccacacgacnagagttcgctggatccactgtcgtgggtcacgtcgatacgaanagccacaatcacgccgccgagacttcnactattccaccgtcggagctgtggncggtccctcctctgtcgtcatcgccggagccggaattatcggtctgac

SEQ ID NO: 553869 - DNA, 601 bp, Homo sapiens
ccgtctgatagtccccgggttcatcactcctaacggtgcctcatgatcctcgctccatcttctcccgaccatcactgctgcctgtaatgaaccttccttcactattccacaaaccaccttgccaagtcaaaagactcctccttggtgaagctccccaggatctttcccattcccgtggcaccctttacttaccatgccagatgccaccgctgccccacggtgtcccccgctgcattgggacctctttgagagcaaggatgtgcctgatccttctgctctctctgcaggcttggagcagagggagagcaagaatttaccgaacaaggctgggtgcagtggctcacgcctgtaatcccaacacttggggaagctgaggtgggcagatcacttaaggccaggagttagagaccagcctggatcaagactgcgaaaccccgtctctactaaaatacagaaaacttagccaggcatggtggtgtgtgcctgtgatctcagctactcgggagtctgaggcacaagaatctcttgaacccagtaggtggaggttgcaatgagccgagattgtgccactgcactccatcctgggcaacaaagtgagact

SEQ ID NO: 553870 - DNA, 156 bp, Homo sapiens
tatcttgcccttgatatcagtgagccatcagaaggccaggaagcagccaggcatggtggcttatacctgtaatcccagctactcaggaggctgaagctggaggatcatttgtagtcaggagtttgagaccagcctgggcaacatagcaagatctca

SEQ ID NO: 553871 - DNA, 122 bp, Homo sapiens
tgtgtcgctactttacgctacaggagcagattgagatcgttgcgagtggagatcatctggcgcacaaagcctatactatttaactgtctgctgtctgcgcctattcttatcccgaactgatc

SEQ ID NO: 553872 - DNA, 472 bp, Homo sapiens
aactacagtcagaagggtaaagttctaatgttagctccagtactggctggcacttacattcactacactgtacctactaaatcaacagaaccaattactaactttaaaaaatactttcagaaaaaaaaaaaaaaaaaaacgaaagctttttgatttattactttctaggaatttttttattcaatgaaaacctctcattcaccttcattttatacagcacttttaaccaaattactttacctttaataggttgatagttgtattaattaccacgaaaaagttattataaatttttctagaagaacacttgcccaaagttacttatgaattattggcctcttaccttattccccaaccgcccaacaaatttagttgaaaaattacacttacaaatttattgtggttttcttcactattcacttcgaagaaccccgggggaattccttcttagaagttcgaaccttgcgaggcc

SEQ ID NO: 553873 - DNA, 239 bp, Homo sapiens
ctctagtgaaccaagtccaggagattattaaatgacttatacttgccttccaaaaacataaacaagtagggagggggaactccactagcaactgtgatatgccagcattacacagtatttattggtgaacactcgtgaaagagcggaaggtatgtgctcgtgtttttttctagtcttattgtatcgtagacatgggaacgcaatttaggcaataaaacaaggcagatagatgagttttc

SEQ ID NO: 553874 - DNA, 256 bp, Homo sapiens
caagtgggctacggcatttttaatcttagagcgatagcctatactcactgcgcccgactcatcaggggatgccatgctatgtttatagatgttaggtggttggtgtaaatcagtgaagcaggagtccgaggagtgttagttgtggccctaaaaatcatttaaggatactcgtatgcgatcatcaggctcgtcctttgctgttgtgtttggttttcatttgttttgaggttagtttgattccgtctcagctcccgag

SEQ ID NO: 553875 - DNA, 957 bp, Homo sapiens
gtccactatgcaacaatgataagcggcggagataattctatgggtttggtattaggttcctcctttgtctgtcttcacgctagtttctgctccaacacccttggggccgccccgattggttcccgccgttaggatgtctcccacacaagggtatctctgtacctcgtgatgacgccgatttttgctgtcaactcagtgggtgtgcgcacaatcgtcgttgacagggtcatcacttctcggaaccctgccgcgtgctcacctccctgtagtgtggcgcccgtagccccgttgcaagtggttggctcccttgctcgcgatttttgctctccttcgcgcccccctgtggcaattcttgttccggtctacattgtgagttgcgcccacatttgttgtcgctacccatcttcccgaggggggtgtcgtcgcgcaactctggtgttcgtgctgctttaaaagcgcgcttcgttcccgatatcttttcgtgatcatccctcgtggcgcgtcccgtaccgctcccactctggaagtggggcggggcccccggtgccccgcttcgcctgatatgtctgtgtgcgccctccgttccccccaattatttggtagtgcctcttccccccgcggccccttctgggcgttctttcttccctggcaaacatctgtcggtaattttgcccccacactcttttttcgcgttgcccataagtctctcgatgacgtgtgccgggccaccgtcagcccccggtgtctgtcgcctcgtgggggtcggcgctgctgatctgtatgcatcgcactggggctttgcgcctctggtccccgctgggaggggccattcttggcccgatagacgccattgcccgccctcaccttactgtctagcaattcaccacagcttccctgaaaaacggcacccggtccaaaattaaaaaacagggttccctgcccggggaaaacataaca

SEQ ID NO: 553876 - DNA, 102 bp, Homo sapiens
tttcacaggatcttactcgatccgctgatcagcagctaaacggaactaaatacatgtacagcactcagcacaaagcctggcacacagcaggctctcacccag

SEQ ID NO: 553877 - DNA, 707 bp, Homo sapiens
  misc_feature (8)..(8): n is a, c, g, or t
  misc_feature (12)..(12): n is a, c, g, or t
  misc_feature (18)..(19): n is a, c, g, or t
  misc_feature (39)..(39): n is a, c, g, or t
  misc_feature (42)..(42): n is a, c, g, or t
  misc_feature (44)..(44): n is a, c, g, or t
  misc_feature (48)..(48): n is a, c, g, or t
  misc_feature (50)..(50): n is a, c, g, or t
  misc_feature (54)..(55): n is a, c, g, or t
  misc_feature (60)..(60): n is a, c, g, or t
  misc_feature (88)..(88): n is a, c, g, or t
  misc_feature (93)..(93): n is a, c, g, or t
  misc_feature (97)..(97): n is a, c, g, or t
  misc_feature (104)..(104): n is a, c, g, or t
  misc_feature (108)..(108): n is a, c, g, or t
  misc_feature (117)..(117): n is a, c, g, or t
  misc_feature (120)..(120): n is a, c, g, or t
  misc_feature (124)..(124): n is a, c, g, or t
  misc_feature (132)..(132): n is a, c, g, or t
  misc_feature (138)..(138): n is a, c, g, or t
  misc_feature (142)..(142): n is a, c, g, or t
  misc_feature (145)..(145): n is a, c, g, or t
  misc_feature (157)..(157): n is a, c, g, or t
  misc_feature (160)..(162): n is a, c, g, or t
  misc_feature (166)..(166): n is a, c, g, or t
  misc_feature (168)..(168): n is a, c, g, or t
  misc_feature (170)..(171): n is a, c, g, or t
  misc_feature (174)..(174): n is a, c, g, or t
  misc_feature (188)..(188): n is a, c, g, or t
  misc_feature (280)..(280): n is a, c, g, or t
  misc_feature (345)..(345): n is a, c, g, or t
  misc_feature (453)..(454): n is a, c, g, or t
  misc_feature (482)..(482): n is a, c, g, or t
  misc_feature (495)..(495): n is a, c, g, or t
  misc_feature (523)..(523): n is a, c, g, or t
  misc_feature (547)..(548): n is a, c, g, or t
  misc_feature (563)..(563): n is a, c, g, or t
  misc_feature (576)..(576): n is a, c, g, or t
  misc_feature (579)..(580): n is a, c, g, or t
  misc_feature (606)..(606): n is a, c, g, or t
  misc_feature (636)..(638): n is a, c, g, or t
  misc_feature (641)..(641): n is a, c, g, or t
  misc_feature (643)..(643): n is a, c, g, or t
  misc_feature (647)..(647): n is a, c, g, or t
  misc_feature (655)..(655): n is a, c, g, or t
  misc_feature (659)..(660): n is a, c, g, or t
  misc_feature (664)..(664): n is a, c, g, or t
  misc_feature (667)..(667): n is a, c, g, or t
  misc_feature (671)..(671): n is a, c, g, or t
  misc_feature (677)..(677): n is a, c, g, or t
aaaatgtngacntgtgcnnacaacatcatggctcttggnagntnaaantngggnnttttnatttagtgaacagaattgagaagaacgngccanatgngaatcanttangcggatttntgnctgncatttcanatgcgnaatnaanttattaatttantannnctanangnnatncttagattctttgngcttgatcacagctgatttttctacattagaaataagatgccacacaaggaactacattccagatttaaagaaatgaaaggataccattagngagtataacagattattgttcatacttgtaaagcatcctatgtcattgagaatataaagaacagngccttagaagacagtgaaaggtaagctctagcttaatgtctatgatttgttctttgacattaaggaaggtaaggattgctcagaggatgtaacttgatgtgagcagtnncatacctgttgtagatatcatactgttnatattttattganaatttatttgagagcggagaaactcatnctaaagtctgttatacagaatttnnagccttccatcttgnacctcccaacatnttnnttatggctgttggtatagcagctaantgatttaattacactgtcctttgactttannngtngngacntctttggncggnnaganggntatncattantttagactctttactattttgcgaccctcg

SEQ ID NO: 553878 - DNA, 218 bp, Homo sapiens
tgcgagtccagggtatagtccaagtgtaaatctatggtgaacatggatgcctaaaggaatggaccacagaccccagaaagaaatgggatgccagagcataccgactgacttctaccagcaaatcttcttccagttaactctgctcctcattgggcgcagggtctcaccatttctttgcctcatgcaagagataatgacgacataaacatgcaaactgc

SEQ ID NO: 553879 - DNA, 119 bp, Homo sapiens
ggaaaaaaaatgcccccccgggggtcccccccccccggggaaataaattttccccggggtccggccaagggatttttttttaagggggtgggtaaaaaaaattctgccctttggaaaga

SEQ ID NO: 553880 - DNA, 599 bp, Homo sapiens
  misc_feature (237)..(237): n is a, c, g, or t
  misc_feature (345)..(346): n is a, c, g, or t
  misc_feature (374)..(374): n is a, c, g, or t
  misc_feature (387)..(387): n is a, c, g, or t
  misc_feature (415)..(415): n is a, c, g, or t
  misc_feature (439)..(440): n is a, c, g, or t
  misc_feature (455)..(455): n is a, c, g, or t
  misc_feature (468)..(468): n is a, c, g, or t
  misc_feature (471)..(472): n is a, c, g, or t
  misc_feature (498)..(498): n is a, c, g, or t
  misc_feature (528)..(530): n is a, c, g, or t
  misc_feature (533)..(533): n is a, c, g, or t
  misc_feature (535)..(535): n is a, c, g, or t
  misc_feature (539)..(539): n is a, c, g, or t
  misc_feature (547)..(547): n is a, c, g, or t
  misc_feature (551)..(552): n is a, c, g, or t
  misc_feature (556)..(556): n is a, c, g, or t
  misc_feature (559)..(559): n is a, c, g, or t
  misc_feature (563)..(563): n is a, c, g, or t
  misc_feature (569)..(569): n is a, c, g, or t
tctctagtggcatctaccctttcttacttggttacctcatagatatatttcccatgattactataacgtgcataataaccgccgttaagggatcgtcatcagataagataggtcaactgtgcacccatgtcctagaatcttcatgagacgaactgccggcgtatctgtgtatgatcagaattgtagttcatgacatatgctggagcatgtcatgtcattgagaatataaagaacagngccttagaagacagtgaaaggtaagctctagcttaatgtctatgatttgttctttgacattaaggaaggtaaggattgctcagaggatgtaacttgatgtgagcagtnncatacctgttgtagatatcatactgttnatattttattganaatttatttgagagcggagaaactcatnctaaagtctgttatacagaatttnnagccttccatcttgnacctcccaacatnttnnttatggctgttggtatagcagctaantgatttaattacactgtcctttgactttannngtngngacntctttggncggnnaganggntatncattantttagactctttactattttgcgaccctcg

SEQ ID NO: 553881 - DNA, 175 bp, Homo sapiens
  misc_feature (26)..(26): n is a, c, g, or t
  misc_feature (163)..(163): n is a, c, g, or t
gggaaagcacgcggcagcccggctgncaggctgcaggctcgtcccattcttcagtttcctcccctggaaagctgcattaccaggcgacctcttgctggctttgagagatgtccaaatgggaactattaacaaaggcacgctcccctttttatcttcgtcacanagtgctttgccg

SEQ ID NO: 553882 - DNA, 714 bp, Homo sapiens
caagatggtgagaccccatctctaccaaaaaaaaaatgtaaaaaatattatttttttattattattatcattattggtattttttagacagagtctcactctgttgcccaggctggagtccagtggtgtgatctcagcgcactgcaacctctgcctccctggttcaagcgattcacctgcctcagcctcccaagtagctgggattacaggcgcctgccaccacgcctggctaattttggtattttagtagagacggcgtttcgccatgctagccaggctggtctcaaactcttgacctcggatgattcacctgccttggcctcccgaagtgctgcgattacaggtatgagccactgtgcccaaccaaaaaatttaaaaattaagatggttgcagtggtgtgtctctgtggtcccagctattcgggaggctgtggcaggggatcccttgagcctgggagtttgaggtggcagtgggctgtgatagcacccatgcactccagccgtgggttgacagtgtgggaccctgtctctaaaaaatgaaggacagacgggaggccgaggtgcagtggctcacactgtgaatcccggcactttggggggctgaggtgggcaggatcgttgagccccaggatttgagactagcggggcacatttgagacccactctaaaaaaaaaacaaacacaacaaaaactctacaacagggggcacaggca

SEQ ID NO: 553883 - DNA, 765 bp, Homo sapiens
cgccggcgggcgcgaccgctccggggacagtgccagggggagagaaaatagagacccggttgttgacagcctgtgatgccgcttgattcatgtgtgggtggcctggtttagaaatgtaccacccttcctttctaggttcctccccggagggcggggtgacgggtgcggcgccgaatcgcaacaggaaaacgctgctcgagggatgtcagtaactgtctcagcttaagttgctggcttttagcttacagttagtatcgtaactgtaatggtggatcttagttaaatcccttcagtgtgttggaaacatatttgttaagtgtatttttggaaacatacttagagcatttggaaatgcttttatgagagcgtttattaaatcttctgtgacactttatttttgtcagtcgtgcagatgaacttgactcactcaaggttaatgattttagttttttatttatgttagtagaggcggggttttgtcatgtagctaggtaggagttgaactcctgagctcgagcgatcgcactgccactgccttccgtgctggacttagaggcgtgagccacggcgcccggtggccgacgttcatactactcacaagttcctaagtccattgttcagttattgaactggtgtaaggcgcacttccaagtcgatgagtggggtacatacctccccaatattgtttcctgtgggaacttccagttagcgaacgggttaacaggcgccacctcagaaccgcactcatttttcacatgcgggtcc

SEQ ID NO: 553884 - DNA, 802 bp, Homo sapiens
ggttcagtaacaggacactagaatatatttaatttattcttttatttcgtagctgtttattgagcatctactcagtgcttgacacatagactcaatgagattctgtcaaggactggtgccatgtttttaagaacatggaatgctgtgagctaagagcttacttttttttttttcttaggaatttatccacacatttttagatattggtacccatgactctataatttggtcttcccacttctctaatatcaaaatttttttaaactgtcaattaaacaaaaagtttaggtcctactaaggcttctagctttggcccttgaaaccaggcctaagtacaggctaatacgttggcccttggcaacttccttaagttctctggaaaaggctctaggtgcagtatgacctgaaaaaaccaaaaacacgtgggttcaaagaggaaaaatcagcaaaagcaagactacttggcttaccccttatattggctacttaagtatttaagatagtgctataaatagcaaagattataattcttaagtcctttttaagggaaccagattacgctcataagtactcagagcaaaattaaactacacctctatggcatactggccatactttataggaatttccccttgtgtaaaacatggtgttgcgcggacacaaatgtttacagaacagccttcaacggacttttccagcccaaacacaacccagcgatacaccttacgacactgggaaacccaaggcacacacaatgtcgacgcccaacaacgtggcgcgcctgggtattccattcccgtga

SEQ ID NO: 553885 - DNA, 138 bp, Homo sapiens
taaccctatttatttgtgacagtaaatcttaaaaatcattgtctctattatgaacatttcctcagtttcttctctgctgaacaatgtaagccatgctactttttaatgtatttagaattttagtgctcattggaaatt

SEQ ID NO: 553886 - DNA, 200 bp, Homo sapiens
tctctgtgactacctctttgaagactcctcccagctcaacacgagtgaagaaataaatgactatgtaatgagaagaggcagcggaaaccagagcctgccgtttcccacattaaagaggcacagaaattccaggaattagtgaaaatggtgtcatctcttgcaggaagggcaccagctgacactggttgggtagtcacaga

SEQ ID NO: 553887 - DNA, 177 bp, Homo sapiens
  misc_feature (121)..(121): n is a, c, g, or t
  misc_feature (129)..(129): n is a, c, g, or t
ctggcgtgagatctctcagttttcctttcctgtgggccactttaaacttcgttgatcttgtaaattttctcatggcatgacctcttgtggagaagtatttggaaagacataccgtgtcctngactttcntctggactctcccacttatttctacctgttcagacccgcgggcgtggg

SEQ ID NO: 553888 - DNA, 467 bp, Homo sapiens
  misc_feature (454)..(454): n is a, c, g, or t
gcgacctagattatcccgtgatgtatcgccccacaccctgtttcaaaacgtaaaaagtaaataggtgaaattaattttaacgttttatttaacctaacatatccaaaatactatcatttcaacaggtaatcaatatagaagttattgagacattttatggctctttttaatattttaattattattatttgttaatagagacagggtctctcttacccaggctgcagtgcagtggcatgatcatagctcagtacagcctctaactcctgggctcaagcaatacttcacctcagcctcctcgagtagctgggactacaggtatgcaccaccatgtctggctaattttaattttatttatttattttttttgtagaggagatctcaccatcttgcccaggctggtctcaaactcccgggctcaagccatccttctgcattggcctcccaaagtgtnggggataacatca

SEQ ID NO: 553889 - DNA, 100 bp, Homo sapiens
cgacactcagcaggatccccccaatttccttcagagatttaaacatctatgatgcggattgcatcatcgccttcaatagcacagcaagattcaagtagtt

SEQ ID NO: 553890 - DNA, 180 bp, Homo sapiens
cacttcttccttcttttgctttgtcagagcacttcttctttattgaacagtatatgaggcctttgagactaaactaatgaagagtaaaggggagagaacctagtgtgtagcttaccctgtggaggacttatagactaacgtccaggggaaactggtgatcttaacatacctggtgtgtcc

SEQ ID NO: 553891 - DNA, 325 bp, Homo sapiens
cccggggcccccgggtgtgttagggttttttgggccttttttttggaccaacaaccctgcaaacagggccctttgagcccccccgcagtcctttgaggccccttaagtttttttgggccccttaagtttttttaaccccccgcagcccttttgggccccccaaagccctttggggccccccaaagcccttttaaccccctgttgccctgtggggcccccaaaacccttttaaatgcctgttttccttttaaccccccgctccccttttaggggtgggggcccctatgctcccgtgtgatgtttccataaaggggggtttccctta

SEQ ID NO: 553892 - DNA, 543 bp, Homo sapiens
aaagagtttagcaggatacccgtcttgactagtgataggtataatctcaggaaggaatggtaccagtacctccttgttactcgtggataaattctggctgtgaatccatctggtcctggactctttttggttggtaaactattgattattgccacaatttcagctcctgtaattggtctattcagagattcaacttcttcctggtttagtcttgggagagtgtcacacattttcttaatccagtctatcgttgtaggacatttgggttggtatccaagtctttgctatagtgaatagtgccgcaataaacatacgtgtgcatgtgtctttatagtagaatgatttatattccttggggtatatatccaggaatggtattgctgagtcaaatggtatttctggttctagatccttggggaatcaccatactgtcttccacaatgtttgaactaatttacattcccaccaacaatgtaaacacgttcctacttctccacagcctcactagcctctactgtttcttgattttttaataatcgccat

SEQ ID NO: 553893 - DNA, 394 bp, Homo sapiens
caattccattccagcgtaagcgtcctgagtagctgggattacaggcacctgccaccatgctcagctaatttttaaaaaatatttttagtagagacagggtttcgccatgttggccaggctggtctcgaactgctgacctcgtgatccacccacctcggtctcccaaagtgctgcgattacaggcgtgagccaccgcacccggctttacttatttgagtatgtaaatcacgaacatgtttttaaaagtcagaaccctgtagaaacttaaattcagatgtattactcccccccgccatctttttttttgttgttgttgttgagacagggtctgattctgtcacccaggctggagtgcagggttgccatctcagctcgtagtggcatccacctccca

SEQ ID NO: 553894 - DNA, 166 bp, Homo sapiens
  misc_feature (110)..(110): n is a, c, g, or t
atagccgtcacacgccacggagaagggtggctgtggtgtaggctggcagctactgctctgattcagccatagcctgtaacttccatatgccatgggtgaggctcttaaanaaaaaggaaagaggagttcccgttgtggcgcagtggtccttctccggtggcgtggt

SEQ ID NO: 553895 - DNA, 375 bp, Homo sapiens
cccacagggggggaatcaagtttcccgttatttttccccccacgggttttaaggccccccccttttccccccccttttccttttcccccttttccttttccccccccttttttccccggggcagcatcattggggtgtttgccgggattgggtaacccctttaacccccccccgtcccttgagaaaattttttccagattttgggccccgatttttttttggtttaaacccccaaagcaaagatttaattttccacccaagtttggggttccggggggggggcccatgaaaaaattcctgctaggaatttgggtttggtgttggaccccccccccccccctggggggtacccggagcccataaacttttttttta

SEQ ID NO: 553896 - DNA, 781 bp, Homo sapiens
  misc_feature (188)..(188): n is a, c, g, or t
  misc_feature (196)..(196): n is a, c, g, or t
  misc_feature (208)..(209): n is a, c, g, or t
  misc_feature (214)..(216): n is a, c, g, or t
  misc_feature (219)..(220): n is a, c, g, or t
  misc_feature (238)..(238): n is a, c, g, or t
  misc_feature (248)..(249): n is a, c, g, or t
  misc_feature (272)..(273): n is a, c, g, or t
  misc_feature (286)..(286): n is a, c, g, or t
  misc_feature (310)..(311): n is a, c, g, or t
  misc_feature (314)..(314): n is a, c, g, or t
  misc_feature (322)..(322): n is a, c, g, or t
  misc_feature (328)..(328): n is a, c, g, or t
  misc_feature (340)..(340): n is a, c, g, or t
  misc_feature (342)..(342): n is a, c, g, or t
  misc_feature (348)..(349): n is a, c, g, or t
  misc_feature (352)..(352): n is a, c, g, or t
  misc_feature (354)..(354): n is a, c, g, or t
  misc_feature (373)..(373): n is a, c, g, or t
  misc_feature (375)..(375): n is a, c, g, or t
  misc_feature (380)..(380): n is a, c, g, or t
  misc_feature (382)..(382): n is a, c, g, or t
  misc_feature (390)..(390): n is a, c, g, or t
  misc_feature (399)..(399): n is a, c, g, or t
  misc_feature (434)..(434): n is a, c, g, or t
  misc_feature (437)..(437): n is a, c, g, or t
  misc_feature (459)..(459): n is a, c, g, or t
  misc_feature (462)..(463): n is a, c, g, or t
  misc_feature (470)..(470): n is a, c, g, or t
  misc_feature (502)..(502): n is a, c, g, or t
  misc_feature (510)..(510): n is a, c, g, or t
  misc_feature (516)..(516): n is a, c, g, or t
  misc_feature (518)..(518): n is a, c, g, or t
  misc_feature (524)..(525): n is a, c, g, or t
  misc_feature (534)..(534): n is a, c, g, or t
  misc_feature (576)..(576): n is a, c, g, or t
  misc_feature (579)..(579): n is a, c, g, or t
  misc_feature (589)..(589): n is a, c, g, or t
  misc_feature (593)..(593): n is a, c, g, or t
  misc_feature (599)..(599): n is a, c, g, or t
gtgcccgcactaccatacatcagtatttttattattattatgttattcctttttaatttaatgtgctcgcactacaatgcatcagtattatgattcctctgtactttcctttcgctattcatcaatttcccattttttttttcagcttaagtaaccacacaattttaggcctcaattttttttttttnctggtaanggaacttgaagnngatgnnntgnngtgaatttaagataccgnaagtcttaanngtgaccgggacgtgagggaaaanngtaagatgagaantaaagaaagccttggtaagggggnnttnaaaagccnttattngcaaacctttanantcgggnnttncnggcaagtgccatcctggtncngggtnangagggtancatggggtnaccttggcaccagcttcagggttaagctcaccctngtncttggaagcacccatgtcagtntannaagaatnggcagcagtcccttagttcacatatgtttggngcaattantttccngnactttnnggccataantttggtcagttttacaccaaacggtttggcaacaaaaaaatnttntgtggattcnattnaatttnagggtcaaattaagctttcgagtccagtgggggcctccatttaatatttcccctaattcacattcaacttcacaatacgtggtcgctggttcccggcactacatgcagttctcccagtattctgcgcatcttattgtacgcctaacacggcggaacgtgcccgcttgaccacttgggggcca

SEQ ID NO: 553897 - DNA, 381 bp, Homo sapiens
  misc_feature (4)..(4): n is a, c, g, or t
aaantcagttataaccctttggttgatgttagcttctccctatgctgtcctcctctaccggagccccataggcttgtgaatggacaggttcaaggcggcgcccagggcctaagcattgagaagtgtattctccatctcctgccaaactatggctggtgtcaagggatgacagtaactgccctgtggccctctgaagaggtactgtggatcagagaaactgggtagatgtccacaaagctgggagcctcattaaagcatacaagatgggaatgggcctggaaggggaggctggtgcccagtagaggcaggtttccctcctcctccaaagcaggaaacctgagagctagagtccctgcttaattaaatgtctaaatggtctca

SEQ ID NO: 553898 - DNA, 352 bp, Homo sapiens
agactctacattactatcagagaccactatagagaccatttacccacatatagtgtatgcgagatgagatagaaaactgtggcaattatatattaccgccaggggaagaggaaaaattgttaccaagcgttatattgccaggacttacccctatacctcttggctatatggattaacctggaataactctggaaggggaggcaaagcttagaaccccgaaaccaggcgaggtcccttaggacaagttaaagagcgcacccggctatgtgagaatagagggaagagttatatggagaggccacctaccgaggctggcgatatatggttgtgcaagatagaatcttagtccctt

SEQ ID NO: 553899 - DNA, 107 bp, Homo sapiens
gatccacccgcctcagcctcccaaagtgctgggattacaggtgggagccacaacacccggccatgaattaactccgttaaaaaataaactgtatacattctgtgagc

SEQ ID NO: 553900 - DNA, 829 bp, Homo sapiens
gagaggggaacaagatggccggcgccgaaggggcagcctctggggtgaggacccatctggggtctcccgccgtctgctgctgtctgatccatggccttgtgtcggaggttcgggagaccggttcggctgaaggcatttgagctcggtcttgggtgatacggcgtcttgctcagccgggtcctgtcagttgacctagccctcttgcatcagcctaccctaaggaagaggagtcgtacgcatgtcagagaggtggcaggctgtttgcgatctgtcagattcgtggcatgatggaattgacttacatcgaactaagatgggaactgtgcatctgctatgtacgagaaagctatattcccaatcggatgagctacagtgcttgccatctgtggatgccagaatcgagctgccattcgctgaactgagactaagaagcaaagttatgtccctgatgccggaaaatgcacgctactctgtgcgctctaactctggtgaggtcattcgtggagtgaccatgatggactccgtacagagcttcattaacctcttcatggacttttaatcttcaaagccgatgacggaaaaatagtatatgccagtctaagccagaaatccagtatgcaccacatgtgggagcaggagcctacagatggagagaatcatcttctaagcaacaatgtcctcagaatctgcacactggacaacatccacaaagcgcacagggaattgtcttgaagcatggacaacagtggatgagctttaaagaatggctctctcttaatcctggtggattcattaccagcctggcctccccgggcggaatgctcgccat

SEQ ID NO: 553901 - DNA, 153 bp, Homo sapiens
ttacatttttactttcagagggcattcagcactcttaaggtgggtgatatggctgtcaattttaagcttgagggtttagatcaagtgcaagctaagcttgatctgttggccaatcctaaaaaagcaaaatctattgcgcgaaaggctgcacgt

SEQ ID NO: 553902 - DNA, 104 bp, Homo sapiens
tgtcgctctacaggatcccccgggcatacggatagtgcgggggatagggatcagctctggtgctgcgatgtgtggtgatcagcctaagcagagcttcccatatc

SEQ ID NO: 553903 - DNA, 484 bp, Homo sapiens
aggttttccccctggaaaaggggcagtgaggcccacccaattaatgtgggttgggtccctccttaggcccccccggcttttccctttatggttccgggttgtattttggggggaaatgttaggggataaccattttccccagggaacagctttggccctgatttcccccagcttgaaattaaccccccctaaaaggaacaaaaagtgggggtcccccccggggggggccgctttaaaaaaaaggggtccccccgggggcaggaatttggcccgaggttttctcccttggcccttagaaacagggggctggtcccccccgcccccaggatgggccaaaaggggcaggatgttgatcctccccctgggttccaaaaaaacctggggcttggcagtcaacccgggggaaggggttcctggggaaaccccccgttgtcctattccttcccaggttccccccaaaaaaaacaaaagggttttgttggga

SEQ ID NO: 553904 - DNA, 1449 bp, Homo sapiens
  misc_feature (309)..(309): n is a, c, g, or t
  misc_feature (474)..(474): n is a, c, g, or t
  misc_feature (551)..(551): n is a, c, g, or t
gggtcgttgccgagtccagagtattatagcctccgttatgcagatggtcctcagtctgtagcatcatggaagcagagctcggcgagctgagcattaacgagatgtggatcgatctctgtatcaacgtgggcttatgcttcgcgccgttccctgggccatggaacgccagacgtagtagtggaggagggacccagttacataccaaagctatggcatgtatgcacggactgggaagtgcgcaagtgaatagcgatgccttgtgcgcagaggctacatctgtcacgcagcgatgacctctctcagtcctancttcgtaggctttcgagtcagaacactgtgactggggcaatgcatcttggtgctgagcaagggcgtgcgatgggaatagatggcaagccacaccgctgtctatgctgcgcacaactaacacatgcatgacgacttggctcggcacgagtttgcaacatcctgcanactggcttctttcgctagtgaggtcgtgcagtgtgcaggccactgtgcgcattctgtactgcactgggaaccatggntattccaaagtcaaccgttgtacttacagccaaggattctgcaagggctcagtggtgcacgacacgagagcgcgccactgggtaggcaactgctgtccaagtcgcatatcaagcagggttcccctgggcccaattccttgggcatgcacgccatgggggttcttaatgtagaacacagtcctgggagggttctggttaactccgaggtaacggagttacgcctccggagggggacatacatttcacctccgatgaggagaccgaagtttcacttctttccatcagcccttcgcgaggggttcttcgcgaaatcctagggggacgatctctccaggaacacctttaacctcgtcccgaatttatgggcggagcattgtggtactgtcataactcgccaaactttaatgattcttggggcaactggggctttcgcgattggaatggcgacaccgtaaatagctcgaacacagggggaattcagttttgtggcacgagaaattaggccagtttctgtgggcgcgaccaagggaaaagcggcaatttgcttcacccaggggtgcgtgatttgaaattcctcttgtgggaaactgctcacatcgggtctaggattcccccggacaggtggaaaaacccagaggcatcgacgaattgggatagaacactttggtacggattgtggggccgcaattgccaacgcgtaaataattggttacacttttccaaaggttcaccgtagaaccctttttaaaaccctcttcactaggcgataacgcacagacaggataggaattggaacgcatcggattggggatacccccaataatggacaccaaggggcttccaaccagggggcagtctcgacgattattggagacttggagacgactagatttcggca

SEQ ID NO: 553905 - DNA, 181 bp, Homo sapiens
atccatgcgtgtagacgttattgatagtcagtctggtgtcacatccatgtgattgttttgggtatgctgttcccatttctgactgcccaaggggttcagaaccccagcaatcccttcctttcactaccttctttttggggggtagttggaagggactgaaattggtggggggaagggaagg

SEQ ID NO: 553906 - DNA, 152 bp, Homo sapiens
tatacgactgtctggaataccatggatgagctgcgtggtggcatgtgcctattatcccagctactcaaggcagtgagagttgcttgaaccctgggctgagatagcaccactgcactccagcctgggtgacagggcaagactccgtctcaaac

SEQ ID NO: 553907 - DNA, 366 bp, Homo sapiens
acgcctggctaatttttgtatattcttttagtacagacggggcttcattatgttggctaggctggtctcgaactcctggcctcaagtgatccactggcctcggcctcccgtgctgggattacaggcatgagccaccaagcctggcttcataattctctttatgagacagaattttgccctgttgcccaggctggagtgcagtgtcacaatcatagctcactgcagcctcaaccttctttggttacgccatccttccacctcaactacctgggcggctcgatgcagcctgatcactttgtcccccccaccggagctcctactttgccgtcatcgtctctctgccgcccctcctcccgcctcctccct

SEQ ID NO: 553908 - DNA, 732 bp, Homo sapiens
  misc_feature (326)..(326): n is a, c, g, or t
tcccagctctcagggaggctaagaggcgggaggatagcttgagcccaggagttcgagacctgcctgggcaaatatagcgagaccccgttctccaggaaaaaggtaaaaaaaaaaaaaaaaaaaaaaaaaaaaactgtgttgggccgccctgggcccccgaaaagcttttaaaaccatcggttgtggggcgcggggccccagagggttaggggaccgcgggccaaagcggttcccaaggaaacccgggccaggactggggtcgggtttccccccaataaaaacgccccggggggcacccggagcgctgttctggaaacaactctcangaggggaggtcaggagagccactaccgcgggctatatcacagggggctccaagggagagccgattattaaattaaccgcccagacgggggggagcacacaagcggagacaaaacacagacgagaagagagcagcggaaagaagcagaagagacacgacagaccaagagacaacacaagagagaggacgagcaagaaagaagggagagaagaaccaagcaagcacgaacacaagcaaccaaagaggaaggaacgagcgacaccagaacggagagaagaacaaagcaacacaagaagcagtaaacagagaaacgaaaaagaggagacaagacaagagcagagaaaggaaacaagcgaaggaggagaagcaaacctacaaggaggagaaagagaaaagagaaaaaggaa

SEQ ID NO: 553909 - DNA, 537 bp, Homo sapiens
caagaattcggcacgaggttttcccattcaataaaaatagctcggtgggacaacatattatagcattcgtggaaataaaaactaggaaccacatcataggatgttctgctccaaacttggcgctgatcccccaggcagctccaagttccctctgattcaggcagcagcgacggaggccctcccctgtcccaggtgggacccggccttcagagaggaagggaggtggtggtatgaggcatcagctgtttcctttgcctgtgggccaagatccttgccatggcagaaatacaactttgtccccagtgtctgccttctgcactgtaaaaagcaagtttccatcacaaagggttgcgattcaggaaaccagggttagaggcaaacgggtcttatttgaaaatggtaaaacctggccaggccttggacttcctgcattggttgctctcctgggacctgggaccagcccagcagggtggggtggggcagcaatgcaggttacaggatgtgaaagtggggactgaggttaggaaaaaaaaaaaa

SEQ ID NO: 553910 - DNA, 414 bp, Homo sapiens
atataaataagcaaagttgtgaacatcgtcttcactatacatctctaggtgcattatgtgtgtctattgatatgccctcttcatttatatccccaccgaactgactgtggtttatcccccagaaagctgttcgttggattctatctcgtgattgcccagcccctctcgcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttct

SEQ ID NO: 553911 - DNA, 892 bp, Homo sapiens
cccaaggttgtggtcggtcaaaagagacgtgtgacgtgggaaccattgtgaactcccaaccgagggttgtggattacgaccttgggaggccaattcgcaacccctgttgatgtcccttgcaagaagcctgggtgatgcttcccagcgcccccaggtgtccctggtgtctcgctggcaagcccggcgacattaaaggcttcttttcttgaagcccagagtttggacaaacaccagaatgtcgccctgtgcatacaagacaccccttcgggtttggaaagaaggtgcttacgccacctatgggccgtacagagacgatcaggctacgaaaaccaggggttggcgccccgtagtcctagggacagcctgggtgtaccatgacggctaacactcttggggggagactttttttaatgcagttcaaaaagcgggcgcgcgctatgacttggactgtgaccgttgcctgtcgtggacgcctgagccaagaggagggaagtaagtcactcctcatctcgacgcctccagaggcattgtgtctgcgcgagtgcatttcccacggcccctcctcgccctacgcccccggggagcccaagccgcgcttcggagttacttgatagataacgttcccccggggatctatggacactataactcccgcactgggggactcagggattggtcttgaaaaatatcctctgacaaagggggcaccccttttttaggctctggccagatccagtctgatttttgtctcctgttatcgcacgccgcaagattattatccgtctttttaccgatgcgtcgacgacgaccacgccccctgggtttaagttataggggaaacgcctcggagatcaaaaggttaaacccagaagcaaggcaccccccccaaaat

SEQ ID NO: 553912 - DNA, 196 bp, Homo sapiens
cgccctatgagttaacttggctgtgtaagcttagacaatttactatcacctccgtgattcgtcagcatcctcatctgtcgaaatgaggcataaaagcaacttcagcagttgttattgagattcaaacgggatgcattcatgtaaaatggcttagaataacgcactgcttggattaccaaggagggtaccgagctcg

SEQ ID NO: 553913 - DNA, 125 bp, Homo sapiens
gtgaagatcgacatcatagaggatccccttctgctgtacgatattgtacatgtaggcataggggtgcactgagctgagagagcacgcagccctgcgcaccaggaacagacagaccagagcaccga

SEQ ID NO: 553914 - DNA, 139 bp, Homo sapiens
ccccgtcaatttcagcaagttccaatcagccagcatgcatggccagggcaaatcaggcaacacatcacagcacagcagcccagcagcaatggctcagagtttcatcagccaagtcagcatccatcaatggaggtcttca

SEQ ID NO: 553915 - DNA, 144 bp, Homo sapiens
  misc_feature (71)..(71): n is a, c, g, or t
ggcagtgcaaatatccaaggaagagggaggtttgtcgctgattggcatcttcaggctgagctgaatgagtnctttactcggggaggcttggctgaagatgggctactcttgaggttgagggtgcgaggttacaaccaaccaggg

SEQ ID NO: 553916 - DNA, 117 bp, Homo sapiens
ggggtccagaagggagtcccttatgtgccacccagtcttcgatagtagttatatataagacctttgttagtaaccccactacaatttccatactactgatacctggggaggcatccg

SEQ ID NO: 553917 - DNA, 302 bp, Homo sapiens
attctagactgaacagaaggctgtgtagggcgtgatgttatcgcccaacactaaccatagctgatgagctacaaaaaaaacaaaaaaaaaaacaaggggggagccttcgcactcaattgccaacttttggtaacagattaatttttcccataaaaaccatttttggaaccaatcagtaatttaaaggtttggttggtcctaaatgtaagagttcagactcacattctattaaaatttagccctaaaatgacaagcctttcttaaagcctttttttttacaaaagcgccccccccatttctgg

SEQ ID NO: 553918 - DNA, 298 bp, Homo sapiens
  misc_feature (182)..(182): n is a, c, g, or t
  misc_feature (216)..(216): n is a, c, g, or t
tagtgatctagaggatcttatttagcaggcagtgttggaacagttcacgtgcggtccgtgcaggctggtctggggagtattctgcggaccggtcacgggcttggttagtcatgcgtacatgtgtgccttggggtgtctgcactccaggccttctcagcacacttccaccccagggttgcccncaggctgatctcatttctgatgttgagggctgtntggctctgtctgtatagcttgtaacaggagccttgggctaaggggctggggaaggaaagccgagcttggcatccgttctctg

SEQ ID NO: 553919 - DNA, 1105 bp, Homo sapiens
ggtcggccgattctagtttagaatagaaggggttggggaactagctgcacggctctctgattttccaccgctacagatagcaagacaaatctctcctctgccttctccttatcagactactcaacattgaaggcaatatagaatgacagacctattattgtatatataatttcgagcttagtatcttcactcagatgcgcttgaactagatagtatagagcacatagcctgattccaccttacatatatatcccccgagacgaattccatcatcgcactaatacatgttttcattctattctgtttgtcatatttatcatgcgaacgcgtgataatgattggcctcgttatgaccctaatatagcacttattatatagagtatttcagcaatgtgtcgtcccgcctcactggatagtgagtgttgatacaaatatgccggcgttgaccaccgagtgcgccctacgtgatgagataagtaaactaacgggtcacttggccactctctttccagatctgcctcgacgatctatgccgcgattggaagatacatacgtcagtgcgaatccgttgactctcgcccgctgctcgatcattcatatacagtataagctagttcggtctactctagagtcgttcactcctcagtctgccgcggtattttatttactagtgtcgtaccaccgcatgtgtagtctagtagaatgacgatacacctctatactcattatctcttacgccgaccacacattatatttagactcctcagtttcacgtcgcgagaattataatatttgacaccttgacacgcgctcgctattcaatacaatattatgtctctatacaccataagtacaagattgtgatagttatatagccagtatcgcagcgtgtataatttatgtcctgcgcacctacagcccgcgctgtattcgcccttatatattgtttgcgccatatataatggcaggcgaagatataaagctgatcgccaaatacactgtgttaccggacgtgctccgctatgtaataatgcgcatgatcgtatctgagcccgtatcttatttgctcacaggcgccatttatcatcaccacatagtatacatg

SEQ ID NO: 553920 - DNA, 206 bp, Homo sapiens
tgcagggaaaagcattggcccccaacccagcatggggcttcattgaggcagttgatggaaataaaccatttgcttttttgctacttcaacattttttagcttttccggggatttaaacccaatttgctacccaagtccctgtttttttttccatgccctgggggtaatttaaaaattaaatggccctcttttcccagattttccca

SEQ ID NO: 553921 - DNA, 190 bp, Homo sapiens
atgcatcgttggcaggacccgtgtctgccacagagaggtgatcacaggccttagctcagagcccgtcacatcgaaccctgagttccgctatgttgcagaccttcagggatgcattttgcgattctcgaacaaacttacggcgctttacccatatcctaccgaggacaccgatttggttaaccttatttcg

SEQ ID NO: 553922 - DNA, 485 bp, Homo sapiens
atgcttggggcgactggagtgactgctcccggacctgtggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctg

SEQ ID NO: 553923 - DNA, 863 bp, Homo sapiens
gtgaggacgaggagatgaagcgcatgcgtgagagcgtgaagctattcgatagcatctgaaacagcgaaggtggttacaccgacacgtccatcatcctcttcctcaacaggcaaggaccgtggttcccgaggagaagaatgcgtcgaacagcaggtcccctggatcggcagttctggcattaccctgagctacacaggcggagccatcgtagatactagatggagggcagcgcaggcgtgacatccatcagtaaggtttggaggaccatgaagtaaggcgcagagagagcaacctataggaggaatctagcactgctacttcgaccgtcgcgccagctgactgcaatgtaacgtcgcacgttcgggtgttctgacggccgacaccagatgtcgagtcatcgcagaacagacctgagaggactgcggggctcattctgaggggcaggcggagggctggcgggaatgagggcagcgcgtcgactgtggaacgccgcccagaagccgctgaaggaagagtggtggcaagaaggaatcgacgctctcgccggtcgtggtttctcacccggcagcgtttctcatcactcctttcctctcgttctgtgcttcagcttcacccactgatacccgtctagttccattgaccgtgagggggaaggggagtttgccaagatggcgtgccttggttttgaggggaattgtgataaggtgtgagaatgagtgagtgggacggggcatgataagctcacattgtgggcagtatagtcaaagggttaataaaagggacttgtccttgtacattgagaattggggtggagggggagaggagaatgctgaagtctccagaggggaatggggtactggagg

SEQ ID NO: 553924 - DNA, 248 bp, Homo sapiens
atcgtatgaaggctaatcacctgtgttgctgataggaacagtcccttaaccagtctctaactgccagtcttgcctgccccccaagctctcctctacactgccagcagttcttttctttatttgatatttttcagattacaaaactggtacatgcttgttatcaccagtgaaacaatacaagaatatgtaaagaatatgagacttttaaaaatacaattttgataattttactgcttcttagcttaaag

SEQ ID NO: 553925 - DNA, 603 bp, Homo sapiens
  misc_feature (69)..(69): n is a, c, g, or t
  misc_feature (410)..(410): n is a, c, g, or t
  misc_feature (412)..(412): n is a, c, g, or t
  misc_feature (421)..(421): n is a, c, g, or t
  misc_feature (449)..(449): n is a, c, g, or t
  misc_feature (469)..(469): n is a, c, g, or t
  misc_feature (487)..(487): n is a, c, g, or t
  misc_feature (489)..(489): n is a, c, g, or t
  misc_feature (504)..(504): n is a, c, g, or t
  misc_feature (539)..(539): n is a, c, g, or t
  misc_feature (541)..(541): n is a, c, g, or t
  misc_feature (571)..(571): n is a, c, g, or t
  misc_feature (586)..(586): n is a, c, g, or t
cttgactatcaagaacgcatccatgttcacatcattacgacatgcaatacaagcacatgcgcgtcttangtcccaatcccgccagcgccatcaacaacgccaaaccctgttattacaattagtcgtgttccggcaccgtgtaaccgtattcgcataacacaaccgaccgtgttgtttgaaagttgcatatccgcccatgcatgcccattcgtcatcgtgccaagttcaacattacccgcacgcgaggcaagtgcacaataaagtactcaatatccgagtgagtgttaagccataacgcatgtatgtcaaacctcatgtacccatgcacccgttagtgccgcgagtttccttacacccccagcagggcccccccatacgctgcggaccgggctttatctaaccgcaaccgngncgtccacgnttcgcgaacccaggccctcatgaggcgntttgagcaagttttgacctnattaacacacacaatggngngggaggttcaaaagnacttcaaaagaagacttttccgagtcgtgggtcgntnacggttgacgttcctaaagaaggcaggatnaatttagacatgggngtagggttacggggccg

SEQ ID NO: 553926 - DNA, 599 bp, Homo sapiens
gcatcccgtaccagactaccgtacacactcgccactgttcacgagatcacgcgagtggaaccattgaacttttgggttaattcatgaaacaattcagccacaacatcaacatggatcgcacattcctcagggaactgtggtcatgccaaacttcactgcaattctcagcaataaggagaactggaagcatcccgacacatttaacccagagaattttctggatgagaacggacacttcagcaagccggagtctttcattccattttccctgggtccaaggtcctgtctgggtgagacactggcaaagacggagctcttcttgttcatcacgtctctcctacagaggattcatttctcttggccgcctgatgcacagcccatagacatggatggcattatgggtatagtccgctatcctcaaccctttagcatcatttgctgcagtagagacaccaaaaagtgacttgaaacatgatatatagagggaaaccaataacagcacagctgttgagtgcagaagagcactttggctcatctatatcatatataaacaactgttgtcaggtcattctgataataaaggtcccaaggatatgata

SEQ ID NO: 553927 - DNA, 167 bp, Homo sapiens
ttcccgtgtacaaggagacgagaagtaggggaatggcttaggtatttggctgggggtgtttcccaaggacgggcttaaagaagataaagaggtgtcatgacactgatggacttacgaggccaagagaacagacaggaacaaagaggcctctaaagatggctaggtct

SEQ ID NO: 553928 - DNA, 969 bp, Homo sapiens
  misc_feature (33)..(33): n is a, c, g, or t
  misc_feature (248)..(248): n is a, c, g, or t
  misc_feature (291)..(291): n is a, c, g, or t
  misc_feature (299)..(299): n is a, c, g, or t
  misc_feature (331)..(331): n is a, c, g, or t
  misc_feature (379)..(379): n is a, c, g, or t
  misc_feature (408)..(408): n is a, c, g, or t
  misc_feature (415)..(415): n is a, c, g, or t
  misc_feature (429)..(430): n is a, c, g, or t
  misc_feature (448)..(448): n is a, c, g, or t
  misc_feature (471)..(471): n is a, c, g, or t
  misc_feature (489)..(490): n is a, c, g, or t
  misc_feature (494)..(494): n is a, c, g, or t
  misc_feature (497)..(497): n is a, c, g, or t
  misc_feature (500)..(500): n is a, c, g, or t
  misc_feature (607)..(607): n is a, c, g, or t
ccagagacttcacagtttctgctctgcatggtnacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgtnactgaagaagacaagaggattctccgtcacactgacactctcnacaatacnacagtggaggagatgcccatgaatgtggctgnccttatttaatccctgggatgagagttttggatgcagtgctcgctgtngctgaataggcgatcacaacgcgcattgngcccctncctttgggaatatnngaatcttgtcccaaagcncataacggaccagaaatacagantccgatagcaaagcgacnnaagncgnganctcttgtgaggaaagtcattggctttatcctctttagagttagactgttggggtgggtataaaagatggggtctgtaaaatctttctttcttagaaatttatttccnagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaa

SEQ ID NO: 553929 - DNA, 341 bp, Homo sapiens
tttttttttccccaggggaacccccggttttttatttaggcccttccactggttgggtggccccccccccgattttcaaagaaacccccctttattaggcttttttggctatagggggtttcccccctcccgaaaactttccccgcccccttttgattcccggtttattgggaactgggggcggtagcccagcccaattttcccataaaacccggcctccccggggtcccgggggggaggggccaaaagggggggaattttcttttccttttggggttttaatggcccggaagaggggccggggaaaaaaaaggggggaacccttcctggttattttttta

SEQ ID NO: 553930 - DNA, 969 bp, Homo sapiens
  misc_feature (33)..(33): n is a, c, g, or t
  misc_feature (248)..(248): n is a, c, g, or t
  misc_feature (291)..(291): n is a, c, g, or t
  misc_feature (299)..(299): n is a, c, g, or t
  misc_feature (355)..(355): n is a, c, g, or t
  misc_feature (361)..(361): n is a, c, g, or t
  misc_feature (384)..(384): n is a, c, g, or t
  misc_feature (392)..(392): n is a, c, g, or t
  misc_feature (397)..(397): n is a, c, g, or t
  misc_feature (406)..(406): n is a, c, g, or t
  misc_feature (424)..(424): n is a, c, g, or t
  misc_feature (427)..(428): n is a, c, g, or t
  misc_feature (443)..(443): n is a, c, g, or t
  misc_feature (450)..(450): n is a, c, g, or t
  misc_feature (464)..(464): n is a, c, g, or t
  misc_feature (470)..(470): n is a, c, g, or t
  misc_feature (482)..(482): n is a, c, g, or t
  misc_feature (512)..(512): n is a, c, g, or t
  misc_feature (514)..(514): n is a, c, g, or t
  misc_feature (518)..(518): n is a, c, g, or t
  misc_feature (550)..(550): n is a, c, g, or t
  misc_feature (552)..(552): n is a, c, g, or t
  misc_feature (554)..(554): n is a, c, g, or t
  misc_feature (556)..(557): n is a, c, g, or t
  misc_feature (559)..(561): n is a, c, g, or t
  misc_feature (563)..(565): n is a, c, g, or t
  misc_feature (570)..(570): n is a, c, g, or t
  misc_feature (577)..(577): n is a, c, g, or t
  misc_feature (593)..(596): n is a, c, g, or t
  misc_feature (607)..(607): n is a, c, g, or t
ccagagacttcacagtttctgctctgcatggtnacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgtnactgaagaagacaagaggattctccgtcacactgacactctcnacaatacnacagtggaggagatgcccccccatgccgcccccccccccccacccctgggctcacnccttcngacgcagcgctcgctgtcgcccnataccccnccacnacccccacncccccccccccccccccnccnncccacccccctcccnacccccncccccccccccccncccccncccccacccccncccccccccccccccccccccccccccccnancccncccccccccccccccccacacccacaccgctngngngnncnnnannnatggnccccccnaacccccccccccccnnnnatttatttccnagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaa

SEQ ID NO: 553931 - DNA, 91 bp, Homo sapiens
aacaagaaaaggcccggacgccgtatcagtttgctgtggaacgtgctgcgccgcgcccgcaagcacaacaaactgcgttttctctttgcct

SEQ ID NO: 553932 - DNA, 681 bp, Homo sapiens
cgacgccaccacttgagcccccggctgtttctgaaggcccgacgggaaaagaccacgatcgtgcttgacgagatatgcttgttaaaatggtgcaatcatctaagcggctatcttctctcccaccgagtctacactagaggatcgaggcttgtgatgccttgacagaaataagggccttaatttgaactggctgccccattatgtataatatggtatatagcgactgacaaatattgtattactgtacatagagcgacagcagaccatttttgggctacctggttcgtttttataagattatgctgggtttggtattttgatattggtattaagaggatgggcatcgtttaacagagttataaacataatttgaaccttatttcagactcctcactcatttctttcttttctactcttcctttccctctctacctcctactctctacgcgtcttattccctctcttccaaaatactttttttgctcctgtaccttcttcttttgtctctatcaacttctttcttgtgcgctccttcttactaatgggggcaatctccttacgtgagcgtgtttaaaacattgtgttggggaaactcctgcctctttcactttggcactcatccttttctgttgggcgtattcctctttggccccgcgtcgttctctttctattctccgtcct

SEQ ID NO: 553933 - DNA, 137 bp, Homo sapiens
agagagaagtgccctacccccagtgagccccctgaaggcggctctctctaggaggagttagagaagaaatccaaggctatcattgaggaatatttccatgatcaattgtctggaatcagactgcgagcttgtgaaca

SEQ ID NO: 553934 - DNA, 229 bp, Homo sapiens
tgtgcaaactacttttattaaaaaggaaaggttctttattttgattataaacattaaaccagagctgtgtgaaggcccttaattggggagaggtggggcagggatcctggtagagaccaatgtttgccacccagaccccaagactgctgggagagagggtgtcagcacctactcccaggaatattccgcggtgaggtggcccatcccctgccccggtgaccaggtggat

SEQ ID NO: 553935 - DNA, 1362 bp, Homo sapiens
gcccaccgtttttggtggagattttttcttttggtggtcagtttggggtttgttctggggccgtgtagtgtggacattgatgtacgcatacgttgctggccgttctttctgacctgtcagggggcggctggctctttgattgctggtgtgtgtggtagcggccgcctctcgtcctccgcctcttataaattggttgataccccccgggttgatggggggggattttacggttagctcttgctggtattccattcctcctcgccggggcgactttagtgtgtgtgcgaccccgcttccctccgtccgtggtccccctctttagaggttcatcctcctgggtgtagtttttccgcctcccccacacggggggctggttcccgtcgaagtgttaatgttttgtttgtgctgtgaggctttctcgtcggcatcccaacactgttttctccgcgtggtgacgcgcccacataccttggtggtatttgagttctctggcccgcccagtggtgtgcgtttctttgaggccgcccctttttgggagattcttctcggttgttcctgtgtttgtctgcccccctggttatagtggtggggccccctgagcccctggggccccctgtgttgatatttttcgccgccccatctttctcaggtcttctctctttgggagccctttctggtgtacttgttaccacccggaccaacagttgtacctttaccgctgtggtgagaggtccacatttccccccacatttatagttcgctctatccccaatataggggagactttgtgtatcatctggcccccatctcacatatagaggaggcgctttctcatatccaacctgggattttctccccctgaatttgtctcaggcgttaccactccctgaggacgccacatacacgtgactcgcgccacaaatatctcctagtattctcacgttatctcgataatatctccatctcgtgcgcgtgataatatttgaacatttcttttctgcccaccaggacaacactcttctctctcggcgcctattctccggagaatgcgctcccgagcgcggttatctctctcggagcctatccgcccgaggtgcgagatacacaccgcacccactgtgtaccaatctcctattctattcttgtagtggcgctccattttcaatttggtcttctgacacgcccgtgaataatattaataaatattttcatgcatttgagaacacctttcgctttcgaagcgcaaaagattcctcaattagtagaaagagaacccccctctataacctcgggagtgactataatggaagccccccaccctaccacacatttgaaggacccgtatacattaaatttagacca

SEQ ID NO: 553936 - DNA, 143 bp, Homo sapiens
ttaattcaatcatcaacagactgctccactcgtcctccacagaagcagtaccagtgtatgtacccacctacaaaacaacaatgtatgaagatacccatatatactgttatgttaggtagcccaaacatgtcataatacaacat

SEQ ID NO: 553937 - DNA, 412 bp, Homo sapiens
  misc_feature (12)..(12): n is a, c, g, or t
cttcgacttccnagacactcgttttacatatgctataaaaaagtatgtatcagtaatgtatcaataatcccagcccagtcaaagccccgcccccactgttagctctgtctcatggtaattactggggctggcctctgtaagcctgtgtatgttatcaaaactgtttctctcctgtgagttccattatttctatttcttatgggcaaagcattgtgggtaattggtgctggctaacattgcatggtcggataaaaaagtccagctgtgagtttttccccaaagcagccccccagtggagcctttggctggaagtccatgggcccccctgtttttgtccatggaggactccgagggttccaagtatatttttaagacccactctgtttaaaaaaatatattttatgtatgggta

SEQ ID NO: 553938 - DNA, 391 bp, Homo sapiens
  misc_feature (354)..(354): n is a, c, g, or t
  misc_feature (384)..(385): n is a, c, g, or t
ttcttaaccacaggcactagatacgaatctaaaattaaaacaaaaccaatttattaaacacgcaattttttgagagtttgatcctagctcaggatgaacgctcgctgtgtgcctaatacatgcatgttgaacgggatgtagcaatacattcagtagcgaatgggtgagtaacacgtacctaacctacctttaagactgggataactattggaaacaatagctaataccggatatagttatttatcgcatgatgagtaatagaaaggagcttcacagcttcacttaaaaatgggggtgcggaacattagttagttggtagggtaatggcctaccaagacgatgatgtttagccgngccgagaggctgtacggcctacactagtgnngtaccg

SEQ ID NO: 553939 - DNA, 186 bp, Homo sapiens
gtgccagggcaaggcgggtcacgctgtagaatccctagcactttgggagttttaccacgagaccaggagttcaatgagcagcctgtgggacatagcaagaccttgtttctacaacaaatttaaaaattaggggcgggcatggtggctcacgcctgtaatcccagcactgcacgggcgaggctagga

SEQ ID NO: 553940 - DNA, 358 bp, Homo sapiens
gggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattaaa

SEQ ID NO: 553941 - DNA, 630 bp, Homo sapiens
ggattactgcgcggttaagctacagggggtttggttacaatgctggttgttcaaggaatatgaggttattgagcagtacccaatgacgattcttaggtctgttagtcgtagcaagacgatgcttgtcatcattatgcgtcataggtatagtacaagatatgggtagacagtgtcattagtcagtgggtagactagatgtctcacacgtataataccatagctgtcgagtttacagagtactgcgtctagctctcttgaccatgcgattctggctacgacatgggctctaggtagacataagttatgtccgtatggaggtatcttttctataaaagctattgtgatagctagtcatctttggttgatggcgcaggagcttgatagttgtgtggctttatgagtgaatagtagaatgtttagtatagcatagggtggtgcaagtgtagattagccagataagtaggggaagggagctatgtagcgtgtagaataataagtatgtgcctgcgatcatgtgttgtggctgttagcctcatcgggtgataatagtcaagttgggaatcagtgtggcttcgagtaagatatctcatctccttattctgtgagtgtgtatgttatcctgcatcaatg

SEQ ID NO: 553942 - DNA, 760 bp, Homo sapiens
  misc_feature (737)..(737): n is a, c, g, or t
ccggtgtagctctgggactgagccacggccgccgtggcgccccgtccgcgacctagctcaagagcagccagctggagcctggctaggcgagggacacgacacaggggatcgactggccccgtgggaacacggtgccggtgacaccaaagacccgttcctgaactagagtggcaacctcgagagggaaatgggacgactcgaggcgtcgggagcctgtgtatgggtctcgattcccagtacgctgtaggtagccgtggagttctcgatgcccctggccaaactgctttcgtgtccctactggaccagacgggtccaggctcgggaacaccttgcccgaaagacggcggatcgggtcgggaaaccttgcctgaaagacggcgcgcacagccagtctatgcatagctcagccgccatgctgacttccttacttgagcagcacggaagggagcaggaaccggcaagcgtgcaacttagccgaggagctacccgtctggagtcgcaggccatggggctgtgtcccacagcagtctacggcctctcttgctcctggacacacgaggaggactcccactaggatccgagcgtctgtgaactcacttgaactttggaaggttggcaccttgcggggccgcatcccctgggaaatgaccgtaagcggggtttcagtgggtcccgcgtgggtctaaggacccagtttcttctgtgagcaacgggcagtgggaggccggtggaaaagnttaccggcccggctacgacgtat

SEQ ID NO: 553943 - DNA, 355 bp, Homo sapiens
cgttattctctgcattaagctttgtaatggtgtaagtcagtgtctcctccagctctggcctgttggtgggtatatctctgggccagcccacgcaattcttggtaggtggttgtacaaactccttccctgtataaatgtcacagttctgtgagaaggaacgcaattggtagctgaatatcaatgtatgcattatctgtccattcaccggtatcaccattccaaagggacttccagtctgaagttaagacacagaaaattctctttggacacaattcgtttgcacaattacttcattaagcatgaagagggaggtatgttgagtggtggtgttagagttctgaatgccgtgtctcag

SEQ ID NO: 553944 - DNA, 1095 bp, Homo sapiens
ggcaactagattttgctacgcgcaagggtacaggatgaaaagattatagccaagcataatatagcaacggactaaccccgtatacctttctgcataatgaattaactatgaaataactttgcaaggagagccagaggctaagacccccgaaaccagacgatgctacctaagaacagctaaaatgagcacacccgtctatgtagcaaaatagtgcggaacgatttataggtagaggcgacaaacctaccgagcctggtgactagcatggttgtccaacgatagaatcttagttcaaacttctaaattatgcccaccagaacacctctagaatcccacttggtaacagtttacactgtatagtccaaagaggaacagactctaatggacactagcgacaaaaaccttgtagcagcagagtacaaaaacttataacaacaccattagctaggcctaagaagcagccaccaaattaagaacagcgttcaagctcaagacccactaccgtaaaagaatcccaaacatataactgaactcctcacaaccaattggaccaatcatatcagcctatagaagaactaatggtaagtataagtaacatgaaaacattctcctccggaataagcctgcgtccagattaaaacactgaactgacaataaacagcccaaatatctacaatcaaacaacaagtcataattagcctcactgtcaaagcccaacacagggcatgctcataaaggcaaacgttcagcaacaggacacgaaacaacctggagagaaacaaatgccgagaggcagacaaacacaaaactcgacatggccacacggacaaaaacacaaacccaggagacacagaccacgacaccacaacggacaaaacacaccagaacaccacaacagagaagcccagtaaaaaatataaaaaaaaacaagataaactgaataaaaaccaagctcaaacaaataacacaaaactaaacaacataaactatccatacaacaaataaaaatcaaacaacacataaaacaacaaaacaatacaacacaaaacacaacaaaacactaaacaaacaaaaaaaaacaaccaaaacaataac

SEQ ID NO: 553945 - DNA, 300 bp, Homo sapiens
gtggggttcacggtagtttggtacagcagccccttcaacactagtgggggttccctggggcgggtggttagcgtacagtagtcctctcaacattctgtgggttccctgtcggggcagacagttcggttacatctgcccctcaacatcagtgttccagtgcagatgatagcacagcatgcatcgcgcaggaggaaacagggaccctcgcgtgcacacgcactgctgttttaagggctcctggagaccgggtgacgttgaatcacctgcagtcacacagtcaggtaaacccccccgcactgc

SEQ ID NO: 553946 - DNA, 825 bp, Homo sapiens
ggcctactaaagcctcagtaatggcagatgcccctccccccaccaagctcaattgtcccaggttgacttcagactggtgtgctggcagtgagaatttcaagccagtggttcttagctttctgggctccgtgggagtgggacccacttagcaagacacacttgactccctggcttcagcctcctttccaggggagtgaacagttctgtctcactggggttccaggcgccactggggtatgaaaaaactgtagctagctcagtgcctgcccaaacagcctcctggtttgtgcttgaaacccagggccctggtggtgtaggctcacgaaggactctcctgatctccggcttgcaaataccgtgggaaaagcatagtatccaggctgggtagcacagtccctcacggcttcccttggctaggggagggaggtcccccagctccttgcacttccgtggtgaagcaatgccccacccttctgcttgctctccatgggttgcacccactgtctaaccagtcccaatggaatgaactgggtaccttagttggaaatgaagaaatcacctgcttctgcattggtctcgctgggagctgagactggagctgtttctattcgggcatcttggcccttctcgaaaagtgtgtaagaactccatagtcaaaagccagtttcattaaaaacagattcacgcagggatggtggtgatgtttgtaatccagccattggggaggccacagtgggaggtttggttgaggtcggctggtcaatgtatgagtcctgttttagaaagtaaggaatttttgggtgggggtgggcgtgccaatttaga

SEQ ID NO: 553947 - DNA, 195 bp, Homo sapiens
gtatatgagcagatgtctgtaagtcgattgtcataggtgaaacctgggtgaaattcaaagattttaggggaatataattctagtgacgatgggcatgaaactgtggttttgctccacagatttcagagcattgacctgtagtataccccctggtcgtgtagctggtgaaatgtggtttgggttctagacagtcct

SEQ ID NO: 553948 - DNA, 419 bp, Homo sapiens
aacaagaactccaaataccaataacaatttctctctactttaagacatgctaccttacaaggaaaatctgtactggagcaaggctaagtggactagtccctaaaacatgcaatcaacatttgcttgaaattccagctggcatcctgtatctagcaaactatcttactttccacatacttatttataccttgtagagacagcttaacactcaatggctagtgccatgtgtattgacaattgattgtgtactgcccaatggcacacctgactttagagcattgagattatatatgtacatgtgtgtctctgctgtacatgattaggatcatgtgacactgatcagttccacagggtcattaggcaggagtcccaaacttgctctttatttcataggatgacatcaatcatagtttgaggag

SEQ ID NO: 553949 - DNA, 158 bp, Homo sapiens
tccttcattgaatatacctactcaactcggccactggccataaaaaactaagtattcaattaagtgggaataccctggagagatggtcagctatgaagtactagagttcgcttaatcataagtaattcaaacatgctattgaaacttctaaaactagg

SEQ ID NO: 553950 - DNA, 1102 bp, Homo sapiens
cgctgtcggttcgcctcccttccctcttttcctctgcttcggctcgttgtggtctgtctgtctgcctgtcctgtgcgtgtgtctctggtgcgtcgctgccgtggcgcttgttgtttctttgccctcgtgtcccctgctacgcagttttgttctcgtgtgttctccccttatgtccgtcgattctgtgctagggcctggctttttccctgttgttctctgtccctcttgtttgggctgtcgtcttactttaggcctctgcgcttgcgtctgtcggtccgttcgttgctcttctgttgcgtggttgtccgcattgcgttctgcttatcctctcgttctgtcattcaccttactcctctgtgttgtcactgttccttgtcctctgttcttttgtccctggggatgtgcgggccttgtactgtccctgtttggtttctttcgttttttcatcttgtgttagtattacccacttcggcttgttatgtcctcgtgtatagttgttgatcattggcatcctttctggcctttttccttggtccctgtcctggttgtgtgttctatgtgggttacgttttggactttttgctgatagtaatttgctcgctagtctgggttctggtaggtcttttcttttgtcatactatatttgctttttttttttgtaatgaaggctcatttacttgaaatgtttcactttctactgatatacaatatagtatacagtgatgtgttttatatcatattgctgggttgtccatctgttgtggtttagtgttatgttactcacttcatgtttttcacctataaaattgtcatagctatgcaatatataactcttgtttttttaattgggtagagatagagacctgcctagattatctagacctcttcatgttaaaagaccatctcctgtaaaactgacctagtggacaagctgaatttgaaatagactgtgaagtaagctgtaacttgtcattttaattttgtttacacggttactgacttagatgatgtattaaataccaagataaagaaaaatgctacctaaatctaaattagaattcatcatggataacaagtcaaggtatactcggggtcgtaatca

SEQ ID NO: 553951 - DNA, 326 bp, Homo sapiens
tatagggggagctaataaggtggaatcattatgtatcgagggagtcgtggaataataggtggacatcagacttaactgggtagtgagtagatgatgaggtaatttgtaaaagggtaaccagcgatctcagcgtcaccataacttccggcgtctcgggctcaagagattctcccacctcaacctcccgagtagccgggactacaggcgttcaccaccacaccaggctaatttttgcatttttagtagaaacggggtttcgccatgttagccaggctggtctccaactcctaacctcaagtgatccgcccgcctcggcctcccaaagt

SEQ ID NO: 553952 - DNA, 478 bp, Homo sapiens
gcactatgagcatatactgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctggataccaatttcctatattagtccattctcacactggctataaagaactatctgagactggg

SEQ ID NO: 553953 - DNA, 1686 bp, Homo sapiens
aattcaggcagtactcagcaaggtacaactattcttcagtatgcacagacctctgatgcatatgaagaatagttgtacctggcagagaagacacggcgaactggcgcgaggcacgacaactctccggtgggactttaacaccactcacaggccaaccttacgacaggaatggaccccccaaactggacaacgcagacaatacaggggtcaaatggcacaaacaccagcagacagcttgcctcgcacgaaattgctcgcacggcaaacgcacgcaccgcgccctatcgtcgacaaatggcctgggaaaacccggagttggccagctcctgggcaacaacatccacaaataacagacttcgtacgtagcaaacgcacgtttcacacaacaacctctgggacacgcgactcctcttattcccaaattaaacacacgctggcttcgcatttcctcgcacggacacacgccacatcatacttctactcgggctgggcgaaaccaatgtggccaattaaaaacatcacgttcatacacgatggggcaatttctcaccttatcaagctggggacgagcttttataaataatcaccgttcaacagaacgggcgctcacaacacaggccaaaacgcccactactcacacagttcacaaggcgcagcttatcgcaccaaaaaaacatcaccgagcgccccacaacacgactacgccttatgagcccagcacagcacagtacaatatctcaccaatcggccagcctcaagccggctgggcacaaaccaggcgcgggagcacctcaaagcgcaccgcccaacaccgagacgagcagaccaacgaactgcgggctcacaccctagcgggacgccacacccgacggggcgagaaacgatccagaccactaacatgaccccacaggagcacgcagaaaaaagggatccgatcgcacgcaaccgcacgatagaaccaaaggtgtcgagcaacaccagccagaacatagacgatgcgcgacacaactaaaaggacgggaaagaacacacaagaacacactaacagagagcacgatagtcagtatacactaacacgtcacagccaacacaacatcgagcgattgatagacgagcgcaagtcacatccataaacggacacacgtaactactcgtatcgccaggtcggtgcaatctcgtcagccacaccaccattcctgaatcagacagaagaaaatacagacaatagaccacacatcaaccactagcgtggcattgttgagcactcaacaccaacaaacaagcggtggacagacgagacatacaggcacacgaggccagcaaccgagctccgcgactacaacgtacgctcctcagcttacgcatgacatgccatgctcatcacgctgatcacgcacaacacaagatcagcacaacagagaacatcgacgcactaccgatggtgcagagacagaacgcaaccatacacgcagacagacgacgagcgaacaggcgaagatcgcacacatcgcatcacgtaaaaacagcaagctcgacaaaccagatgcagacagcaagcagagtcaacaacgtacaaccgaacatagaaactcccactacgacaacgcaacgacaaagcaggcgacagaccgcacgcagcaggcaagagacaacgagcaggactagacacaaaccaagacgatgttg

SEQ ID NO: 553954 - DNA, 151 bp, Homo sapiens
  misc_feature (36)..(36): n is a, c, g, or t
  misc_feature (71)..(71): n is a, c, g, or t
  misc_feature (112)..(112): n is a, c, g, or t
  misc_feature (120)..(120): n is a, c, g, or t
cccctcttaggacaggcactgcccagcagcaagggncaagaagggacttgcctaaagccacccagcaactnagcagcagaaccaagatgggccccaggctcctccatatgtnccagtggnttaccaccctatcacacgtggccttgtctag

SEQ ID NO: 553955 - DNA, 147 bp, Homo sapiens
gtgcgatcgaatcgagccggtacccagagcaacagaaaaccacggctggcaccttcaatggtcttacaggcggcttcagatagcaggttgccataagaatatacattccaccacatgagggggatgtttttcaagcataaaaatgct

SEQ ID NO: 553956 - DNA, 225 bp, Homo sapiens
gctggagtgtagtggcacaatcccggctcgctgcaacctccgcctcacatgctcaagtgcccgcacctcagcctctcaagtagctgggactgcagcacatgccaccacaccagcctggccaacatggtgaaaccctgtctctgctaagaatagaaaaatttgctgggcgtggtggcgggtgcctgtggttccagctacttgggaggatgaggtaggagaattgcc

SEQ ID NO: 553957 - DNA, 341 bp, Homo sapiens
ttctatgtctaggctcttatcaatagccgtcatatctctcatttcactacattcattgcacttcagctatgtagttctctggtctgtcattccctactattgctataaacgtgttcttaattatgcttggcatcttggattgtcacacataatcttattttctaattgttttatactaaacctgtaactgctgaaaactcctatctcatgcttcctctcttccatgggccatacaccacatccttctccttcctttatcatctgtccctatcagatcttcagtcacattagtcaactacgctttaaatgtacgcaattctccctgacaggagaacgcggcc

SEQ ID NO: 553958 - DNA, 345 bp, Homo sapiens
tcagaatccacctctcggagtatccacatttgcatactgagtactgcacattaaatctgcatccacatcgtgttacatccgaacaactaacactatgctgtggggaggagaagggcagacaaaggaaggcttcacatccaaaatgtcaagccctgctgaaagaatgatagaaggcactctgtggaagagcagaaaccaacttctgggcttaaaatggagttctaccaccgcctgctggaccaaacgagcaatacagaagaggctaaaaatgcttagaactgaatatcttggggatattttaacttgtcttgtcatttattatattatattaaaaaaccaatttca

SEQ ID NO: 553959 - DNA, 110 bp, Homo sapiens
agacgtgttgcatggctcaaattatagacctgccctgtgtactggaaagcttgaaaaccattgataaaaaaactttttacacagacagctgatatctgtcagatgcttgt

SEQ ID NO: 553960 - DNA, 706 bp, Homo sapiens
  misc_feature (472)..(472): n is a, c, g, or t
  misc_feature (530)..(530): n is a, c, g, or t
  misc_feature (556)..(556): n is a, c, g, or t
  misc_feature (603)..(603): n is a, c, g, or t
  misc_feature (612)..(612): n is a, c, g, or t
ctaaattctaacctcaagaatcttactctagagctgttggtttcctcagatcagctcatctcagtgcacaatcttatggactaggatgtaaaaacacaacatgcaactctgtcactcctgccttctactgctgtcatactctgctgcttagcgcttgtcaccctctgaaatatgcacctgtttactttgttgtctgtcttgcctcctagaatgcaagcacttatgagaccatggactttgcctgcctccttcatcactatatccccagtgtctagaacagagcatggcacagttagagcgtgaaaggaagaggcgacgtggagtcagaccccacattgactccttctccctcacttaccagcagcctagctggacaggtacctaaacatctccaagcctcaatctcctcataattaaaatccaaagaatgggccaggcacagtggctcaggcctgtaatcccagcactttgngaggccgaggcgggcaggtcacctgaggtcaggagctcgagaccaacctagccaacanagcaaaatgcctgctctactatacanaaattagctgggcatggtggcatgtgcccttagtcccagctacttgngaagcttangcagtagaaatgcttgacccaggaagcaaaggttgcaatgagctgagattgtgccacactgacattagcttggccggagcagactcaccacacc

SEQ ID NO: 553961 - DNA, 1514 bp, Homo sapiens
  misc_feature (198)..(198): n is a, c, g, or t
tcccttcaggggctattaattccccggtcaaaaaaaaaccaggaacaggctccctctgctctgagcctggcaaacacaacacaaaaaccgggaatggggcgggggaggcacaggaaacggcttcctcagcaagtgtgtgtgtgcacttgtggctccctgttggttgtggtccccgatggcagtggagtctacagtggnacagtgcgcgtgacgcgggggtgtggtgtggcacgtgaaagccgtggggaaacaggcgccaggccagtgtggcccagggaacggaacgaacaggaggcaaataaaatacggagtggccaggcggggcctccgtggcgtgggcccagggtgggggtggggagaggcgtgcaccactcgaagggcctcagggggggagtggtgggcctcgtgggcacacgtgcccggtgatgaaacagaaaagaggcagaaggcaaggaacaaacacaccacagccctcccgtggaagtggaacacgtggaggtgtacacatgcggagctagtggagcaacattggcgtatataccccacaagccgcgcggaaaacacttctatcacaccgagcccagtggctcacaggggaaaacgagggagacagggctgtgagccacgcgccaccggagtgtggatgcatggggagaagccacacaaagacaagcaacaaccccacagaggtgatccctgtgaggcccacagggggatcacgacccaccgaggaaaaagcgacacgagtgagaggccccactagtgctccatggcaaagaacaacgaggcgggagtaagaaagcgctacagtggaaagcgccccccagagcgtaacacattacaacaccagcgtacagcggcgacattcctagggtgtcaacagaacggggacacccagaacaggcgaccaagaggaggggttcgacactagagagcacgcaacaaggcggggcttagaaaagagaaagcggccccggagccaccacaaagaaggcacagtagaaattcacccacacaaccccacaggatcacaacctcaggaacgacaggcaaaaagacgcaaacagtaccccagaggggcaacacccaagagtgcacctggaacaaaatcggaaagaaccacgtgacacctctcctggaaagaccagagccaccgggagtacacacgggagaaacaacaaccacgggtgtggggcaccaaaaaagtggggacgaaaaagccgagggggcggaggctattcaccaacaaacaacgacgatgaaaacaacacaaacaccgagaaccaggagtacaaggaccaaaagagtaagaagaagaaggagagaggagaaagagccacacggcgagcagaatgacgacaagtagatagagcagaggagagataaaacaatagagagagaaagaaaggaaacacaagaaaggagagaaacaaaacacaagacagatgcacaacgatgcaacacagaagcgacaacagcaacagcagcgacacagaacagaaccaagagcacaa

SEQ ID NO: 553962 - DNA, 398 bp, Homo sapiens
tgctgggattataggtgtgagccaccatgcctggcggacccatttatttttagacatggaaaaacaaaggcccagggaggtgctgtgtagcttcatgtgacttacccttagtcagcagctggttcatggtacagccaatattaagtctaagttgtcagtctttcaatcagtccaggcttctttgcaatgaattttaccaccttactttcattataaagatgagagtctcaagctaatgattgcgttcatgtgaaagtctcatactcagacagaaccaagtatatggatttttttttccaagtttcacagctaatttgacaaattcctaggggcagcagttaagcagttctcatctattttggggtgcctaagatccagggcttgtggatcactttttt

SEQ ID NO: 553963 - DNA, 874 bp, Homo sapiens
tgcgaagctgtgccatcgagaggcacctgcgtccactatgcgctccgccacattgctgctgactgcctgtacacctgccacactgcatctgactgccctgctgagtgttgctggttgtgactgggcccgcaccctgtgtgtggtgctgcttacttcacgcacctgcacagtcctgaccagtggcccctgagtggaccctcgcaaccgctgtcggtcttcctgtgtggcctgctggttctaccgcggtgacgacggacggttggcgggtagacctgccttgggcccttcgcctgccgcgactacccgcttgactgcggtagacccacgacaccgcacacaatcgacaccgggatgctacgcgaactggtggctgagcaaaatgacccaatgtaaagccactccatcttgtccgggtgcgcacaatttccctgtagctgtcaccatttggaaacctggaaacccccagcacttgcacagtgggcaaggtggcaagtgctccgtgcccgttgtgcgcacggtcccggtcagtggcaaccccttctatcggcaacccacggtgcctatttcacaaccttttggactgacagcgacccccaaccactattagaccccaagatacttattccagatgaccccagtgcagcttattaccacagcccccaatttggtacttggagtgcggcggacatcaatagggtcgacgtcacaccgccgaacagttgcaccccattgggactaccacctggcgcgacactctggccacacgacacacacgcttgcctcggactatgttgagtgtgccccatttctaataacgcctttagtagcagtcccctccaacatgtccccattatagtgagacagtggttcagag

SEQ ID NO: 553964 - DNA, 472 bp, Homo sapiens
cgcggtggctcacgcctgtaatcccagctctcagggaggctaagaggcgggaggatagcttgagcccaggagttcgagacctgcctgggcaatatagcgagaccccgttctcctgaaaaaaaaaaaaaaaaaaaaaaaaaaaaacatttgtgtgcggcgcgcggcttgggccttggaaaaagttttttaaacaccaatgggttggggggcgggggcccaagtaggcgtaagggagacctggggcacaaagcgcgggttccctaaggagagaacccggggaaaagagaaaaggggcggggagattctcttcaccattataaaaacgcgcccgggggggaacccggagggtgttttggaaaaaattcacaagaggggaggttcgaggagggaacattaaggggagatttattaaaaggggaggccaaaggggaggtaggaatttaaaattaagccccgggttgggggggggagc

SEQ ID NO: 553965 - DNA, 1455 bp, Homo sapiens
gcttcttttgcgtcgccagccgagccacatcgctcagacaccatggagaaggtgaaggtcggagtcaacggattggtcgtattgggcgcctggtcaccagcggctgacattttaactctggtaaagtggatattgttgccatcaatgaccccttcattgacctcaactacatggttatacatgttaccaatatgattccacccataggacaaataccatggaaccgtacaaaggctagagaacgggaagcttgttcatcaatggaaatcccataacaacatcttccaggagcgagatccctccaaaatcaagtggggcgacagatggccgctgagtacagtcgtggagtccactgaagtcttcaaacacccatggaagaaggcatggggctcactatgcaggggggagccaacaaagggtaccatcatcctctgcaccactactgctgatgaccccatgtacgtccatggagtgatgaacccatcgagcaagaaatgacacacagggctcacaagatacaatacaagcacaaggcctacctgcaacaaacaaaagtggcatataagcacccctaggaccacagagaacatagcatgaacaacaaggaggtatacggagagaaaggactcatagagccacagggccaaggccatacactagacagccaagaaagaaatgaagggcatagggcccaacacggagacaactgtaggaagatgaatgagacagagagaggaaacatcacagaaaacactacagccacctggagaagcatacaaggagaagactagcgcaagagacaaaacggggagcaaagagacgagacccattgaaggcatgtgaaacgagcacacagaccaacatggacaaatggaccataaccagaggatcacaacacgatgacacaaagagtgaatacggagtggagtggaaagcccgaaaccccaggcgcgaacacaagaaacaacacaccggagcaaaaacatggaatgcaccacacaacaagaggaggagcaacacagagcaatagaaagagacccacaccaaagagaacatacacagagaaaaaacaagagacacacaggaggacaccccacgataagcatcaaaaaaagaaacaaacaagaaggaacagacatacgaaggctggagagggagaccatgagacagtacacggaaaaacagataggacagacacacaaacagacacgcaaggaacacacaatgtgagggacaagaacaagagagagaagaccaaaagcaccaagcagcatcaacaggcaataagcaccagggaacaccacgcaaaaaaaaacacaaaaggcaaacaacaaaccacacgcagaggagacagagcacagagaaaccagagaacacaaaacaccaccagaaagaacgtgaacaacagaaaagaaggagccagacaacgaaaacacaaaaaaagtagaacaacaa

SEQ ID NO: 553966 - DNA, 778 bp, Homo sapiens
ggcttcccgggtggtaagatggtggcgcgcatgaggaagtgcgccgcgcgggacccggtaggacacgttgatcccatgcccattgggcctagccgcagactgttccaatcaatgttctctgtaaaagctaacaggcttctctacgtacctctatggtgttagagcagctacgaggttcgacaaggcaccaattccagctgggctcagcaagaggactctttttgtcctcgaatgtgcccccataactgcacagaggagacgcctgtcccgtctcctgtccgacctgtggcctcggtccagtcatgtaggagtttgcagagagatagtcggtgatccttggttgagcatgccctacagagcgagtacagatggttcgcagaagatttcttcgatccgcataagccagtattccaggcgatttccagggatagaccatagttgtggttgttccctaggatagtcgcgaagggtggggggtgctcgaagccaggctccgttgggcccctgcaatggtgccgcccccgttggctggtgtccaacagtaggagccaccctccgtgttgcaatgtagtggcattcactaagtggatcagtgactacgcaagaactctgttgtcgccgaccctgaggacctgagggtggaagtggacacgttcatggaggcatttgaccagaagatcgctgaggaagaagctaaggccaaggaggaggaggggggtcccttgacgagggagggctgggtgaaggtgacccgccggggcgggcggcctgtgttccc

SEQ ID NO: 553967 - DNA, 132 bp, Homo sapiens
ccgatggagcgatgaaccagtgcgagcccatggtagcgatgcaataatgagactggtcgcagaacaaatgctgaatctaaagaagaggacaactttgagacaaattatactagcttcttatataatttgagg

SEQ ID NO: 553968 - DNA, 467 bp, Homo sapiens
ggctgtacgaattctgcacgcggagagagagagagagagttagagagagagagagagagagagagagagagagagatatagagagagtgagagatagacccatatagatagtgttagatgttgatcgatagaccactttcttttctttttagacggtcgttttcttctgtcgtgagccttgtttgttccttttcccttttttctgtgtttctccctatttttctttcttttaattattttcttttacctttttccttacttctctttatttccttgtcccctttttttccttattttttttctttcccagcccctttctttgtttttctttttttttttcacttttttctgttttcttatgtccttttttttgccctccacttctctggccccttctttttttcttttttttccctcctttttttttttctcccctcttttttggcctttttttccttcctctcttt

SEQ ID NO: 553969 - DNA, 129 bp, Homo sapiens
agattccagcgcagatatgcaactgtgagcgagaagttgagccaataatgatctgaattgcgagaaacccttgtggctacaaaaaatgttgagccgtagatgccgtcggaaatggtcttatctgcgcat

SEQ ID NO: 553970 - DNA, 841 bp, Homo sapiens
  misc_feature (251)..(251): n is a, c, g, or t
ggggcggaggctgggccgtgaggggtggggaccggcgaggaggtggaggcggcgctccgctccgtccagctcggtttcatgtcccgccaggcgaaggatgacttcctgcggcactacacagtgtcggaccccaggactcaccccaagggctacaccgagtacaaagtaaccgcgcagttcatctcaaatgaaatggacccaagaggatgtcaaaggagggtggtggtctggaaggctggtacagcggagcnttccggcaaggcttgcaattggaagaccttggcctacaacccaccggaaagcctcattccggccggcctcggagggaggttcccttgctttcccccgtgggccccagggtgttttggccggtttgaaaggccctcaggttgaatcggagggaagccgggcgaaagggggggcagaaggtgacctgctttcgctttcactgtgccacatacctgctgctcaacaaccagcccccagctcaaggagttcttccggggtggggagggtgaccctgacccttggaggtgtccagggacctacacatctttgccaaccgcgtcattagatcccgaaccggaaagattaaatagaggtacggggaaatcgccagaggggggcggcagtagggaagtaggaatgtggctagagggaattgtgtgagttgggagggggaccgcgcgaacaaataaaagacgagcatgatgaaggccgtggaatatcattcgtttaagtggtgagagagaaggagagggagtggggttccacgttaagaggggcataacggaggatgagttaacagttgtagacagaatattcaatgaataagtgaggc

SEQ ID NO: 553971 - DNA, 439 bp, Homo sapiens
acgctatgacattgtgggatcacagctttatcagacactacctctaatccttataagatatataactatctggtatattgcttcatatcctcttatctttggcttttatacgaaggactttgactttcctttttatctcggaccactaggcgggtgccaccacaccaagctaatcttttaagttcttgttgatgcccagtatccttctgttgtgctggctggaacacccctcctgggctaaaagtgattctcccacctgggcctctcaaagaactaggattacagacgtaagccactgcactcagcactttttattacaaaaaagagtgtcttgcactgtcacccaggctagagcacagtggcaggattttggctcacgccagcatagtaattcctaacctcaagcaatcctcccatctcagctttccaaaatgctgac

SEQ ID NO: 553972 - DNA, 730 bp, Homo sapiens
ctagtactacagtcgcgagtgttggtcgctgttgtgttgactactgtgcattatatagaacagctggtcccagattcgctgccggagtgctggactggaggcgtttcgtcttgcgcgtctgtgacatttccaagtttcacgataatgccgtcgacatctctgtcccccacgggacccccgtgagagcgccccgagtgatcccgtagaggaagacagcttgaacctaggaatcatcactccgccatggattgttgacgagaaggcgtggctttggaggcggccgttggacactgcgttgggcccttgatatgatgaggactacaccagacttgtgctgtcgatgaatgttaccctgtcacttggtgtggggctatcctgaaaagtcttcatgtgacccataatttgttggcctgaggaatcaagggggagccagaacaattttgagcgtaattcttcaacaccgtccgatgcattgtcgtaccagataaagcctcaatgtccacatttggccttgtgggtgcccaccaaagggagagttcccttcacatgcattcccttcaactgggtctttgcacacataacattggtcccaaggacaaatgaatcatccactcctcatataagatgggtggtcccatgatggttcggggtaggtcacatatataagcacccaaggatggcgcattccacattgggcaagaagaattttgtttggcgctgtgaacttcct

SEQ ID NO: 553973 - DNA, 619 bp, Homo sapiens
  misc_feature (8)..(8): n is a, c, g, or t
  misc_feature (73)..(75): n is a, c, g, or t
  misc_feature (82)..(82): n is a, c, g, or t
  misc_feature (97)..(97): n is a, c, g, or t
  misc_feature (103)..(103): n is a, c, g, or t
  misc_feature (105)..(106): n is a, c, g, or t
  misc_feature (113)..(113): n is a, c, g, or t
  misc_feature (166)..(166): n is a, c, g, or t
  misc_feature (168)..(168): n is a, c, g, or t
  misc_feature (178)..(178): n is a, c, g, or t
  misc_feature (188)..(188): n is a, c, g, or t
  misc_feature (198)..(198): n is a, c, g, or t
  misc_feature (208)..(208): n is a, c, g, or t
  misc_feature (218)..(218): n is a, c, g, or t
  misc_feature (221)..(221): n is a, c, g, or t
  misc_feature (229)..(229): n is a, c, g, or t
  misc_feature (231)..(231): n is a, c, g, or t
  misc_feature (239)..(239): n is a, c, g, or t
  misc_feature (241)..(241): n is a, c, g, or t
  misc_feature (257)..(257): n is a, c, g, or t
  misc_feature (267)..(268): n is a, c, g, or t
  misc_feature (282)..(282): n is a, c, g, or t
  misc_feature (292)..(292): n is a, c, g, or t
  misc_feature (582)..(582): n is a, c, g, or t
ggtatttntcttcagcctctccctcagagtccctgggagtgtttctgttattgtggagggaataggggatctnnngacacgntgggacgtaccatgncgacangnngtctcanaacacacacacacacacacacacgtgcacacacacatccccccacaactacanangccaaaatanccagcatggngttgtaacanccccccagtnggggctaganttncccatggngncctgtgancngctccctgggagaggngggggcaggnnggtcacggtggggncgcagcagancattatttctccatcttgctgttttctagccttgagttggggacatgagtgagaactgggggttttgaggagtaacccttgtgaacacatgtactccagcagccaggcatcccagatctcctgtcctggagggtgctggggcccctggctccccagagtgtgcaggcagacccccagagccctagctcatccatttatccattcctcataatccagtgtccaaagagcacccccagcagggtagggaaggtccctcccggggtttacatgactgattccttctcagaggngaccgtggcatcccctgggggcccccgatagtgtttg

SEQ ID NO: 553974 - DNA, 290 bp, Homo sapiens
tagatgctccccgaacgggtgatgcggttggggtggccaggaacataaactatgtataggggccgggggcttctgcccagggctccccgcggccattacgccagggctgtcaggcagcctaactgggacggcagccagccattctcagagatgaatgcgtcaataacctccttcatagccaagttggggatgagctgttcctgggtcagggggctccgggtcacggggtcaaaatgacccacacgctgcaggtgctcctcgatgtccttgcggtcgtaggtgatgccact

SEQ ID NO: 553975 - DNA, 379 bp, Homo sapiens
ttgtctaggtgcacacaaaacaatacatacagaaagactacactgcagccatgtttagagtggcccgagacaggatcaaatgtcagctaccaggggcaggtttaacgctggcatatccttacagcaatgagctctttgcagcccttcacaaggaggaagcaaagtttatgtactgataagttctgatcttccttttttggagacagtctcactctgttgcccaggcgggagtgcaggggcgtgatctctactcactataacctccacctccggggttcaagcgattcgtccggtgtcagccttccgagtaggtgggactacaggcacatgccaccagggcctggctaatttttgtatttttagtagacaaagggaaaca

SEQ ID NO: 553976 - DNA, 308 bp, Homo sapiens
cttatctgttaaaacgtaagatgaattggtatttgcatcataggcagtttgactgcatatattagagaatgaaaagagaatatatgtagtaatacctggaaactaggagctttaaattaaggtaataatctgctaatgtagaatggaattcacacagtggatagctatgggtgaatcagaatattatgtttagaatcccattagataagtatataaatattgtggggaattatgaaattaatatgtactacctgcaattgtgctgtgtgaaaaataaaaacaaggatacgtttaaataattcaactta

SEQ ID NO: 553977 - DNA, 451 bp, Homo sapiens
cacagggaatatatagatttataagtagacacgtggcctatactgagactacactcgtaggtcacacactaaagacagacataacatgattcgcaataggagtaaacttgcatatagacattcctgtcctcaaatgatttaaacaccaaatttttctccgaacctcatagaaacctccagagaacaacttgtattagttactgtttatatctcatcattttagaggctccaaccactagaaaagtctcagggtattgtaaaaactatgacaccttcaagtggtctctggaagcttgtttagcaaattgattgtctcactttgatcaggctactgtcagttttaaaatacaggaaatcacccaatgggtcacaggctgagctgatgtctgcctgacctatggcttcagtctcctaactgacaaaatctatacagagccagatctcataaaag

SEQ ID NO: 553978 - DNA, 333 bp, Homo sapiens
  misc_feature (122)..(122): n is a, c, g, or t
  misc_feature (156)..(156): n is a, c, g, or t
ggcttctggatttgggggtgcttccttttctgttaaccatgtgctttggtgtctgaatcccggtgggtgagggtccctgccctacctagtagctgtctcaaggagtgtacatgcccctgggnctgagggctgctttgtgtgcacgcgcgtgaaacnacactcacacacatgcacacacgcgcacgcacacacgcgcacacgctcatacacactcacgcacacatgcgcacacacgcacacgcgcacacacactttcatacacacgctcacacgttcacacacacgctcacacacacatgcacacatggtcacgggcactcatgttcttcaggt

SEQ ID NO: 553979 - DNA, 99 bp, Homo sapiens
tctgtgttatggaaatcaaagaaacaaatcgctcctctaggtatggctggagactggactgctccattgtctacaggtgtgtatgtggttggggtgaga

SEQ ID NO: 553980 - DNA, 468 bp, Homo sapiens
catgcgagtttgggacgggcggtcgaattacaaggtcgtgtgtgggagagaggcagagtctcactctgtgcccaggcgggagtacaggggccatgatctatgactcagtgcagccttggacttcggagttcaagctattcctccacctaggtctcgcgagtagctggtgctatgggtgtgtgccaccacgcctggataatttttgtctttgggggccgagccggggtttcagcatgtgggccaagctggtctccggctcctgcactcaggtgatctggcatcctcagcctcccaaggtgctaggattacaggtatgagctacttgccctggccttcttctacttttattgtgaaaatatacaagacaacaggccaagaacagtctggttagcgaccatattttcctcacttaatttaacatggactcttgttgccatattggctccttctaatcccatgcacatttca

SEQ ID NO: 553981 - DNA, 542 bp, Homo sapiens
aaatcaaaaatcccagtgagatggatacttttattatccctactttacacaggaggaaacggagacaaagagaggctaaagaacctgccctaaagctacagagctatgaagtgatgaagtctagacttgaattctgaaactttcccttagtagttcactgccgtggttttcaagctacattctgcagactatttcagctccaaaagttctacttctaaaatacattttatccggtataaaaactgcaatgaaaaacatcacaatcaaaactttaatagactgaatataatacaccaaagggaaccaacacattaactttttgttgccaggttaagtggcttttgtgcagctcttgaaataagctagacctgtcaccactgagatcttacttgaacttcttgtaaatgtttcattgatttggaaggtgtaactctgcactttttttttttttttttttaaactcaggactacttctgcctgctcaggtgagacggtccagcatacgagctcaagcacaagggtaaaccaagcaaccccttggt

SEQ ID NO: 553982 - DNA, 443 bp, Homo sapiens
caacagtgctatagtattcagtccaataacatgctacgcatgttatagacgagaaacaatatgctatactatatagcataggcgtgtagcaggctataccatctaggtgtgtgttgggtacacgctatgatgttcacacaatgatgaaatcacctaactacgtaattctcagaacatatccatatcattaagtaatgtatgactgcataacctgaccatccaaatcacatttcctaaacttttgccaaaagttccttttaaatctgtgtcaaattcactggcgaaaggaagcagaggaggtggctaagctgagagtcagtctaattgatatgttggggctaattatctacaaaaataacgcaaagggggtcatataacttaacacttaacgggagtggggagaatggtgaaatgagtgacacagacaaacatctgtaccatat

SEQ ID NO: 553983 - DNA, 378 bp, Homo sapiens
gtaccatctgggtagactgtacgtctcagctcacaagcatagtctcctgcacctctcagagcactctggggaagggctggtgctggcagatattcacgaacgtacgtgcgtgactcagggcctgacagcgggtgcacactcccggctgcctacagtcctcaggactctactccctcagatttgtggtgaccgtgccctccagcagcttgggcaaccagatctacatctgcaacgtgaatcacaagcccagcaaacatcaaggtggacaagagagttgagcccaaatcttgtgacaaaactcacaaatgcccaccgtgccaagcacctgaactcctggggggaccgtcagtcttcctctttcccccaaaagccaaggaa

SEQ ID NO: 553984 - DNA, 485 bp, Homo sapiens
ggcctccccagccctgcagaactgtgggtcaattacacctctttcctttataaattacccgtcttaagtatgtccttacagcaacatgagaacagactaatacagaccctttccccaatcccaggcccagacagttttctactccattcctctcaatgtcatccgcttctctccttttttactgtcactacttctattctggctcactcatctgtcgtcttgatcactgcagatgcggatttccaagatgtgaatctgatcctgttacttccttgcttgaatcttcaatggctccctactgccctcgggataaggtatttgctcttagcttggcttgtaaggagaggcttggcctggctcctgcttcctgcctctctctgtcccctccaggctctctctgcctctctcaccccatggtctagccacacatgtggtctagcaagggtgagcctgactttgggctggagccacaaacaggcagaaga

SEQ ID NO: 553985 - DNA, 551 bp, Homo sapiens
gaaaaaattgatcccgttttggttaaaaggggaagaaggccctaaatttttaaagtttgggaagccgccctggttaaaatgggtcctggccagcccaattgggttgagagcttttcaaactatcccccttgggttgcttttctggtttgtatttagacaaacagttcgggtgggggtcatcaaaccagtggacaaaaaggttgctggagctggcaaggtccccaagtttgcccagaaagctcagaagggtaaatgaatattattcctaatacctgcccccccccttttaatcagtggtggaagaacggtctcagaactgtttgtttcaattggccctttaagtttaggagtaaaagactggtttatgataacaatgccttgttaaaccttcagaaggaaaggagaatgttttgtgggcccctttggttttttttttttggggggggcagttttaagttattagttttttaaaacaggactttttaatgggaacaacttggcccaaaatttgtcccagaatttttgggcccctttaaaaagtttaatgggga

SEQ ID NO: 553986 - DNA, 1978 bp, Homo sapiens
cttttcctaaccctgctgctaagctagacacctcacttactgagagccagcatggcagctgttgtcctggagaacggagtcctgagcagaaaactctcagactttgggcaggaaacaagttacatcgaagacaactccaatcaaaatggtgctgtatctctgatattctcactcaaagaggaagttggtgccctggccaaggtcctgcgcttatttgaggagaatgagatcaacctgacacacattgaatccagaccttctcgtttaaacaaagatgagtatgagtttttcacctatctggataagcgtagcaagcccgtcctgggcagcatcatcaagagcctgaggaacgacattggtgccactgtccatgagctttcccgagacaaggaaaagaacacagtgccctggttcccaaggaccattcaggagctggacagattcgccaatcagattctcagctatggagccgaactggatgcagaccacccaggctttaaagatcctgtgtaccgggcgagacgaaagcagtttgctgacattgcctacaactaccgccatgggcagcccattcctcgggtggaatacacagaggaggagaggaagacctggggaacggtgttcaggactctgaaggccttgtataaaacacatgcctgctacgagcacaaccacatcttccctcttctggaaaagtactgcggtttccgtgaagacaacatcccgcagctggaagatgtttctcagtttctgcagacttgtactggtttccgcctccgtcctgttgctggcttactgtcgtctcgagatttcttgggtggcctggccttccgagtcttccactgcacacagtacattaggcatggatctaagcccatgtacacacctgaacctgatatctgtcatgaactcttgggacatgtgcccttgttttcagatagaagctttgcccagttttctcaggaaattgggcttgcatcgctgggggcacctgatgagtacattgagaaactggccacaatttactggtttactgtggagtttgggctttgcaaggaaggagattctataaaggcatatggtgctgggctcttgtcatcctttggagaattacagtactgtttatcagacaagccaaagctcctgcccctggagctagagaagacagcctgccaggagtatactgtcacagagttccagcctctgtactatgtggccgagagtttcaatgatgccaaggagaaagtgaggacttttgctgccacaatcccccggcccttctccgttcgctatgacccctacactcaaagggttgaggtcctggacaatactcagcagttgaagattttagctgactccattaatagtgaggttggaatcctttgccatgccctgcagaaaataaagtcatgaacagaaagtgacgtcatagacagaacttaggaggtcaaccaaaaaaatctgctgatagaagtatagtaactgcttcttttccctgaagaagaaaagttttatttgcaatgtcagcttttaatatattttcctaacatagtggaggatcaccaaataaatcaatttctctgaaatgaaagtatattaaaacccatcagtggtagatccttcagagtcacatttgatttagatatctcagaccttcaatttggtttaaaatgtaatttctcagttctcatcaacattcatcaaatttgggactcatatcatttgggctctgtctgttcatttttaacctctcaggtaagctctgatggaatacatattgcttagtgtaaaatgtgagactgtcatcgggaacaaattattccattcagtacagattgtaatctacaaagcttagtttctacattcattcattatggctctgagaactactttgttagcctgcttacataaatgtcctctgatctaagactctattaagatagttacaagcaataaagcattatataaaaaaaaaaaa

SEQ ID NO: 553987 - DNA, 943 bp, Homo sapiens
ggggctgtctccctggaacagaagctgtcccgcctggaagcaacagctgaagcaggagaacctgggaggcccggcggaggatcgacctcaacctggatatcatgcccccagcgtgcccagtgcccaccctgcagagtccctggtgtgacaactgatgtggggcagacgcgtcgccatcctcagagagctcgaccgaaagaaaacaccaaagaaacaaccagcaccggacacagccacaatgctgggagcgtcacacagatcaaacacgtgatatcaaaccccagccgcctggagcagcattgagatttgaagagaagctgacaggcagaatccatgaagcaagcacagggcatccgtgaccaatcagagggaccagcgcctaaccacgtggcaacagacacattcacaaccgacacattgggaagaaactatgcgacgcagacagattgcgcgcaacacagacagcaacctcgcgagcccatggattgtcggacacgcatgcacgccaatcacaggaccacacccagcacacaccagatacaaataggccagaagagagccaaacaatggccgaggcgacatcccggagagcaaaccagagggcagcgaaggacacaaaggagcgaccaatccctccaattgcgaccatggcaatgatcgcgaccgccgcgacacgccgcgccaacgaactaggccacactcaacaatcagaggacacagaccagcacgggacagcagcgcgagtcacacccaaagaaaccagagaacagacaaagacaagcccaggcacactgagagcaaaggatcaacagcggccacacccctgggacacacggaacaaccgccacaacagcaacgagccacggactcggcaaggcggaccccccaagccccccacaacgcaccaattcctcggcggacaagcggacacaccccagagacg

SEQ ID NO: 553988 - DNA, 882 bp, Homo sapiens
cttacggtgcctcttagggagtagtttcttgggtgccccggacgacgcggcttcctggcttcctccctagtgaactcctacccgcccgcggttgtgtcccgctgtcttctcgcccgggggggttagcacccacttgtgccgtgctttgttgtaatagctccgctcgcgcgggcgctgtgccacaccgccccccacttgtggctttctttcacagtggtggattctctcccggtcgatgtgacacgcccccccccgggtggtgggtccccccgagtcgggttggtgctacactagtttcctcctccgcccagacattttgtggtcgtatctcctctccctggttcacactgccgtctcgcgtcagactggtttaatttccctcttcggggaaaacacgtagtgtggggtcgcgcaagtctctcatactctaaaaaggggcggccccccatcacagtagataagacagattctttctctcacacactgaagaaaacgggggacgcacactagtctcgtgagatgacccccgatcgcacacacgcacactctttgagagggagactcacgctttcacgcacagggaaagaacggccccttctcctgcgtgggttcagagacgtgctttccatatcaacagactgggagtcgtcgttttccacggaacaggagaatgctctcccacaggagacttcctctgagtgtcgcccccgctgctcttctctgagggacgtgctgtaaagcccagacagtgaacgttgtccgctccactattcgggtgaccccagaggattgagagtgggggaagtcgcacccactcacgacaagcggctaatgcaacgctacggcgtgataaaaacggagaggcccccggaccacaagaca

SEQ ID NO: 553989 - DNA, 267 bp, Homo sapiens
  misc_feature (12)..(13): n is a, c, g, or t
ggggttttttgnngggggggtttttttttttgccccccttttttggtttgggtaccccgttttcccccttttttggggggttttttcccccccgggaaccccgggttccccccggttttaggggttttttttaaacaaccccccgggggggtggggggtttttttttggggccttaaaattccccccccccttaaaaggccagtttttttttttttttgggtttgggggatttccttaaaattttttaccctttttttttgggggga

SEQ ID NO: 553990 - DNA, 786 bp, Homo sapiens
  misc_feature (786)..(786): n is a, c, g, or t
agcgggaaagcgtaggagacggtgtcaccggaacggcggcgacaagggtgttcccgaactagagtggcgcgcatacataatcttgctgctatgcttcgaagctgtagtctgaagtcaaccgtaagtttgtaaacagaaggtgaagcctcgtgagcatacaggaaaggatcaagtctatgaaggattcatttagtaaacatttattaagatgcctgctatgaactaagccttgggatacgaaaattacgaagaaaccatgccctggttatgtgagtcactggattcttgaacagggcttgtgtatcagtgttggaagtaaagtacaaagatattagacttatagaagaatcaacgtatattgttaacaagaagggatgtgggatctaaggaggacagccgttggcagtcagtggcccttgaaccagctaacaatggatgcagttcattccagcaccaacaggatccaagccagattgattgggctgcattggctccaagcttggattgcccatatgagaagcttcaggacacgcaaagcatggtagaactaaccatccatgaatgatgccaaatggacaagatatgtctacaatggaatctggttcaaatgatcatgggaatttccaaggggatttcaatacttctacacgaattgtggaaatcagaatggggcaatgcatctgcaaagccccaaaacgcacctctccagaattagccatggatgcctacaaaatcaggcccaatggacattgttcctccttctgaacgacagcacagttcaggaan

SEQ ID NO: 553991 - DNA, 93 bp, Homo sapiens
ggatttgctggtgcagtacaactaggcttaatagggactcgaattcgacgcctcgaattcgacgcctcgaattcgagccgagaccacatctca

SEQ ID NO: 553992 - DNA, 1902 bp, Homo sapiens
cttgtgcatgcctctgcccccccgggccgcggaactctcctggggcgaccccgagtcccaccccgctgctccgtgccgtcctcgcagctcgagccctcctccagcccagcagtgctcccgcagcgtctggccgctggtcgtcggcagacgaaagggcttgaaccgcggctgaccttagcctttgtccctcggcctagttccgcagctgccgtcgaggccgccagcccctcccccagcatgtttgggctaagccgcctcctttccgcctgcgttggagagagaggtaccagaaggaatgaaaggactggggcttgtctccatggcaactgaaagaaagaggtgggttataaatccttcgccaccctcctgtggcgaaggaggggaagtgggagccgggaagtagagttggccttttgcaggagagtctggagcccctttctgggtgatgcattgggggccatagaaggatttggctgccgctttggagcatggaagtagagttggccttttgcaggagagtctggagcccctttctgggtgatgcattgggggccatagaaggatttggctgccgctttggagcatggattttttttttaatcatcttcctttctcttttggagagaaaaattggtcacctccaggactgagaccctgacccttccaagcatccccactaccaaaggctgcccaagcccggaaggatcccatcccgttctggactctgaggtcacttcctcactccgtcaaatttcactggaccgtgggctaattaaaagtgcctccgtattagcggggcgtggtggcccatgcctataatcccagctacttgggaagctgaggcaggaaaattgcttgaacccgggtggcggaggctgcagtgacccaacattgtgcaacaagagcgaaactccgtctcaaaaaaaataaaaaataaaaaagagtgcctccctggggagactgtaatgcccactgggcagtgatcctaatgccccttgggcagtgatccttattcccctctcccataatgattggttgtagcaggctgaacaaaaaggttgagcttcacttgtgcttgctgaatagaattctcacgcccactccacgttagctcccctcactgtaggactagctctgaaaattctagctcctgtaggaagccaacacagacggatctacaagaaccaaaaacagctatagctactcttctaaatctcagtgcctgacattgcctctctttctgcctcctctctccaccccccaaaaaatgtggtcctccttgacctgagggagcttccgtccaagtctgagctctgatcatcctgaagaatcaaagtatcatcatcccttggctggcaagatgaactccaacgtcaaaacacttgaaacagtagtatttttacacaatttgcccactgcctctacatctcacttagtccttgcagtaacatttggatgatgaggtaacttatccagaagcacaaagcctaaagaatgacagagcttggactcctgagaagttcagctactgcccgccttatgataaccaaaagaaagcggcccggcgcagtggctcaactcctgtaatcccagcactttgggaggccgaggcgtgcgaatcacaaggtcaggagtccgagaccagcctggccaacacagtgaaaccccgtctctactaaaaaaaacaaacacaaaaattagttgggcgtggtggtgggcacctgtaatcccagctacttgggaggctgaggcaggagagtcacttgaatccggtaggcggaggttgcagtgagccgagatcgtgccactgcactccagcctgggagacagtgagactccgtctctaaaaaaaaatgaataaataaataagaaggcacaccacaagttcgagaccacttctac

SEQ ID NO: 553993 - DNA, 199 bp, Homo sapiens
caggcgctcgttcgttatacggcggctttttcggggccggcatgggcaatggcacgatctcggctcactgcaacttccgcctcccgggttcaagtgattctcctgcctcagcctcctgagtagctgggattacaggcacccgccaccacgcatggctaatttttttgtatttttagtagagatgggattccaccaggtg

SEQ ID NO: 553994 - DNA, 1134 bp, Homo sapiens
ggagagagagagagagaactagtctcgagttatttttttatttttttcagggggtaccccagccaagctgttccccgggggggccgcacagcagcccgagcgccccctttccgggagctcccctccggagctggggatccaggcgcgtacgcggagatcccagtgatcctggcgtgctgtctggggccctgttccccaccatgacctcctcggggcctggaccccggttcctgctgctgtagccgctgctgttgccccctgtggcctcagcactccgacacgtgcccgcggggccagaaggacccggtcaacccaagaagaacgctgcctgagatagacacacatggtggccacaagttagaaaccagagggtgtacctagcggttaacctgcagctcatgggaaaagtacttacaattacaatctgtgcggagacccctggggagcccctgggccaaacacgggaatgtcggccacagggctggatgtagcaacggtcgggctacagaaaccagtagtgcgcgcgaatgaaacacaagataggtgtccccggaggagggacacaacaaagaaacgagacacaccggaacaaacaacaacagcaagcacgccggaacaaggaaaatcatgacaaccaaacaccaaaggacaagcgagaggcaaactaacgaccagacacaccgaagaccgaatcccggcgccaccgagcaagaacccccaaaaaaggagagagatagcgacgcagacaaacaagaagcgagacgccaagcaggaagagacaacccacagacccagagcgcaaataccacagacgggcaggaaaagaacacaaaccagcggagaaccaccagaaaaaggggagagagaaagccacagaaacaagcaagaaccacagaagaaacagatgaacaacacgcgaggaaagagagcaaacccacaacaagtcagggggaggaaacaacaccgaggacaaaaagggacagcacaacaaacgacccacaaaagtggtagcagccaacaacgacacagtaacacaggagagtcaaacagcgagccaaacaaccaagaccgcattcacaaacccgcgtagccacaacatggacaccacaagaaacataggtagggaaaacacaa

SEQ ID NO: 553995 - DNA, 1161 bp, Homo sapiens
agttcgaaaacctgaagatccagaagaatgtcagaggaggtttatgaccctcgatctctatatgaacaggctacaggcaacagcacaggcacaggcaagccagcaggagtacgaggcaacagttccaacattcgaacaaaccatggtcaagcaggcttagcatgacagatgcagacccacacttccttgcatgcagcgtttctccgacccagccaggcacactcacatcagcaacacagccaacagcacacgagcacagacagcacacgtgcaacagcacactgcacaggcacatcaccagcacacatcacaccgtccaccgcacacggtatgcgcacattttcctcccacagcagcacaccaagcacaggccacagctgcgcacacacagcacaacttggacttggtgccacagccatcaatcagcacacaccgcacagcaaaccacaggtatcttcccaagcgccgcacacgcttcgttctgcgaccagggcaggcatgttgcaaagccccatcacacgccagcatccacgaagcacgcgtggcccaaccacgctggtgacacacaagagcaatgcaacacgcgcgcagccacatgaaggcacagtacgtgcaccaacggaaacctcacatgcatgtcccctctcaactctcgtggcacacggtcctcctccgcgaacacaaaccatccacatgcacgatggccaccataccaatccacagtgcccactactgctacccagtactagtactacgagctaatccttcctcagagcacctggaggtgccctaacatcatgcggactgcacagcgacctcccggagctcccaagcctccagcatcacgcgacagcgcacgccatcacatgcgcacccggcaacagcctcgtacgtcctccagtcttccgcacaccaacaccattcctcgacggccacctagtatctccgttccgctacacagggcagctcctccccaaagggctagactcggaccggctcattgctaggcttactagcgactttatggtccctcccaaccaacaaaaactcctctggaccggcatcctgctgcaccacattgaacattctcacccaccaccactttcaacacgtgcccacacttccacaacacacataaaccacgccctcaggcacaaacac

SEQ ID NO: 553996 - DNA, 581 bp, Homo sapiens
  misc_feature (132)..(132): n is a, c, g, or t
  misc_feature (204)..(204): n is a, c, g, or t
  misc_feature (208)..(208): n is a, c, g, or t
  misc_feature (238)..(238): n is a, c, g, or t
  misc_feature (293)..(293): n is a, c, g, or t
  misc_feature (333)..(334): n is a, c, g, or t
ccccccccagaaaaaaaaaagagggggtttctcaccccccccctttctctcccccaataagagagggggggcagaaaaaatagagagggggggggggggccctctctcccccccccccccaaagagaaaatnttctctttctttaaaaaaaaaaaaaaaaaatttttttttttatataaataaaaaaaaaacaaacccccttcncggnccttatttgtgtggcccccccccccccttnaaaaaaccaaagaggggggcgggccccccccccccccaaaaaaaaaaaaccccangggggggccccaaaaaaaaggagggggggggccccccccnnggggggggtaaaaaggggcgcataaaaaccccgccgccgcggataatatcccccccccccgcgggggggtgcccccccacccccccaaaaaaaaaggcccccaaaaagaaaacccaaagggggggccccccccaaaaggggccggggctccaagaaaccccccttggggacccaagcttcatttttttccccaaaaaaaaacccggccccccctccaattaaagttcaggcctgcccccagtgtcca

SEQ ID NO: 553997 - DNA, 270 bp, Homo sapiens
gttgaatgcatacatcataaagaagtatctcagaatgctttggtgaagttttacgtgaagatatttccttttccacaacagtcctgaaggccctccaagtatccacttgcagattctacaaagagagtgtttcaaatgtactcaatcataagatatgttcaaatctatgagatgaatgcacacatcacaaagaagtttctcagaatgcttctgtctggtttgcatgggaacatatttcccttttcaccatagttcagaaagccctccaaa

SEQ ID NO: 553998 - DNA, 106 bp, Homo sapiens
acggtacagccacactgagctctggctccaagggctgcctcctctgtgctgtccacctcctctgtgcctcctctgtgcctcctctgtgctgtccacctcctctgtg

SEQ ID NO: 553999 - DNA, 120 bp, Homo sapiens
cttagctgcccaggtattcttcttctctacagctaaaccatcactggcctacagataagcaatattaaaacaactgtagctcaccagcagacacgcgaccagcttgagaccagcttgaga

SEQ ID NO: 554000 - DNA, 600 bp, Homo sapiens
ctcgtgtcgaaaaaaaaaaaaaaaaaaaaaaaaaaaaaaaaaaaaaaaaaaaaaaaaaaaaacaaaacgaaaaaagaaaggaccatttacctgcccggccttttccatgccttgggcctgggaaacccctggcgttccccaatttaatggcttggctgcacatccccttttcgcgagcttgccggaattgccattgggcccgttccgatggcttttccaagcagtggtgcagcctggatggcgaatggcaaattgtagtgggttttttgtttaatttcgcgttaacttttggtaaagtgagcccattttttacccaatgggccgaaatcgggaaactccctggtaaagcatgagattggcccgcgttagggttgagggttgtcccggttggaaccgggagtccccttttaaggaacgtgaactcctccgtcagggggtgagcaccttattttaagggcgttggcccattgggggatccgtggccctagtcaagttttccggcgttgcggtcctctaagcccctaattcgtacccttaaggggagccccggttttgaactgtgcgggaaggggccgtccgtgccatcgttgtgttttttgt

SEQ ID NO: 554001 - DNA, 561 bp, Homo sapiens
cagaggggaaattaaaataatggagtcctggttagcctttcagggataagggataggggttttttttttttctcttttaaataactagaatatctcagtttaataaaaggtaagtttaaaatgtttatggtgccataatttaacctggcatcttgaaagaacagtaggtttcctccatgataaacggatcccagtaagaattttcagtacataccaggtacctggaaaggtctccagataagttaatagatccaaggagatacatgcctcagtgagataaactgaccttttaactagctaaactatttagccagagcaatactctgtagaactgtgcttttctaaagtaaagattatctgttcctcaatttaatgtgcataatactttcccgggtgctagcttggataggcaaaatatttggaaatgtgggccccgtaatgatggtgctagtccataagcttggtggtaatgagtgtaatcataaaaatattcccaagcagttttggaccttaattctacattccggggcattggtaatatggtattctactgatatataa

SEQ ID NO: 554002 - DNA, 300 bp, Homo sapiens
  misc_feature (25)..(25): n is a, c, g, or t
  misc_feature (32)..(32): n is a, c, g, or t
  misc_feature (178)..(178): n is a, c, g, or t
  misc_feature (226)..(226): n is a, c, g, or t
taattgggtttatcactgttgatgnctaaatnaaatttgggattacaagtgcttttctcctcaccctcataacattttataagaaaagagctcccaatttggggtttgagcatgttcctctaaaagcatcggaaatacttgctttattagttcagttaaaaatttaaagatttatggnaggacacatccataggtgacttcatagaagaccaccatgggactcagngagtacccctccagctgggaaaagcttgacaaactacataaacctgagctgagggagaaaatacacatgccatt

SEQ ID NO: 554003 - DNA, 168 bp, Homo sapiens
ctagtccctgatgggcttcagatgacgggatagtacacttcactcagaggcattgcagtcgtttaaataatttcttacaagcctctacagtgatcagtgccttgatgccaactaaggaaatttgtttcgcatagaatctctgaaggctctatgacaggaatagcatga

SEQ ID NO: 554004 - DNA, 399 bp, Homo sapiens
  misc_feature (2)..(2): n is a, c, g, or t
  misc_feature (93)..(93): n is a, c, g, or t
  misc_feature (114)..(114): n is a, c, g, or t
  misc_feature (150)..(150): n is a, c, g, or t
  misc_feature (192)..(193): n is a, c, g, or t
  misc_feature (195)..(195): n is a, c, g, or t
  misc_feature (216)..(216): n is a, c, g, or t
  misc_feature (311)..(311): n is a, c, g, or t
  misc_feature (343)..(343): n is a, c, g, or t
cncccccgccacaaatgggaaaacgtgattcttttgttttaaataaatacttagaacacgacttagctcctacaaacatctaaaactctaagnctcagaacaggaagtagtctnacccaaaggccccacgcaaggacgccacagttcccncccaccccgtgatcaaaacacgaaatcggctgccgatagatnnancgcaatgcacaccctatttcnagagccttccccggccatctacaagcaagatgcggctgggaaaaaaacaactggaatttctcgaaggttgaaggtccgcacagttagaggattcnacgtggttctcttggttccccatggtgtgtgngtatgtgaagaggaggccgcggcccttaaaatcaccattcttgagctcatcgaaca

SEQ ID NO: 554005 - DNA, 236 bp, Homo sapiens
ggacctgaatacgcatgttggggtttgtgggtcgggtggcgctgtccggctccggggcttgcggaagactcacccttcagtgtcgctgccccagctcagctcttactgcgggccgtccgacggcggtccatcctgtcagggactatgctggcgcaaacatctccttcgccaaaatgcaggcgcctgccaccgggtcggcattcgtggcgtgtcatttggcgcatgtggtggacgtc

SEQ ID NO: 554006 - DNA, 430 bp, Homo sapiens
ctgattgacaaaaagggagtgttgaggaaccttctttgcacatgaaatatttctgtgatcatttcatagatcttgaaggaactgctggtagctacagatcgtccgtgagcttaaaaactttggagacacgaagaagccacatatgatgagggccctgggaagaagtttccatccacagggcgaatacacttggccaggcttatgctaagaggcgtaagtactgctgatttgcacattctacacctattgctagccgtaagacacttactggttcataaagaactttcagtctgtccaaacacagatatgccgagcatattaagatgggcagactttgtaatttgggcaaattagatcttatatgacatactcgatatgatcgtcactccaaacaggacgttaacctgaatggccaatggttccgcgctcg

SEQ ID NO: 554007 - DNA, 820 bp, Homo sapiens
  misc_feature (820)..(820): n is a, c, g, or t
gagtccgatgtggacagagcgagctgagtggtagtgtggtcgcgctctcggtaaaccggtatcagtcttgctagtcatggatgacgcaacttgatctgtaagagcagattgtcatgaattcataagacagcgttttgcaactattctgacacagatggtgatggaactataacaacaaaggaattgggaactgtaatgagatctcttgggcagaaatctcatagaagcagagttacatggatcatgattaatgaagtagatgctagatggtaatggcacttaattgacttacgctgaatttctgacaatgatggtaagaataaatgagagagacacagagcagtgtagagaacgaaattagagaagcattcacgtgtgtttgataaggatggccaattggttatattagtgctgctagaacttcgccaaggtgatgacaaatcttggagagaagttaacagatgaatgaagttgatgagaatgatcagggaagcatgatatttgatggttgatggtcagagtaggactatgaagagttgtgtacaaatgatgactagcaaagtgaatgaccattgtacgagaagtgtgttacactttccttgtaccacaagtttgttatatggctgtgttactttgattggtcaacttgtatctgtaactagggtgttctcccctaactggtcaaaaaaatagatactgcgtgtataggacattagggaccttcaataccttccaggtgatcctggccccttaattttacctgtttattgtcctaataaccttatttttagaagcttgatccaggttacatgttggctgn

SEQ ID NO: 554008 - DNA, 811 bp, Homo sapiens
  misc_feature (3)..(3): n is a, c, g, or t
  misc_feature (17)..(17): n is a, c, g, or t
  misc_feature (24)..(24): n is a, c, g, or t
  misc_feature (28)..(28): n is a, c, g, or t
  misc_feature (77)..(77): n is a, c, g, or t
  misc_feature (132)..(133): n is a, c, g, or t
  misc_feature (160)..(160): n is a, c, g, or t
  misc_feature (163)..(163): n is a, c, g, or t
  misc_feature (179)..(179): n is a, c, g, or t
ggngcctttgcagtganattttcnggcnaccgaaggccctgcagtcgctagtagaccccagcacgtcagaatgcttnatgtagctagctagcttctaccctgactactcgtattagatcagttaatggaaannagaagtaacatggattcttgacaattnagnccacggttgaaaatcncctttacttattaagggctccccccttcccttccctatgggctaaaataaaccgaaacttaggctttaaaatttgtccggagggaaaatcctctaacctggggaatattaaaaaggggccccgcctttgttgtttcccccccctttaaaaaaaatttgccttttaaaggggttggggttaaaaaaaagaaccctaaaaaaactctttgtttaacacactttcccaaaaaattctgaaaaaaaaaaaaaatttaaaggtggggggggggggggcccccccccccttattttttttttttagagccccttttttctttttttttcctttttggggggaagtccttcaaattttctcccaaattttttttttttatcccccctttttttccccaaaaaaagtcttttttatttttaaaaaaattttttccccctaaaagaaaaaattttttttggcccttggaaaaaaaaaaaactttttccaggaaaaaaaaaaaaaaaaaaaattttttttttttttgggggggtgaaaaaacaatttttttttttaaaaaacccccggaaaaaaaattttttgcgattttttttagggggggggggggcccccccttatttttttttttgtggggggaaaaa

SEQ ID NO: 554009 - DNA, 393 bp, Homo sapiens
agtaccccagatacattttagtacatttatcgtcatcatctgctctgagtggtaaggccgttcagagaggctagaggttcttattctggctataaattatgtgagtaaaattgtgctaaccatgtaaaagtactgtacacccacgctcaatagatagtccttgaaatagcaatggaaacatgtcttctcacaagagaaaatgacagttgtaatgatgtatttgatgaatttaaactttaaggcaggtgcttcaaagtggaaagaagacttgtgttttgtgaaggtgctgtggacactttgaggaaacgtagaactcatggtgcgcttgggtttcgccattcaagtgacagggttgattgagtgttttgttagggtaaagtattagaagagaaa

SEQ ID NO: 554010 - DNA, 108 bp, Homo sapiens
attcttattgcaatgccaatgtcagaagataaccacgtgactgaaatagaaaaatgctacctatgtgagttgtgcccctacgcttgtgccttgcccatatgcaatggt

SEQ ID NO: 554011 - DNA, 859 bp, Homo sapiens
acaattaagaatctataaataaacccatacctctatagttgatattttgacaatgggaaacacaaatcctttccataacatggtgctctgacaacttgaactagccacgctagaagaacgaagtcagatctctcttccatactcatactatgaacaacttaactcaaaatggatcacaagacctaactgctaaggagactactacctatacaacactctctaaaactctagtcgctaaacataccccaataaccccctggcaaccaagggcccaccacagccaacccaaacagaacaacacggtaccgccccggcgcacctcacccacaccaacgcggctcaccaaacgggacacaattcacaatgcgcacaaaaaacgctggcaaccctggactctccagcaagatcccgctgctgcaccgggaacattccacacattggccctggaacaaccaactcccagcctcctaaaagttacaaggaaccatctccttgacacggcacaataccgcttcaacccaaccttcccaaagtattagggatcaccacaatcactcacctaccacgcaacgacaaatataccaaatggacggcaaacaacatgcaacgacaggcaaacacatcatgagaccccaaacgaccaaacgacagaaaggccacaactcacgcaaaaaacaccccaccccccccccccattctacaaacatctttaggccacaggataaccaatacaaaaccaacttcacccactctacagactaacaaacaataacaaaaaacctatcttccaacaacactcattaaccgtaaacacagcccatatcacaacaactacaacaaccgcactcccccaaaaacg

SEQ ID NO: 554012 - DNA, 596 bp, Homo sapiens
gagcctgcagtgagctatgatcacaccactgcactccagctgggagacagagtgacacccaaaaaaaaaaaaaaaaaaaaaaaaaaaaactggggggcggccggggccccggaaaagagcttttataggaaccatctgcgcgttggggcggcgcgggggccccgagaggaggtaagcgtggaacacgtgggcccaaagagcgggttccccaagaggagaaactcggggtccgaggaccagaggcggcggggaattctcctcacaaataaaaaagagcgccgcggggggaacaaagcggagagcggttggctggaaacaaatatcccaagagagggagagttccgggaggggcccaattagaggggggactcttacccaaaggaggaggtcccccgaagagaggagagaggcccgcggaactctatctccacatatttaacgcgccccccggcttgccgggtgtgataaagagacaataatacatggtgaacgatcacaacacaaactaaacgagaacgcacagacagcagagcaaaaaacacaacaaactcattacataaacaagaccaacagcaccaccaaccagacgaaaaaca

SEQ ID NO: 554013 - DNA, 149 bp, Homo sapiens
cccgatgggttcaaatcttatactaaacaatgaatgcccaaacataccattaatcggcctactcctagcacagcacaagctcaggcagctgtccaaggacctgttggtacagatttcaaacccattaaatagtacccactcggcgtgtg

SEQ ID NO: 554014 - DNA, 361 bp, Homo sapiens
gactgagaatccgaactatttgagacaggtgtcaatcagttagaaagcttattttgccaaggttaaggacatgtctgtgcaacagcctcaggaggtcctgacaacatgtacccaaggtggttgggcacagcttgctttatacattttagggagacgtgagatataaatgaatatgtgtaagatggtcacaggtagagacaaatgattgctttctttgagtcttggtacgcctttcacagaatacacgattatatggggtacagggcaggtagaggatagtcattatgcctcagtccgactcatcaatctgaggttgtcttgttgttatttagagtagagctcgctcgtcgacccaggctga

SEQ ID NO: 554015 - DNA, 639 bp, Homo sapiens
  misc_feature (594)..(594): n is a, c, g, or t
taggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaaccctgccccatcctcacttggggctgatgccattttaggcctcagcctgtctgcatgcaggcgctcattaaaacagcatgtnggcttcgaaacaacaacaacacacacacgcacacaaaaacacaac

SEQ ID NO: 554016 - DNA, 317 bp, Homo sapiens
cgacagccgagtggtcaaattactactgcatcagactgcccttcgctgacactataaattctgtctgcttggttaacgctactcgtatgaagataactagtcataatcgattttacggccccaataactgatagatagtctgcaaaaatctcttcaccatctttcctgggcactggacttgcttgggcgctctcttgtgccttgagcgccagttgtaatcacccagtgagattgtcgaaatctttgagacgtaggatcatactatcctccacgaagtaccttcattatcgaatttgcatgcatttgctggccattaa

SEQ ID NO: 554017 - DNA, 1049 bp, Homo sapiens
ggttggaacaaatgtcaaatatgtttcagagctctggagtccagacagcatcctccagaagcaacaagcccaaatcggacgggaatgaagattcagagggcaaagagcaacgttgggaaatggtgatggataagaaacactttaagctgtggcggcgcccaatgtacaggcacccagctttaggcagtagcgagtttctggaatgctacaacagatgtgacacctcggcagttcttcaagtgttcagctggacacagagtatagaagaaataatgggatgcccgtggataatcaagctggaggtgagttgagagggatgtggattagtggttcgcacggtttgcttcagctgggatacacccagtgctcgttatccagatgtactcacctgggattatgtgctgctacggaggtgatagacgtcgcgatccaggaaaagagacctgataggtagtcggtggtctcggtggctgtgcatcctctggcagtgttggcaccaagttcaccgagaatgggcgcaagcacatgatcttgtcgatgtcccctaggggaatggcgtcacccaaaagtgatcccgatcgtacagaggggtttacgactcatcttcacctagcatgacagtggactcatgcaccaagagcggggcaggcctcgtcgacgactagcgtcaggatgatccccagcgaactgccgagtaaagcctggacaccgacgcacgagggcgacaatagtgcgccacgaacacggaagatctggcatacgacgcccgtggcaagcgagcatcgtgacggcgaccagcgaggctcggcactaggcagacgacgaggagaagaacgagggcacggtggacagccggacgagaggacgcggcccgagacaacacaggccggccagacggcctgcgacacgagctgcgaaggacatacggacggagccagggcctaccagcagtggggggccgtcggacgccaccacacacacgcgggcgcaaacaacccaagacagcggggcagcggcaagaccgagaaaaaccacaaggagtggaagaa

SEQ ID NO: 554018 - DNA, 145 bp, Homo sapiens
tttgtactgcatcgtgaagatgtggctgcctacatcaccaggaggatggcggcgtgctgcagacccagacaacattatacctgaccaccggcgctagtgacggcatttcgtgtactgtgagacggcgtggctcctcatttgccca

SEQ ID NO: 554019 - DNA, 265 bp, Homo sapiens
ggccatcataacccctgtgatctgcatgtatatcatccatgatgacctgaagcaagtgaagaaccacaagaagaagcaaaataggcagttcctgccttagctgctgtcattccacccttgtgatttgttcctgctccagcctaactgcacaactgtccgcgtgtctttacatctcctggcctgagtctcaggagctcacgaccaagcatgtggtgacccctgtgcctgtgcacatgagaaaaatcccctttaactgtcatttacc

SEQ ID NO: 554020 - DNA, 526 bp, Homo sapiens
caaagactgtgccactgcacttaagcctgggcaacagaacaagaccctgtctcaaaatagatataaatagagaatgagagagcacgagcctgtctgatctggagcttcaactagaagaatttttttgatgttcaaagagttattactggccaaatgcagtggttcacacctgtaatcctagtactttgggaggccaagatgggtggatcgcttgagctcaggagttcaagaccagcctgggcaacatagcgagacccccatctgtgttttttatctactcaaaacaggaaaagaaaagaaaatgggggccaagtgtggcgacttacacctataatctcagcactttgggaggctgaggcaggcagattgcctgaggtcaggagttcgagactagcctggccaacatggtgaaacctcatctctactaaaaatacaaaaacactcccgcagcgttgtggtgtgcacccagtaatccagctacctgggaggctgaggcgggagaatcccttgaatccaaaaggcacaa

SEQ ID NO: 554021 - DNA, 139 bp, Homo sapiens
acgccggacctgttcctgtgacttggtggggccatggaggagaccggaagcgtcatgttcagtgcagagatctacttctctgagatcagctgaccccctccccccaatccctcaaaccttgaggtggaggtgatcttct

SEQ ID NO: 554022 - DNA, 170 bp, Homo sapiens
  misc_feature (134)..(134): n is a, c, g, or t
tcagccgacgcctgaagtaatgttaatagagagacggggagaaaagtgcctgattttaaggatatttcagaggtaagttccataggatttggcgattgactggtcaggaggaatccagatgaaatagaggtganaacaagctagcctcgcggacaacagggcgacacaca

SEQ ID NO: 554023 - DNA, 937 bp, Homo sapiens
  misc_feature (58)..(60): n is a, c, g, or t
  misc_feature (68)..(68): n is a, c, g, or t
  misc_feature (76)..(76): n is a, c, g, or t
  misc_feature (79)..(80): n is a, c, g, or t
  misc_feature (82)..(82): n is a, c, g, or t
  misc_feature (97)..(97): n is a, c, g, or t
  misc_feature (102)..(102): n is a, c, g, or t
  misc_feature (109)..(109): n is a, c, g, or t
  misc_feature (112)..(112): n is a, c, g, or t
  misc_feature (146)..(146): n is a, c, g, or t
  misc_feature (152)..(153): n is a, c, g, or t
  misc_feature (156)..(157): n is a, c, g, or t
  misc_feature (159)..(159): n is a, c, g, or t
  misc_feature (167)..(167): n is a, c, g, or t
  misc_feature (169)..(169): n is a, c, g, or t
  misc_feature (174)..(174): n is a, c, g, or t
  misc_feature (184)..(184): n is a, c, g, or t
  misc_feature (221)..(222): n is a, c, g, or t
  misc_feature (225)..(225): n is a, c, g, or t
  misc_feature (229)..(229): n is a, c, g, or t
  misc_feature (237)..(239): n is a, c, g, or t
  misc_feature (250)..(250): n is a, c, g, or t
  misc_feature (269)..(270): n is a, c, g, or t
  misc_feature (276)..(277): n is a, c, g, or t
  misc_feature (293)..(293): n is a, c, g, or t
  misc_feature (311)..(311): n is a, c, g, or t
  misc_feature (316)..(316): n is a, c, g, or t
  misc_feature (322)..(322): n is a, c, g, or t
  misc_feature (350)..(350): n is a, c, g, or t
  misc_feature (366)..(366): n is a, c, g, or t
  misc_feature (369)..(371): n is a, c, g, or t
  misc_feature (421)..(421): n is a, c, g, or t
  misc_feature (423)..(423): n is a, c, g, or t
  misc_feature (426)..(426): n is a, c, g, or t
  misc_feature (442)..(442): n is a, c, g, or t
  misc_feature (451)..(451): n is a, c, g, or t
  misc_feature (582)..(582): n is a, c, g, or t
  misc_feature (589)..(589): n is a, c, g, or t
  misc_feature (790)..(790): n is a, c, g, or t
  misc_feature (824)..(824): n is a, c, g, or t
  misc_feature (850)..(850): n is a, c, g, or t
  misc_feature (855)..(856): n is a, c, g, or t
  misc_feature (861)..(861): n is a, c, g, or t
  misc_feature (867)..(867): n is a, c, g, or t
  misc_feature (871)..(871): n is a, c, g, or t
  misc_feature (875)..(875): n is a, c, g, or t
  misc_feature (901)..(901): n is a, c, g, or t
cgctccccttgcgaagaactggggcctcccgggaggagagagggctttgacttgaaannngggacgcnaggggcgntcnngnaagtgggggtcctcnggganttggaangcnccggcagggtggtgtccgggcgtcctttccccgnttcttnncanntnggctggtnangtttnctcctgcgcncagtgcggacctgtctcggcgcccgctgccctctcanngcnccangcaggatnnnggcctggtcancgggcagtgtgatgcttcnngaatgnngcggggaaagagaggnaaaaaaagggcttgggcngcgcnggaggnaaaaggcctggctgagttgctcctggtntcccgcctctccaggngannnggaggtagatttccagaggaaggtaacaaaacagggggatgggcacagcnangcnagatggaagagaagancaagaaagnagaggaaatggccctgagcctcacccgagcagtggcgggcggggatgaacaggtggcaatgaagtgtgccatctggctggcagagcaacgggtgcccctgagtgtgcactgaagcctgaggtctccccaangcagganatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtggggtgattgggcagcggctggcacgagaccaggagacctgcactcccatggggtgcggcanaatgggggaagtgcctacctctatctgctgtcanccgcaaaacatccctcaacctcaggngtgcnngggcngggcantgcngatntggaaaatctggcttcaagactcagntgcacgcggggcctctggagcagcccccaaaccggg

SEQ ID NO: 554024 - DNA, 367 bp, Homo sapiens
  misc_feature (77)..(77): n is a, c, g, or t
tgcacctgtagatcgctctgcacctgtagatcgctctgcacctgtagatcgctctgcacctgtagatcgctctgcanctgtagatcgctctgcacctgtagatcgctccaacacgggaaacctcacccggcccggcacaggacaggcatggcacagatggatcagctcttactcgcattccgtgggtggtggtgccatagccgttcttcagtgggtggcagcgattggtctggttaattccgataacgcaacgcacatctggcatgctcaactagttacgcgcaccccctgagcggtcggcgtcccccaatttcttagcagggcaccagtggcgttcagccacccgagatggagcgatctagaggtg

SEQ ID NO: 554025 - DNA, 127 bp, Homo sapiens
tgcacctgtagatcgctctgcacctgtagatcgctctgcacctgtagatcgctctgcacctgtagatcgctcaatctcggataactagaccacacaggacactctaaggaccaggaggtacgacgtc

SEQ ID NO: 554026 - DNA, 522 bp, Homo sapiens
ggagcttcagcaagctatctcttgccccttatatcgtctctgttgctaataggaggctctggcttacgtcctagtagctctgtgaccttgaattggtggcgcaactagcaagggttgtgctcctcagctttctcagtgcggttgggacgtgttatcactctatctagttccctaagtgtgtggtccttgatggattgtggtagaatgcactgctgtcttggactgtcttgagtattttttgtttttcagagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgcccaaacaaagtcg

SEQ ID NO: 554027 - DNA, 329 bp, Homo sapiens
tcacccggacgacgttacccggacacaataacccggagacaataagcccggacgacactaacccggacgaacctaccccacgacgacaatcacccgaacgacaataacccggacgacaataacccgaacgacactaacccggacgacactaacccggacgaccaataacccggacgacaataacccggacacatataaccctggacacaataacccggacgacaataacccggacgacaataacccagacgacaataacccgaacggacaataacccggacggacaataaccctggacgtcaaatcacccgtgacgacaataaccacgg

SEQ ID NO: 554028 - DNA, 272 bp, Homo sapiens
tttgagctcggtaccctgaaagatgaaggctggaatgaggaaaaacttgcaaaaaagaaaactggctgggcgaggtggctcacgcctgtaatcccagcacttttggaggccggcgtggggggggggcggataatcttatgtcgggagttctagaccaccctgaccaacatggagaaaccccctctttactaataaaacaaaattagcctggaatagtgacgcctgcctccaattccatctacttgggaggcttatgggatactctataagat

SEQ ID NO: 554029 - DNA, 458 bp, Homo sapiens
  misc_feature (199)..(199): n is a, c, g, or t
  misc_feature (401)..(401): n is a, c, g, or t
  misc_feature (444)..(444): n is a, c, g, or t
tcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgcccgagatagcgcanttgcactccagcctgggcgacctgaataaaactctgtctcaaaaaaaaacaaaaacggtaagcttttatatttaattaactgatacctttcactgtggcaatctccaagagggaagattttctaaattaggacattggtctttaccttaaaggaaggaaaattggtctatttccagtggcctttttttaggcaagatttggnccaaaacgggtgggtaggtggtggaattttttaactgtcctgnaatactggtaattt

SEQ ID NO: 554030 - DNA, 879 bp, Homo sapiens
ctggtgtgattccgtcctgcgcgttgttctctggagcagcgtctttaatctccgtccgccttctctcctacctaatgtgctgtgccgccacccgatgaaagattcgatggacatggacatgagccccctgaggcccagaactatcttttcggtgtgtgaactaaaggccgacaaagattatcacttaagggtggatactgctgaaactgagcacccagttatcttaaagaacggtcagtaaaggggcttgtgcaccaggatggagttgcacattgttgaagcagaggcaatgaatacgaaggccagtccaaataaaagtaccactgcaatttgaaaattgtcttgtacagccaatgtttccccttgtgggggcttggaaataacaccaccaggtgtctaaggttgacgttgtgcttcagggcccagtgcatattagtgcgcccagcacttagtagctgtggaggaagatgcagagtcagaagcatgacagaggcaggcggatgtgaacttctaagtatatcttgaacgcggtctgcccctgatgtgttcgcagggttccaccagaacacacgtaaaaactttgttgtgatgacgatgatgacggatgatgatgacgaggtgctggttaacgattgcggctgatgatgattttgtgatgaggagtgaaaaaaagcgcagtgagaattaaagagaattccaggcaaatgcaaagtactcgagggaagctcaactttctaaaccggtaaagggagatttagaaaaggaaattctaacaggctttttgaaatagcatgcggtaaaagggttgccagggaccaatgtgaaggcggggcaggaacatcgggggccaaaaaaggacagtttcgtgttggcagggta

SEQ ID NO: 554031 - DNA, 495 bp, Homo sapiens
caatccaatccaggttcccaaatcgcccgcacatccacctcctatatacgtccggacctaaaaaggacgagggtgtgcggagaaacgcgcccgccttttactgggaacgtagaccgaggttaacgaactcgcctctactaacctctcgttaactaaagctcgatcgcgtaaccgcggacgactactggaaggcctaaaggatatgatcttcgacaaaaccaccgtatacctaacctcgccttaaagattgtcttgttagtaagaagaggagaggtaagtgtaaaaagccgatgacgtctctaaagagaaaaagaaagacgacggtggctcgatcatcaagtccgactctcgttatcgagatttccaaggcgacttactcctatttccctcgctatacgacccgaaactaaaaacgatagaagacttacgactctataaaggaaaagggcgccccctcccctcaacccctcgagcactgcccggtagtaccaattt

SEQ ID NO: 554032 - DNA, 410 bp, Homo sapiens
gaagaggaggcgcagatgaacggaaggggcacacgatgggaagggggccctggacaggtctcggctctgcttctgtaaaagcggacggagttttcagagcagaaggattgcagtctgcaggctgggatcccccctaatttgcaagccggcttgctctgtgcccaggccccagcctggtgtcctccctctgccctttcctccgctactctcagttttcctggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccgcctgtgatcccagcacctcgggaggccgacgttaga

SEQ ID NO: 554033 - DNA, 130 bp, Homo sapiens
  misc_feature (26)..(26): n is a, c, g, or t
aggtgactctaccgatgctttgaatncgacggtttctcacactagatctgtatacagaaaagagagatgggcaacaacaagctaggcctaaattcacgaggaggtgaaaacaacaaagaatgcagagacc

SEQ ID NO: 554034 - DNA, 444 bp, Homo sapiens
agatcctctcctcataccaaaataaacaagtggattaagacttaaatctgaaacctcaaactatgaaactactacaagaaaagactgggagaaatatccaggacattggtctgggcaaaaatttcttgagcataccccacaagcacaggcaaccaaagctaaaatggacaaatgcgatcacatcaggttaaaaagcttctgtgcagcaaaataataatcatcagagtaaacagacaaccaacagatgggagaaaatcatttgcgaaatatgtatcccgacaaagaagtaatatccagaatctacaaggaatgcaaataaatcagcaagaccaaaaagccaataattccatcaaaaagtggccaaggacatgaatagacaattctcaagagaagatatacaaatggccaacaaacatatgagaaaatgctcaatatcactaatta

SEQ ID NO: 554035 - DNA, 112 bp, Homo sapiens
ccgatatcgcgccactgcactccagccagggcgacagagtgagactccgtctcaccaaaacaacaaaagggatcctataggccgggcttgtggccccccgcttgtaccccca

SEQ ID NO: 554036 - DNA, 248 bp, Homo sapiens
catggctgatttcaccaggcctggctgacttctggcacttccagcttgacagctcgatcatgaattcctggggcggcgcggctgatgaacaactgcgggcacgcggtccgaacggacttcggccaggtagccgcgcacgcggtcaccagcgcgcagcatgttgcgcggaaggcccttgtccttcggaatgaagccttcggcgttgccacctgatgtcgacatagatgttgccgcgctcggcggcgctt

SEQ ID NO: 554037 - DNA, 263 bp, Homo sapiens
tgtgtttaccccccccccccccccttttataaaagaatgggggggggggggtttgggggggggggggctttttttttaaaccccccctctttttattcccccggggtggtctgcctggggccgcccctccccgttttttcgccccccataaaaacctggggggccgatcccccctccgttttttagcgtgggcgggggggcggttttttttttcccccgggcaacaattatccccgttcggccttttttggcccccttttaca

SEQ ID NO: 554038 - DNA, 1328 bp, Homo sapiens
  misc_feature (341)..(341): n is a, c, g, or t
  misc_feature (373)..(373): n is a, c, g, or t
  misc_feature (444)..(444): n is a, c, g, or t
  misc_feature (1225)..(1225): n is a, c, g, or t
agcgggttttggtgtgtctactgcgacaatgaacactattctcatgctaatgtcagactgtcgacattccaggacatccatgttcgatcgttactctgaagggactcacagttagtcgtgaagggactcctcagaggaaacccatgtcgtgagtggagctgtcgagagtgcatcatcgaggtgtgagaactctagcctttccttgcgtagagagcaaaacaacaaggaggctccggagggcttgactgaatggtggggtaacagaaaggaactggctaccggttcgcactatttgtagtcctgttcagtcacagaatggagtcaatgggtggttacgaacntgtggtcctatcccggtgtactagagtactgnaggggtctgggtgattccatgcatcatgggtgtctccccactctaacaggctatgcgtatagtccgtaggngaagcacaatggtgtgtctcatgtgctatggacaagtccgtaacattgtcccgtctggggtagattgaaataatatcctcgcagaaggttcgagaatcgaagacccaaggggctgtttgccttgtgctgacgaggctagtcgtcgataagcacccaagccaaagagtcgatattcaattctcgttggaaaggaaaaaattgacactgtgatcgcctatgtatactatcagtttctagggccgggctgtgtgagttatcatgcgggagagcccactgagacacagtttatccaggcgagggatatcatagatgcaatttttcggggactgggctatcattactcgtcgctctgtgaaaatgcaaaggacacatgtttcatagcgagaggcgctgattgaagctaatgatctcggtaaggaaagagttagcccggtggggctacattgaaacacgaaaggagttgccccatgtaatgaccacgtttaaaagaaaacctaacttttgctagaagtaatcttaaaccttgaccttgccacagatgcactataggagacctacttcgaagtcttgtgggaccccttgcgtctcccttttaacaaaaggacattcacattcacgaatacctcctgtcaagaggtttggtagaaattgcccgggtctctaaaaggaggcccttgtgaagtacctctataccaggggggtggtggacccccgggggaacccaagaacttgtttttggcttgccgcaattttataatgaggggggttttcaccatttggnaacagctttggggggggaaaaaccatgttgtggcattataggacttggtttgccccgtggtgttgaaaagtcgtgtttagtccgtgtcccaaagttcccacac

SEQ ID NO: 554039 - DNA, 256 bp, Homo sapiens
caacagagaggagattggaagctgaccttccacccatacgatagaactataaagcagaagagtttagaaagaatgaccatatactaagtgacgaaacctcatactccataagtgataaatagcacaaaggctaaaaaaacttatttttgaccaaaagctctgttgacattctattacacaaacaccgacctatataattaacataatgtaaatggcagacattttcataattcttatgctaataaatcatttccct

SEQ ID NO: 554040 - DNA, 395 bp, Homo sapiens
gataccccctccatagtggtacctccaaagagagtgttacatagcaggacaccaaggtcaacccctcatgcctctcctgcccccttctgtgaggcaaaacaggttacgataaaccaaaagttttcgcctgtaaagtccccccaaagggcctgagcttgcccgtcccaaaaagtttccacaaggaagagttttagagggaaaagggccccccctgtttcccagggttaagcgggacccccccccaacctttggcctatgaccctttttccacaggggacatacccctattggggtcctaaaggtaatttttccccccccccccccccccccccttggctttaattatggtaatgttgggggaaaaaaaaaaaaaaaaatgaatttttgcccccgta

SEQ ID NO: 554041 - DNA, 123 bp, Homo sapiens
ttggcattgtttggtgagttagtcatatcctaaggtcactactggctagctcttctcagcccaggcatattgctcctaattgctcctagtatgagctaaacattccttacacaacagggagca

SEQ ID NO: 554042 - DNA, 254 bp, Homo sapiens
tggcccaaggaaaaacctaggagggtccagcccagcccaggccctttccccctaccctggggcccagattttccatcaggggcggaggaaaaccctaagggcctcaaatgccctttccctgggaaccattttgtcccctttattcctttagggagccctgggccccctctttttgggttttccaaaggaaagggctttcagaaagaagggtttgtaaaatccccaggaaaaaaaactggggttgggccccggga

SEQ ID NO: 554043 - DNA, 964 bp, Homo sapiens
ggccgaacctgatctggatcctatatattgagtctgacgtggttgggagctgtgcagtgcggtccgtgtgtctggtgtgactaatctcgcgcgtacgcatggactggtgatggagcgtgtcctgggttctgtgattgtcaggagctagggccgagaacgtactggacaatgagagtttgaaaacgcttcagcggcctgtagactcaccggcaggtgtgctcgagaggactcgcaacgtaacggcattgcatgcagaatacactaagacccttgcaggaggtacgcgtagcagagcattcaaggacacgtgccgcgacagcggtggccatgtgggtggagttgcactcagcgtgcgccttgaatgacgcgagtcgcattagcgcgcgaatgactactaggatgagaattcgaaagtcactagacgaagtcgatattcgaatagtgcagggcaggtggtacacgatggttagaggttacccacaagtgacgttggactatgggacgatgaactgttgtccatatgaaagtgggaccgatggagaattggacagtatgtggcaggctgtgaacacatgggcagtgggggaatgttggatggagtacgacaatggtgaaagaggattggaaagttccccgaaaggtagtaatgttaaatttgagacttggaatatggttcattaaaacgcccactgacggggcgcgaacacaacgacggtgtcgaacggcacttctgggcaacggttcttcgcaccaagtatacaccacgcaaattctaccaaagcaaaagacacagcggcaccagggaaacggggagccaccacaatggcgcgccagtgcacactataagatgagttggggacagacagccgttggggataccacagattggcgcgagacgcctgggagtcagagaacagcgagaaagaggaccaaaacaaagaggtgacagataggcaatattccc

SEQ ID NO: 554044 - DNA, 770 bp, Homo sapiens
gcagatgcgtatcatatgctggatggtgttacttgagattagaattttgccccgtggtcatatgcacagcacctcatgctagtcctcacggaaactggaataagcctgcgaaaagaaattgtccttgatagcttgtatctgatatcagcactggtattgtagaacttgtgctgattatgaccttgttattgaacgttaactgttccccttgggtatttgtttagataccctgcttcagtatcttcgagcttcaacctttagttcacggtgtggcttggtcacttcggtggctaaggtacgaacgtgcttgtgcgagagcacaaagtctgtgctcttgagttgagtctgtgtggccagcagacctctggatctgtgtccggggtattaacgtgtcaggggctgcagtgttctgcggtagtttctctacaggctggtcagtaaccgagttgttttgtccttgcggggtctgtccaggctctggaaagtccaagcccgtgaggacccatgtttccctctctcttagctgatgtctttcggccaagcacacccgtgggctgttgactttgctttgagttgggagcgggctttgcatttaccgccctgtaaatgtcttccttctttaagttgcatgtgaggtccttcctttgtacgcagtctcgattcttttgcgacctgaccaccttgggtctcttcctggttttgttggaactctggcccagcaccgtcttgtgtaccgaagaatccagtgctgcgtaccgacaatgaaacag

SEQ ID NO: 554045 - DNA, 1106 bp, Homo sapiens
ggaagagcgttagtgtgtgaacagtactgaggtctcctctcctctcctatcctcgctctcgtgacctagctttacccgcccgcctgctcggcgaccagaacaccttccacctatgaccacctcagcaagttcccacgttaacagtaacaggctactcacagcagtgtgttacatgtacctgatcctcaattgggtgagaaatgtcccatggcctatgtatatctcgagtatctgaatgcgtactgcgtagagagcgacttgcagctagtaagaccctcggaacctggagccacctcgcagccctgagtgtgtgcgcacaggagttagcactgcagatgggaatttctcggcactgcgttcatcagtctcactctttcactcacgtcactgtcctgcttccgaactcagttggaacattggttgtcatctgtctgcccatgccattgcacaacctaggtattcgggagagcacgcccctgattcccgtctcacatgtacgccatgagagcaacatgccattgtcgctcgtaccactgtgtgaacaggtcttatcacgccaaagtaaccataatccgacaaatgcgtcccttgcccatgtaagcaaccccataagtactacgaggatgactaccaaccactttggattaataccatctgagagttacgactcgcggaccccacattgtgtactgaatgcccaaaacaccccaagaagtatcacctccccattggtgtatttagctagagaaccccttgggaatgggccaccgaggtaaaggtctcttcagcaccttcattcactacattgagcgggcacaccccgtacatggtgagtctacctgccaacttactcgtgtatgctcctggaagaataccttatcacagaaaagagtgaccttttacctacacagtgcggactaccattacaatacgtgatccccgagttaaatcttaaacttgtatggcgtgtgagatgaggtgccaagcctcaagttaaccatgacagctgacactctcattggagacccgagggggaaacaccattatccagacggaccagaagacctctcactattgtaccgccaggcacgcaccctagtgcggta

SEQ ID NO: 554046 - DNA, 1337 bp, Homo sapiens
ttgtgggtcctccacgggctccccctgggggggataataagcccccgggtggagacacccactgtgggtgtggtgtctaccctgcggggttttttcataaccacccagagaccgtcggggtgggatgctttgttaaaggagatatgctttttgatgggccggctctcctcacactgtttgtcacttgatgtggtcccctctaactgcgtgtgggtgtatattttgtcgctcttgtggtttcttattaggtcgagtaagatacagaaagcgcgtcttcctctttaatatggtccacaccgcggaggagcgttggtggcgttggtccttcccacacagagaaaatatagacagtttggtgtcccccctatcacgcaggtttatatacctcgagaaataaatatttttctcccggcgagccccctctggtagagttgtggattattatggggagatatttcctcttttacgtgggcgcgtgtgtcgcgtcgagcctctttttggcacagcaaaaaagggcgtctcatattgtgagagcggtacacatgtgcacacgtgtttacacacgcgtatagccttgttgacaaaattgtttctcgcgccctcttgagaagattccccaacatgtgtgtgtacacacgcgtttacacacgcacatttttatatagagaatacccgcggcacacatttcttcctcccagcgggagagatatatataatttctttgctcacagggccacattataatgtgtctccagaaatgagggtgggtatatgttctcacacacacatttgttgtgagaggggaaacttgtgcgttgtgctccacgcgcctctctctttgtgtgtgattcacaagctccacagtgggctctctagagactttctttgctcacacactcgagaacactcgttttcgcgagagccacatgttctgagaaaatatagagatagagatagtgggggataacacacctctcgcagatataatttctcggagatataactcgagactaagcacccacattatatgagatcacccacgctagcttgtgtgggcgtggagaatggagaagaaagagatcaccctcgtggtgggttccctctgtgtgttgtgagaagaattaatttccgtctctgaaatttttctggggtgtggttttccacgcgttggcactcttgccctcgagaagttgtatttgaaaccacacatttataatgagaaaatatttaaatatatttgggttccaaaaggcacagagatttatttttttcccccaccttttgttaattttgaaaccttttgaaaaacttattaaaacttattaaagaagcgttta

SEQ ID NO: 554047 - DNA, 644 bp, Homo sapiens
  misc_feature (26)..(26): n is a, c, g, or t
  misc_feature (71)..(72): n is a, c, g, or t
  misc_feature (110)..(110): n is a, c, g, or t
  misc_feature (507)..(507): n is a, c, g, or t
gtgtgagtgcggggcgctttctcgcngatggtcaaggtgccgttgctttcccaggcaacccgcacgccgcnngtggaagccttcgatacggaaggcttcgccattctcangatagcgttcaccgtcgcggggaatcatttcgtccagtaccagcgtcttgctgtcccggtcgatgtccaccaggtagctctggaagcgctggctacgttcgtggaaggtgatgatcagcgggtcatggctttcttgcagcatccgcaacgtgctggcgatttccagaggcgtggtgagcaccttgggtggctgcggtgcatcttccgcattaagggcgttgaacacggttcttccatctccaggcaaaatacgactacacgcaagaaccggcattttgccagtatgtagcgcgccttggataggtcgcgctgtaaaccggcgtcaggcttggctgcgggtgcttggtttgatcaggctcaagaacagtaatgctcatttattctcagcataagcatngcttcagtgatcatgctgttcatggccgtggtggtgtgctttcttcattacaggattgtccttgtattctcactcttgatggttcgcactgtttcagcgaggtgtgccggtggatgcggctctacggggggatcctc

SEQ ID NO: 554048 - DNA, 476 bp, Homo sapiens
  misc_feature (19)..(19): n is a, c, g, or t
  misc_feature (247)..(247): n is a, c, g, or t
cggcagggaaaggcttttnatttttaggccccaaagaatttgctcctgctcctccaaagaaaatggctggggcaggctgttgaggaataattttgcagggaaaagtggaaaatggctgtgaaaaactgggaggaggctggctgtgttttcaggggtttttcctgcacagtcggtaaaaatttaacttctggggaaaggggtggaaaaaagccccccccccagggatcagtagcaaattcaaaaactncagaatcagctccaaagggctttgtttacaaaaaaaaaaaaatttaaaacagccctgggggttccccaactcaaaagctcccaggcaaaatgggattctgggccccccatttttcctaccccatcctcagtggggacttccccaggccccgtttgttttggcatgggggtagttcaaccctggggcccccctcatccttataaataccaactgtttttggtgaggggca

SEQ ID NO: 554049 - DNA, 86 bp, Homo sapiens
aaagagaacaggtagggtcgggctgaggcagtcccacggctcttgccggtgcatcttcatatacgggtgctcataaactttgctcc

SEQ ID NO: 554050 - DNA, 200 bp, Homo sapiens
  misc_feature (48)..(48): n is a, c, g, or t
  misc_feature (54)..(54): n is a, c, g, or t
  misc_feature (132)..(132): n is a, c, g, or t
  misc_feature (180)..(180): n is a, c, g, or t
  misc_feature (189)..(189): n is a, c, g, or t
tcttcattgccgcctccggagtccactgcagaggggcagagtgaatgncggcgnccaaggtggcctccgggacaggtcctggagccctgctggactcagggtggggtggagggctgttgcctgttggacggnccgggggtgggccaaggacgggcaaaggggcttggggagggcacggtncccccaagncccagaaaaaa

SEQ ID NO: 554051 - DNA, 134 bp, Homo sapiens
cggaacaagcgcttctactgagtggcgcctccggcggggcctgtacctgggcccaggagccaatgtgaacttttttttaaccgggattataaaagacaacagatacctattctagtgcttccaaatataaatcc

SEQ ID NO: 554052 - DNA, 614 bp, Homo sapiens
cgagtctaccaccattgttaaatagtacctgcctttctggcgttgcttgtggtctatagtggtactcaagatcatgactaagtttgaggtcgggttcaggtgaaggtctgctgctcagtgtgtcgatccgctagtgttaatcaaagccacatcttctttaagtcatagagtttagaactatgttacgaaagtaccgggcagagcaagtgagacgtatccgtttgaagcatgacgaagtctatgcccgttgtcctttcagatggagattattgtgtttaagtacatgcacagtttcgagggtctgggaggcgtaatggtaaaatagatggtctttcatctgcctcttcttccccccatcgcttactctccctccccagtggcagctacttaggatagtttactgtttctcctgcgtttttcactggggccatatgtagggtcttcttgggctggtcagagagtggtcttccagtaaagtttggcactgaggaaagagtgtaggttccagtgttcatggaggaatctggctggggttccagcatcctctgtgtagagtcatgtcggagaaggttcaccatacagacttacctgtttacctactcttccaagaacaa

SEQ ID NO: 554053 - DNA, 324 bp, Homo sapiens
aactacctatcctcgggggaaaagctgagtgagtgaaaaagcaaaaaatggctaagctgccatactccaacgcagactaatcaaagcatgtaaatattatttaaaatatccgtctaggctgagtgcggtggctcacacctcgttatctcagcactttgggaggccgatgtgggcggatcacctgaggtcaagagttcgagaccagcctggccaacatggcgaaacctcgtctctactaaaaatacaaaaattagctgcgtgtggtggcggacacctgtaatcccagctatttgggaggcaggagaattgcttgaacctgcgagg

SEQ ID NO: 554054 - DNA, 422 bp, Homo sapiens
tagctgctccctcttcagatgccctgaagaatcttcagaatcacactcttactgtccctttatatatttcttagtccttcttaatgaaggagaaacaatgttagaattttgtggtacgattataggtttctgaacatgaattcaacaattcagtcttactaccttaatgcttgcagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaataaagtgcccctcaggctg

SEQ ID NO: 554055 - DNA, 152 bp, Homo sapiens
ctcgtctgctgatactatcctgacagatctctcacacgaatcgtcatgaaatcatcatttcttgccctgttcggcgctcggcttaaagttctggaacttggccatcttcttctcatcatagtacaagaacttgtggtgatcttctgcacgat

SEQ ID NO: 554056 - DNA, 259 bp, Homo sapiens
  misc_feature (9)..(9): n is a, c, g, or t
  misc_feature (27)..(27): n is a, c, g, or t
  misc_feature (35)..(35): n is a, c, g, or t
  misc_feature (75)..(75): n is a, c, g, or t
  misc_feature (219)..(219): n is a, c, g, or t
  misc_feature (226)..(226): n is a, c, g, or t
  misc_feature (235)..(235): n is a, c, g, or t
  misc_feature (251)..(251): n is a, c, g, or t
  misc_feature (254)..(254): n is a, c, g, or t
agaagaagncgctggcgtcagccggcnaggaaatnaggccgttgcgcatcaccttttcgtcaaggatgtccaagncggcctcgatgacttggccggcgctgccagttgaaactggccgttgtcgtcaatggtgaaaaggtcgatgtgcgaagcagtcatgtcatggactccaggaagtgggcgggattgcctacttcctctggatcggttcgcagcgcnagcggtncaagggtgnagatagccagcggggnggnaaggg

SEQ ID NO: 554057 - DNA, 2007 bp, Homo sapiens
cgcgttgcttgcgctgcgtgcgtggttgtgatcaaatagagtcgacgacacgttgggttgggggtgttgtttgtccttggtgtcggtcgtgtcggcagtgttgtgtcggtggtgtgttgtgtttgcgctcgggtcggcgcgcgtgcgacggtagggcggtgagatcgtgtgcgtgctttcccgccgttcttggggatgacgattgtgggtggtggtcctactgtggggggagggcgcccccccgtttgggggggttttttgtgatatgtgggggccgaggggttgatatgctgtgggtggtcgatggatgggagtacggttggtgggataatataggtggggcaggtgatagcgtgtgtggggttgagtagtacgggctgttgtggaggagatgaggcgtctgccggtgtgtctttttgcgggtgctatcaccggggcgcgtctttgtgattgcgtttggggtggggttgccctacttgtgcgtgtggttctgctgctggttgcgtgatggttgggctgctcgagcgggggcttgtgggttttgtgtgcgctcgcgcctgcttgtaggggggtcgaattggttgttgagttatgttgtttgtgtatgtagaaaggtggcgctccgcgctcctggtggtgcttattgttgtgaggtgcccggctgcgctggcctcgttgtggtctccgtggtgtcgcctgggtgaggattgtttgttatttgcgtggggtggtcgacacctccgtcttcgggggtgtggttagtagtgaggggggtggctccttccgccggcgcgcgcgccgcaccctccgcgcagtggggggcggcgagggggtctcctcatcccgccgctgctgctaggttgggggtgttactactccgcgaccgcgggctgttgttgctccgcacagcacagcgtcgcctctcgtgctctcgcctgctggcgcctcgtcgtgtgggggaatattgttgtgcggcctactatcaacacgaggcggggagaggagatgttatattaggaaggctgcgctcgctcgtctgcacgtaggtggtggtctgtcgcacgagggagcccccctcgtggcaggggtggtttgttggtttgttgtggtcgtggatagtaggagtggcggcgtgtgtagttagaagatgtgggggggatgttgttgttgtgtgttttggttgattgtcgtgtgtgtaggatcgtgtacttccacgcgggggtggtagtgatagtgatgtggtgtgggtggggaaaacacatcagcagtgtggtggtgtgttgggtggggttccaccgcccccccacgtcggtgttgttgtatatggtggagtcgtgcgctggcgcgtgtggaggccccacacagcactcaccgcgcgcctcgtgctgggtggtcgcgcctcgttgtcgtggtgtgggtgttctcgaatacttgttttgtgtgagagtacgtgatgactacttctgtgtgtgtgtggttgagaccacacactgctggtctcgactgattagatatagtttgtgctcacaagagagagagatatatagataaacaccgctgtgtgatgatgaataattagacgcacacagaaatagtgtcgactcacacacactagatatacacacactgtgtgtgtgtttgtctctgagagctctgttgtctcgcacgcggacgctgtgtgtgtgtgttggttgattgagtacatgtatgacgcgggtgacagcagacaagagtgagagtgtgggggtggtggtagatgaagagagagagggtgtgttaatagagacccccaagagatgtataaagaggtgtgttgttgtgtgtgttgtctccctgttgttggtggttgagtaaaggtgctgtttgttatattttttgtggcgccgtggtgtgtagagagaagagcgggcggacacacacaagaggggccccaccacagtagtcacatcacgagatatgttgatgttgtgtgtggtgagagagtgggtttgcacccaaaaaataaaa

SEQ ID NO: 554058 - DNA, 907 bp, Homo sapiens
  misc_feature (3)..(3): n is a, c, g, or t
tantcttgatttgtagagaaactgaaacagagaggcggtcttcgcacagcaaggagcgataacctgtgcgacgacgtgtatggcgccttttgtcatatatagtccgccgcacaattgtgatcctatcccggaccacaagacgtcgtgttcacaagggaacccttctgggcccgcatggggaaattgtacgcgccggggcaatttccgcccagccctttgctcttgatacgtacaacgcccgggctaaaaatattcacgacagcacgtctagccccccgtggtgcataaaatagacgcacagggttcccgtggtcttccccaaggacccccggctcaagtctgctggccgtatggtctcgaaaaacgtcttttagaaccaaaaagacttgggcgagggggatgccccgctgctcgcccccatatttggttggcttctcccgcgtgtacgcctgtgctttaccttccccccttacccgcatgagggagtccctctccaggaagagcatccccattaatttgagggacaaaaatccgcatgcgacggtcccaactggtcccctttaaagaacattttctgtaaaagcaatgggcacagcaagacgatgttgttcaaagctcactctatatgggcgcccgcgggatatgtaaattttgaaaaacggagtcccgcgcaaactcaactggggtgcccttgaggcagaaatcatcaccctatgccggatggaaaaccacatacgcaacactaaatttgggaagatgaccctggaacaatagtggtttccccagggggccaaagaggggacacactaaatcatttcatatcaaaggcatcattggtataaaagcccacctagcaaaattcctttttcatcccccataggggataaaccaaagcccaacaaaaaca

SEQ ID NO: 554059 - DNA, 1431 bp, Homo sapiens
ctctcctgtctccccacctccacagagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactacacgctgctggatgtgcttgagcccggcagctcaccttcagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttctttctccccattggggctacaggatccataaatcacaaggaggctgtaaccatccccaagggctgcgtcctggcctttcgagtgagacagctgatggtcaaaggcaaagatgagtgggatattccacatatctgcaatgataacatgcaaaccttccctcctggaggtaagccaggagaagggaagttcatattgatccaggcatctgatgttggggagatgcacgaaggcttcaggacactaaaagaagaagttcagagagagacccaacaagtggagaagctgagccgagtagggcaaagctccctgctcagctccctcagcaaacttctagggaagaaaaaggagctacaagaccttgagctcgcacttgaaggggctctagacaagggacatgaagtgaccctggaggcactcccaaaagatgtcctgctatcaaaggaggccgtgggcgccatcctctatttcgttggagccctaacagagctaagtgaagcccaacagaagctgctggtgaaatccatggagaaaaagatcctacccgtgcagctaaagctggtgaggggcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgt

SEQ ID NO: 554060 - DNA, 1065 bp, Homo sapiens
  misc_feature (814)..(814): n is a, c, g, or t
cgtggtcctcgatctcggggatttttcacgccgcctcgaaccgctttcccattaatcggttgttgaggaagctttgtgctgctccccccccccgattatattttttaatctcgcggcagtttttcgtgggacagcagaagagcggggtcctcattttgtgtttgttgattggagccctggttgagtggtctcctctcttgaagatttgttttcctcctgggggtagttggcgacccaccgccgggggttaatatgttggcaccagtgcccccgttggcctgtgtgctccccccactagaagtttttttttgtccccgcgaactatgcttcctgggggcctaccttcttattaacttgggtcgccctgcctgagcaccttttcttctccccggttgataccaccgcgcggcgccccctctgtttttgatctcctgatgaaatatcctctctgttgcacctctcgccgccttccttcattcttttttcgaatgattagtggtcgcctctcttgttgcttcataatattgagtgcgccccgcgcgcctcctctttatcattcatccacgcgcgcccgctgttcttgtgggggaccctcctctaataggggaaataaatcaccaacccggcgtgtgttcttgtggctccgatatatattgttggaaccctcctctgcttaatatatagcagatagattatcacgccactactatttaatatctcctccgtccattagtagtgcgagtattattgcaagcaaccactatacaaccatgtgtccacaaaagcactccgggcgtgttttgtttttggtcgntccagcagaagtagatattaacagccactccgtcctccctctcgtttggtgccaccacatagaattattgacacacacacaactaaagtcgggggagggggtaaaaactcccccctcccgaaaaacaacacctttttataaaaaatttgtgggatttttaaatgggtttttttgacacacaatctctccccccgcggaaatttttttaaatgtgtggtttctctcaaaaaagggtttttggaattttttta

SEQ ID NO: 554061 - DNA, 981 bp, Homo sapiens
  misc_feature (622)..(622): n is a, c, g, or t
  misc_feature (633)..(633): n is a, c, g, or t
  misc_feature (649)..(649): n is a, c, g, or t
atcgccgaggaccgagtgcgccccgggagcacttagagctgtctgtccattgggcagatccggctgtccagtcacaacaactccagccaaggtccaagactcaactcaatggaatgaatgatatcagccgcgcatcggtcgtcgacaaggagttccggcgatgtgcaaggcacggcttcggctgggtcgacgaatgcctcctccggggtccgtcttccccacgtccgatcagtggggcggggtccataggcgttctcaatgggccgtgagttgagtggggcagtggggtgccaaaaggggatttcctaatggtagcggcagaactagatagtactcatgaagctatttgaagaaaggcacatccttcatttcacatgataagtatcccctctatatcgatgccaatctggtcacttcagtttcatcacgaaacatggcgtagtcggacactggtggggaccaacattctgggccaacgctaggaccttttcttgtccaattgtacgctcgccagttgttgtgattccttcgcatgtgaagtctacccatcggtcgacttgcttagacgtcgaagttggctccatgctaggatatcccacaatggtccggaagccgtgaggancgtgatcgtcnccagcatttcaatgtnttctgcagtaaccttgtacgagaagcatctccgaagtaaggttgaccggtaagtgtatcgcgaggtcgtggctgttaaatcccgttgttgacggcactcttagagtgcgataacgccaggtggagcatccgtcgaaggacatggttcctgagttgagtcagtgcatcgatcaaccacttggaggacccagtcttagcgaagccaagtatggccacttacctcaaaatgtgcgatccctgaagtactggaagctggttgtggcctggtaccttgacttgagtaccttccttgaagtactctgtcaacgaatcgcggtaaaaggtttttccagc

SEQ ID NO: 554062 - DNA, 826 bp, Homo sapiens
  misc_feature (510)..(510): n is a, c, g, or t
agcgggtcgaggagaacgcagatggtgtggacgctgtgtatgaaatgtctttcctccaggacccaagattgtcttcaccatggggactgtgtgctccatcggttgcacggagccctggtggggctgctagccttgagcattcgctggccttgcgcatactatcatgacgtgatttactgttccaagtccccagacagcggccctggcagtacctggaggatatagacctgaagaacactggaagaaggaaccaaggactttcagatgcaaagagagcctatgcggaatatgacaactggacgtcgtgtgagttagtcggccgtgtcgcgaggccgaggctggtttcactctggtcgcagagtgaacgctgctggactctgtcctccctgtaaaagcatgttggacccagattgggcgtccccctctatgcagctgtgtataccggagcacatcaggactgacagtgaaggatttgccatggccttacttgtcagcacggacgaagatctntcctaggtatgtaagaaggcaaagaatgtactatggtccacaaaggcggcagatgatgtttatgggatttatccgctctgggagtgctggtaccaacttcttccgagcctggcacacggaggcttctctgggaaagcctgggaaggcacaaggcttcgtccttgaggggaggtgcacgtggctgggatcaggactagcagggcattcttcttgagctaccgaagaagactgacctttggagactaaggtagacctacttccttgtcctggaagctgctaagatcgatcagaccagagagtttggcctcacgtagaa

SEQ ID NO: 554063 - DNA, 111 bp, Homo sapiens
tatttggggtactctcagatactatttggccaaccatgccatctaaactgcctaactgtctctcgtttcaaggacctatcaagatggaggccccttcaccaagggttggtg

SEQ ID NO: 554064 - DNA, 151 bp, Homo sapiens
tgcgtcatcactcacgacatctattatccatccactcagacatactatccatctatccacccatccacttatctatctatccatccatccatccatgcatcaatccatccatctacctactcatccacctacccatctacctacttatccg

SEQ ID NO: 554065 - DNA, 125 bp, Homo sapiens
cgagatcgacctttcaaagagctctaaagaaagtactaaatattgaacgcaaagctgtatcaggcactacaaaacttgatatcacagaccgtacaattaagcaacacataacagtttggaaataa

SEQ ID NO: 554066 - DNA, 197 bp, Homo sapiens
  misc_feature (113)..(113): n is a, c, g, or t
tcggatagggccaaatggatgtggggtagaagaagaaaacttcgaaggcttaactctgaaacatcacacatctaagattcaagagttgccgacctacctcaggttgaaacttntggcttccggggggaagctctgagctcacttagtgcactgaggtgataaaatatttttatccattcacttggccccttatcgag

SEQ ID NO: 554067 - DNA, 371 bp, Homo sapiens
agtgcacactctacactatcgagtacgccgtggagcgcgtacctcgcccgggagctgccacaaaagagcaagatcctgtccacggcaagaacagaaagtaggtatgcgtatcatagagtcgggccacgcctatggtgggctggatagctggagcacacggaggccgtgatgaaggtactaccataaacccctcggacaaacgccgccctgggctatgctacagatagctccccagagaccagcacctctatcaccaaggagcagctataaagagcggatgtgcatagccctgggaggacgggcctcggaagcactgtccttcaacgaggtcacttctggggcacaggacgacctgaggaaggtcacccgca

SEQ ID NO: 554068 - DNA, 259 bp, Homo sapiens
gcatgagtccaccgtgccttccacctcaggtaattctgtgcccttaagggctccattgggaatcactcatccttgggtagtattaaaattcatctgttccacagtgagcaggtctatatagacctatccccaaagtcttagggagctgagaggctgaagacagaggctggcaaatccagttggtcagaaagaaacatttaatagggactgaggaacagaagccatttatcgggcagctgcaagatgatgggttcctgca

SEQ ID NO: 554069 - DNA, 922 bp, Homo sapiens
  misc_feature (104)..(104): n is a, c, g, or t
  misc_feature (517)..(517): n is a, c, g, or t
  misc_feature (522)..(522): n is a, c, g, or t
  misc_feature (579)..(579): n is a, c, g, or t
  misc_feature (625)..(625): n is a, c, g, or t
  misc_feature (722)..(723): n is a, c, g, or t
  misc_feature (814)..(815): n is a, c, g, or t
  misc_feature (834)..(834): n is a, c, g, or t
  misc_feature (842)..(842): n is a, c, g, or t
  misc_feature (891)..(892): n is a, c, g, or t
  misc_feature (907)..(908): n is a, c, g, or t
gtgcacatgctgatgctgctcactattttgacacagaggtacaggtgcatccctgtttcattctaagcaaatgaccctgacagtaaatgatcaacaactggatntgcatcctggtcacactctcaatctattatgttgatgaaaacgcacctgaattctcgatgcagggtctaacagctggtgttatcgctgttattgtggttgtggtgatagcagatgttgctggaattgctgtctgcgttatttccagaaagaagagaatggcaaagtatgagaaggctgagataaaggagatgggtgagatgcatagggaactccatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcaggcttgaaactggctcttaccaattcttgacatttngaccnacaagtgttctctatataatgcacgattctaatggtaaaatcccagcaacttggacnatcccatcggttaaaatctcattctagtgtgtcaaccattcaaatncgtggtgccattacaaatatagccttcccacaggtaaaactcctgaaaaacctgcatcttggtgatctgaaacgcgtcgcccttttcatatttaccnnttgatgttctgtgtgacaatacactactctctctttactgcacgctaatagaaaaataaacaccattttttaacacctgaaaataaaaaannaacaaagggcgggggccgnctctatgnagtattcccctccgaggggccccccaacgctctacggcggtacccagcnnttttcttggtacaannagtggggtccccta

SEQ ID NO: 554070 - DNA, 270 bp, Homo sapiens
cttcacagatgagtcttccttgttcagtcaagataaatgttaagggccatgtatggtggcacacctgtattttcagtagagacagggtttcgccatgttggtcaggcgggtctcgaactcctgatctcaggtgatccgcctgcctcggccttccaaagtgctgggattacaggcgtgagccaccacgcccagccataaattttgtatttttagtagagacagggtttcgtcacgttggccgggctggtctcgaactcccgacctcaggtg

SEQ ID NO: 554071 - DNA, 242 bp, Homo sapiens
  misc_feature (55)..(55): n is a, c, g, or t
  misc_feature (143)..(143): n is a, c, g, or t
ctcttatcaattatacgggccgaactcgcccgaagcgcagaaatttattgggaanctcatgcctttttctggatagaactacttcgatgcagaaaagaattctatcagcttgtgtggtcagctcttcccttcatcacatactntggagaacaaaggacaccgttacccatgctttttcaacacattacagtgtgggaggtacaataagaactgtcacaagttcctaattcagtccaacagga

SEQ ID NO: 554072 - DNA, 288 bp, Homo sapiens
ttcgacggtgtctgggtgacactggggtctgcagtatctagctacgtggagagaaggatgggagggtaactcagttcggcttggtctcttgcgacagtgtgtgccctgatcaagtcctccctgcagggtggaacggtgccgttcgaataacatatataggacaaaagaggccgagaacgggttccctggggcctgagcagcgttagtgtcagatggggggtgtctagtgctagtggatgtgcagaatggccaggtggctaatgtaacgaggacgactgatggggctag

SEQ ID NO: 554073 - DNA, 979 bp, Homo sapiens
ggagaaacgcaggcaaggctggggtcctcagaatggtcgggcacaggttaggtggctgatagaggttgtggtggatgcgctgccagtattgtagatcaaggttatgaagccccatggatgtggggggaagcggctgcggcacgtggatgcggaggaggataatgtcgcatgataccgaccatacgtaagaacctacgctgagactatactgactaggcccccggaattatgtctgccttggtagagcactgatataatgagacaatgaattagaaatatgacatggtcgtgctcggatgaccaaatgaatggctcaggtatgaaaggatatggagcttccagtccccgtcagtctggttccagaacaaatgacagttacctgccatggtcgagagaactgtgtcaagcaaattggctaatggcgccgagtgtagagcatcgaagccggttaggcatattgagaaatcgtggaaactgttggcacagtccttggatgtactgcctggaaggtactacaaggagaattctgaggtgcataatgcattgagctcgcaacaggaaggaagcattcagaagtgaggaaaacagtgttccatgattgacgacctggggtgcagtatagagacattgcaactcgcagcgtggtatctaaattgcgagatagggacgtccaaaatgggtatccctgttccgtactgatgtcatgaagatgtgcggactatggtccgctacgaaaacgtgatttatcaatgacgcaagcacgtggagaggaaccaaccaagacatcggcagacattgagagacaattaccgggtgaggacaagtgtggcttccccacgtctacttatgcctgggggccggcatccccgccatgtggtttgtaatataaagggctcgcgggaatcacgtgtccaaagaaagtgccgggtctccacaaataccgtccagcgccacaggacataagagaaatgccccaaag

SEQ ID NO: 554074 - DNA, 218 bp, Homo sapiens
  misc_feature (141)..(141): n is a, c, g, or t
cagaagcgagatgacgagggaacgtcatcgtttggaagcgtcggaataaggcggacacgttgtgccgccgctgtggctctaagggctaccaccttcagaagtcgacctgtggcaatgtggctaccctgccaagcgcaagangaagtataactcggagtcgccaaggctaaaaagacgaaataccaccggaacttggtcgattgaggcacctaaaaatt

SEQ ID NO: 554075 - DNA, 854 bp, Homo sapiens
agtataggtagaaatagaatctagggatctgattctcatattagaggataatatctccccaaaggggaaagaataaagattatttcttggggtagataacattgataaatcattgttgagaatgatataatatgaatttccttgaaaatcttggcatgtctgagagtcttgtaggctgaggtttttaggtattttttgccgcaaaaaatatataaagttaggggagctagctttaaaagttaaacaacaaaaatattaatattaattgtgcaaaatgacctgagttcatttgcgatttttgatagtataatcgaattgtacgacttgagtactctgaaacataagaaggccaccacactgcacttcatagagttcacacacatgcattctacatattgatatgaccagaacttagtttcacatttacgataaagtataaaataagaatgtcgtagtcaaatttttcagtaagcccaagctattgaagatagtcagtgtatacagtgggatgattaagttcatatgacaggatagagtctcagagtcaagtattataatattcaccccaggtgaaggtcgcttgtgactggctaagatgtgagctggaaatgtatatggctcagtgttggtatgtttccctacgtgtatgtttgccatcacaggacttctgtctcacaattctgtaccttgtaagagctcaggtaggtttatgtacggcctaaggcaagtaggcgaagagaaacctgtgagggttcacgatacaggtgctccaggtctctgtgttcaagtgggcccaggcggttttgtcaccttgagggttgaaacactgcgagggaagtttccacaataccgga

SEQ ID NO: 554076 - DNA, 381 bp, Homo sapiens
agttggatattgcgtatcaaagaagataataaacatgtgactgacgtattggtaatatttgtggagtttgaaaggtgtgaacaattagcttagtattctgcatcagtaagattctatgaaactgaaattactgttttaattttttatttttaaagtatgatttcagaactatgggatttataataattaaaatattgactatgaagaaatcatttttcagctttatttatgggatggggatgcaaaagcttattaaataagtctgcatggccaaaaaatacaagcaatagaatctgccattaagcaatagaatctgccattccttagtttaatgttggaagttaatttgtctgtgcttttttttttgaccacatcttcgtc

SEQ ID NO: 554077 - DNA, 326 bp, Homo sapiens
ctctgatgcagtgcaaaggaggtagtgaggcgaattcttgggctgagggatgcttactatgaagacgaggacttttcggggggggcgaacgagtgacatgggatgacatcacagtggtcggcaccctgttgtggctctataagcaggttctagagctagcactatttctcacttagtcctggttggacacaggttccctggaacagtgctgtcgtggttatcttctcgacgtgtctttgtttctgaacttgaaacgcttttgagttttttatggtttttgttcttcctcattagttagagtcccttgcagatagttgtaaatggcg

SEQ ID NO: 554078 - DNA, 123 bp, Homo sapiens
tcgatctagaggatccttgggagccttaaccctacctggagggtcttttaccatttgaggcaatgagatatgtatgtagaggcttatgacttgtctttttttttttcatttggagacagagtc

SEQ ID NO: 554079 - DNA, 708 bp, Homo sapiens
  misc_feature (19)..(19): n is a, c, g, or t
  misc_feature (396)..(396): n is a, c, g, or t
gctaggtacgaggctgggngttaatcggccgagggaagatctggcatgtctgggggctcacattctcacctagcaacaactggctggagctgggcaccagctctgcctttagaaggggtgtccacttcaccaggtcaccacagcccacactacgccctatcacttcccacaatgaggctaagtgtttgtttttaacttggatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgtggcctaggctggagtgcaggggcgcaantctcggctcacgtcaacctcggcctccggggcctcaagcaatttctccacacctatcaaagaccctttacccccaaaatataaggcgtggagatcacgggcacaaaccaccagtgcccagcataatttggtatttttggtagagacagggtttcaccagtgttgcccaggcgggtctcaacctccggggctcaagcaatcctccggccctcggcctcccaaagtgcggggattacagatgtgagccacgcatccagacccaaccctcatttataccaattacctgtgcccagtaactggtggactttggctc

SEQ ID NO: 554080 - DNA, 229 bp, Homo sapiens
ctactaaagtttacctcaaaatcattgatagtcaaaaagagtatacagcaaatgcaaactatacctatgtaggtacatgacactggtctcactcaaaaataactgaaacagaactcaaagaattctcttatgggaaaattctacatctaaggccgggcacgatggcccacacctgtaatcccagcactttgggaggcttaggcggcataatggcatgaacctgggagtt

SEQ ID NO: 554081 - DNA, 252 bp, Homo sapiens
cgtgccggacacttcagctgcccggctgcgttttggagacccacagcccatctgggcacggaccgtcttaccttggcttccttcggctgaacagagctcactgcatgccacgtggagcggcggcacgactgcacttgtatgctggattgggtctctggtatcacaactctggaagctcagcaggcatgctggtaccacccctatcgaccattgggcacctctgctcgtccgacgcggaccgggtaccgatcc

SEQ ID NO: 554082 - DNA, 422 bp, Homo sapiens
gggactgaaaacccatggaaagggcgtgcaatacaggtaggaacagtcttagcaggagccaaaataaatgtggacatacctgttgcagagatcaaagagttaaagacttgaatagcacacatatatgaaaaagaacagttgagcaagaagatatctagtggggatacattcaagtgcagagagtgaaaagtgatgtggagaccagtgatttccagtcatggaaagctactaatctctcttatgaagtgcaatataagagcagagaacgaggccagaaatttggagatacagagtaacagaacagaagtctaacaatatgaaatatatcagtctatatctcgcgtctctctctctctactctctatctctctcgctctctctctctctctctctctctctctctctctctctctctctctctc

SEQ ID NO: 554083 - DNA, 146 bp, Homo sapiens
cacgagggggatagggagcttgattcatcgcctctcacccctccccacatttccacgtgctatgccctcagctcaagaatcgtagagtagttgtctcaatctctggtactctcctgcatcaattatgactgtgtaactatgatatg

SEQ ID NO: 554084 - DNA, 425 bp, Homo sapiens
tctgtcccaaagtggtacaaccggtaggaccagagcttgaggactggggttcactaagtgggtggaaccggagggttttacgaccctaatgtccgaaactcggtgacacgggttggtgttcgtgcattctaagacttcctcctaggttgtaaatgtacttaaaaattcggtcttaacccgaaggttctctaaaacaggaaggactccgaaccaggaccgatgaaggggtcgagtgtctctcaccacacacggagacggaggtggtaatcctcgtcccaaacccttcgtgggtaccatcgttctcgtctcacgaccccggttttcggaaccagactttgggtcacggctgtaggggtcgactcaccggaacccattcagtgcgttgttgtggaaacaagtgtctttacctgtaggagcaagaatga

SEQ ID NO: 554085 - DNA, 594 bp, Homo sapiens
tgccaggcatggttgaagttgctggtaataaagcagtttttaaaaggcccttattctctggaagttaacattctaggggggtaaggggaatcaaaggatgttggtaggagaagtgagagaggaaggctattttttaatagcttggcctacgaaggcctctttaattttgggacattggagcaaagacctgagggtattaccatcattggctccaaactgaccaaactgtcctaattactaataggtttcaggagatgtgttacagggctaatctagctattcgacagcatgccaatctcttcataaatcttttcccaaggatgctgggttctggaatgccagacctacaatctttggatgacattgcatacattcgaaggaccttagccttagatctgagcaggaggctttgaagtatttcatgaaccaaatgattgatgcacatcatgggggctggccaccaacttgagaaattgaaggctaactctggattccacactgaactgttaatactctcagcaggcaaagaccgatggctaggaattgcacatccatgacagctttagatttacagcaggaccagttactatattt

SEQ ID NO: 554086 - DNA, 361 bp, Homo sapiens
tgcagttgattgccggagttccgttcgaagtcagcgaagctgtctgatcgtagagtacggtgcctgtgccgcgattgctgtgagcgatgccgtggttggcgagcgagatgcggcctcccgccgagtggcgcatctgcgaatagttgcttgcggttttttccgattgtgggtgtcggtgaatctgtgcgatttttgctttagagccgccggtctgtggtccatagtgagtcttggccgcattggcgttgttggcgttcgagtctgaggcagcgagtgccatcagaactgcggcggagagtaaagagagcttgctgtagatcctgctttcgatcatgtgatccccatggaaggcggggtaccg

SEQ ID NO: 554087 - DNA, 564 bp, Homo sapiens
  misc_feature (70)..(70): n is a, c, g, or t
  misc_feature (119)..(119): n is a, c, g, or t
  misc_feature (172)..(172): n is a, c, g, or t
  misc_feature (178)..(178): n is a, c, g, or t
  misc_feature (181)..(181): n is a, c, g, or t
  misc_feature (190)..(190): n is a, c, g, or t
  misc_feature (203)..(203): n is a, c, g, or t
  misc_feature (209)..(209): n is a, c, g, or t
  misc_feature (226)..(226): n is a, c, g, or t
  misc_feature (228)..(228): n is a, c, g, or t
  misc_feature (230)..(230): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (250)..(250): n is a, c, g, or t
  misc_feature (253)..(253): n is a, c, g, or t
  misc_feature (258)..(258): n is a, c, g, or t
  misc_feature (265)..(265): n is a, c, g, or t
  misc_feature (269)..(269): n is a, c, g, or t
  misc_feature (283)..(283): n is a, c, g, or t
  misc_feature (302)..(302): n is a, c, g, or t
  misc_feature (313)..(313): n is a, c, g, or t
  misc_feature (317)..(317): n is a, c, g, or t
  misc_feature (329)..(330): n is a, c, g, or t
  misc_feature (338)..(338): n is a, c, g, or t
  misc_feature (340)..(340): n is a, c, g, or t
  misc_feature (344)..(344): n is a, c, g, or t
  misc_feature (358)..(358): n is a, c, g, or t
  misc_feature (360)..(361): n is a, c, g, or t
  misc_feature (370)..(370): n is a, c, g, or t
  misc_feature (374)..(374): n is a, c, g, or t
  misc_feature (421)..(421): n is a, c, g, or t
  misc_feature (446)..(446): n is a, c, g, or t
  misc_feature (453)..(453): n is a, c, g, or t
  misc_feature (462)..(462): n is a, c, g, or t
  misc_feature (472)..(472): n is a, c, g, or t
  misc_feature (484)..(484): n is a, c, g, or t
  misc_feature (490)..(490): n is a, c, g, or t
  misc_feature (500)..(500): n is a, c, g, or t
  misc_feature (563)..(563): n is a, c, g, or t
cgccgccgccgctgccgccgtgctctcgctttgcccgccgccgcctaaggggggctggggccggggccanccatcactgccgttgccgggatgccgcgggtgtacatcggccgcctganctaccaggcccgggagcgcgatgtggagcgcttctttaagggctactgggaanatcctngangtggatctnaagaacggatatngttttntggagtttgattatctncntnatgtcanatnatnctntttnttntctgnatgtgcnaatnccttttttgttatntatttattttttatcattnccgcggcccantgcnatattgcatttnntgttcttntnctcntttttttttttatntnntattttttntttntttatatttccctccttttctcacattttttttttttttttttgtantttttcaattcgtttcatctttttntacctanttttttatnttctttttgnttttttattttntttttnattttctctnaagggacgcaaaaatgaaggggtgattgaatttgtatcttattctgatatgaaaagagctttng

SEQ ID NO: 554088 - DNA, 323 bp, Homo sapiens
  misc_feature (285)..(285): n is a, c, g, or t
  misc_feature (300)..(300): n is a, c, g, or t
  misc_feature (314)..(314): n is a, c, g, or t
gtctagttaaaaataattcaacttatcgtggaaatgctataaattgctgtgaagtgagttgctggctatggcttgtcagagcaaatatattgtacaaatcttaggggagaattagtgcttatgcattcaaatcaaatcatcttgcagcacactgagaaaaaggttagatttttaagataatttcaaagtcatgaaaagagcaaatatgctccacaaagagcctagcaaccctcaatgacccaattccccttttatatagtttggtatctgaattagaatcccagnatctacaaatcctcngggttgtgggtgcngcattttta

SEQ ID NO: 554089 - DNA, 80 bp, Homo sapiens
tcaagcttctaacgatgtacggggacatgttataaaagaggtttagtcaaaaagaccaaagcccatgactctaagaaaaa

SEQ ID NO: 554090 - DNA, 1589 bp, Homo sapiens
  misc_feature (1)..(2): n is a, c, g, or t
  misc_feature (4)..(4): n is a, c, g, or t
  misc_feature (1116)..(1116): n is a, c, g, or t
nnantatgcggcatgctggtgtgtgatagctttcgctgtgctttgtggtcagttcttctgttcgtgcggtgcacgtgctcgtgctcggtagcgtctggtcttgtcgtcttcgttggatgttgtaggttcagcagtcgtgttgagaacgcgggtgggtcattttctcggcgccccggtggtgaagacgcgtggttgcctcgcgccgtttttttcgttatattgtctggccttttggtggtttcgccacgggtgttgttgcccgctttgttctgtcccgccgatgtgtgtaggtggcgcggcgtcatcattgtgtctctctagggtggtgtttcgccgggttggtgtttcgctactctggttgtgcaccaccaggggctctgtccaccgggccaccatgtgtttctgggggaactgtgggtcttgttcttagtgtctgttgtgtcctccctcggttgttgtttctcactcccttttgataccctttttgtgggcccactcctggggcccacatgttcctgcatgtgcctctcctctcgtttgtgtgtgccataggcacgtgagtgtgtcggccccgtctttcttctgtcggtaattattttgtgtggggagagggaccgtgcgtgagtgttgatgcacacggggggtttgttgttttggtttgtagtgattatgttggtgtgtccattgttggtcgttttgttttctgttccccacgcggtagtggggtgttaatacccccctcgtgcgctttttttggtgggtgtttcgcccgtctcaggctctcttgtgtgtttttgcgccccactgttgtcgccccctttgttcgcacgttttttcgccccccggcgttttttttgccgctcgtgcgtcaggttttcctctctctgtttgttttcgcgcgggtgttttcgcgcccgcttgagtagtatctactcctctctctgtgtgagctacttgtttttctctcttgttcttctctctccgtgtgatctctcccccgctctcccgcggtgttttgtgtgtgctgtgtgagccgctctgtgtgtgcccccgcccctgctctcttgtgtgtgagattctccagcagagcgtgtgtgtttgtgtgaccgtggggtntttttgaggagggcgagagagggccgacatagatctgtgttgtagagacacacacaggttgtggggacacactcgtgagagagggtgagagggcgcgcacacacacagagaagcgcgctctcacacgtgtgtgccccacgctctctcttggtgcgctctcacagcagagagtctctctttgcctccacacacccctcttctctcacctgccgcgggccccccgtgggcatgtattcccctctctgtgatcctctcttcgccctcttccccagcaccctctcatgggccccgtgcggagaggtgtccccgaggaggagagaggggcccctttcacccctcggtgaattctctcgcgggtgtttttccctcttcccttttttttggttttttttttgtgaaattaaaaaaagactttttcctcccccgaaataataatattttttccccaaaaaatggggccctcgccccccgga

SEQ ID NO: 554091 - DNA, 752 bp, Homo sapiens
ttcatggaactcagccctgtggcaagtgcttagggcccttaagggaagaaaatcgtccccagaaggcatccatcatgttcgctgtaatggtcgttcgtgcagcttcctttccctaggagctttccctgtgttgctaagagctgaaaatggcatcttcgtgatcaccgacagtgagcttggctcgcctcggccggcccgggagtgcgactcgttacgaacagtgtgtgactcttgaacctggagttcatcagattacgtcagcagcttcccatctggttgctttcctgagtcagctacgtgtcacacttgtcaaggctgttttaccccaaagagtcagacaggacgtttctgatgcatggttgttccctcctccccccaattcccccccccgattgaccttatggtcccaggacacacttgagaaggtgagctttgtattcctagtggtgtacatttaattttacaaaggtggcaggtatcatgctgtgtgccggaacggcggatgggctactgtggcaggccttcttttcttccaatggtacttagacgtgttcgtatgccgggtacacctataatggtctgccgatgggttcttaggaataactttgatagttcatttacacaatgtctcaaaccatggggaggcaggagaagacgcgcgctgggccgggggcccattggcccacaacgggcaccaatgtggggcacagtcgggccagggtaaacccggggccacagggggaaatataagc

SEQ ID NO: 554092 - DNA, 1238 bp, Homo sapiens
gtgtctccgtcgcaggctccggcgggggcgcgaggaggtcgcccggcgcgtccactgtcgggtcggcgagccacgggggccgctgcagcaccatggacgaccaccgtcagacactcagcgcgggccggtgtacatcggtgagctcccgacaggacttcctccgcatcacgcccagacatgcagcagcggcaaggtccagctgtgacgcccagtgccgggcccagcagcctgcagtacggaggcgcagtgcggccaccgtggggacccgactggacacattcacggtggtaaccacaggcacaagtttgagccaaagaattaccggcatggacccgacattgggaacacccttactggccgtcgactggcgccttgtgcgcctaccggcaggttggtcacgaagaacctaccccgactgggtgaccaaccaaaagtggtcggaccaaagtaaattccccccggctgtgacacatacaacgggttacaagtccaaccgtggccaccaggtggcacccacaccatgtgcgtgtgtgacacaatcatttttgccttaagtgtctccggaactgaacttcgttatccggaaattgcacggccacgacagaccccgtttcatggtcccacttgtggacacggaacacctgggacaatatgtggcccagtggagcaccctccacgacagtacagccccaaattcacgcacgtgacaagtagatagcccccattggaacggggacaacagacggcaccaaacaaggggatatggagggaccacgaggcgaccacacaacagggagtgggagataacaccaagggacacccctggcggaaccccagagcgcaacaaggaggcccacaggagcagcggcgcgaaccacaggacaccaaaacagcgggcagcaatgcgcgggcgccgccagattgggaacgtacaaaagaggcaccaacatcgaggcaaaaccaacaatgagggattacacactggatacaaccagggcgacggtgacagcacaggagcgccaagtcaccaccagaagagggacaagcaggcgagccgccaaaatgggggcgaccagggaacaagaaagggacccacaaagcgccacaccagagaaaggcggacacccgggatcatggggagagaaccgcgcagtgggagaaatcatagagcccccacaaagcaaagcgaaaagggaactaggagacaacaccaacaacacaagagcaacacacagggg

SEQ ID NO: 554093 - DNA, 280 bp, Homo sapiens
aggtctctggctttaacgcagagcttatattcagcttattagttttaaaagtgtgtaaaataatgcacgtatttggccgggcgcggtggctcacgcctgtaatcccaacactttgggaggccaaggcgggcggatcacgaggtcaggagatcgagaccatcctgactaacacggtgaaaccccgtctctactaaaaattcaaaaattagctgagcacggttgcaggcagctgtaatcccagctactcgggaggctgaggcaggagaacgcgtcaaaatcg

SEQ ID NO: 554094 - DNA, 101 bp, Homo sapiens
agtcacacttgctgaggtgactgatttatatgggcaagagaagtacactctggcctctcagaattcacttgaggttcacattaaatacatgtcacacctgc

SEQ ID NO: 554095 - DNA, 433 bp, Homo sapiens
  misc_feature (40)..(40): n is a, c, g, or t
agggtttctccccggggttttccattcttccccccccttncgggcaagggggtgtttttttggcccccaaaaccacggggcttttcaaaattttgttaccccccccccccctttcccacaatggggggggggggtgtccggtggggggttttttttacccaggcttttttttttacccccccattcccccgggacccccccccccctttttttttccccctttaaaacccccggggcccttcccccccccgggttttttctttggcccggggggggtttccttttttcccccgggaaccctttttcccctttggccttttttggggccccctttaaccccgttttttccaaaaaacccgggggggcccggcccggattttcccggttttttttccccccccggcccccgggggggggggggggggggggggga

SEQ ID NO: 554096 - DNA, 403 bp, Homo sapiens
  misc_feature (105)..(105): n is a, c, g, or t
tcgttttggggtctttgctttggtccgatcagaagggatcacagaggaaagctgtgtttggtggctcacgcatgtgaatcgtcagcacgtgtgggaggccaaggngggcagatcacgaggtcaggagatcgagaccatcctggctaacacggtgaaacgcctgctctacttaaaaagcaaaaaattggccgggcatggtggcacgcacctgtagtcacagttacttgggaggctgaggcaggagaatcacccgaaccagagaggcggaggttgcagtgagccaaaatcgcgccattgcactccaggctggatgacagagcgagacttcgtctcaaaaaaaagaaaacaaaactagatgtttttaatcagcagggtctcataaggcatgcgaaattgcttaagg

SEQ ID NO: 554097 - DNA, 195 bp, Homo sapiens
ctgtctcagcactccccgtttatactggggtggcacacaggcggctgaagactcctgtgggtttactccctgtcgtggtgtctgccttggtcctcggcgccgaggcgtgcaaacacagacgtcctatggagatcttattgcagcctgctgctgctccatggatcttgcggagtgcggggtgtggttgcctttggg

SEQ ID NO: 554098 - DNA, 236 bp, Homo sapiens
gaaaaaaaaaaaaaagcccgaaaaaaaaaaaaaaaacccctgttttggggaaagggtcgggtcccgtttagccttttggtcttaaggaaaaaaaaaacccccaaagggtttccccttttttttaaaaaggaagaatgggggaaactattttttccccctaaaaattatgggaccccctgatttttgttttttgtcaaggcaaagccttttttttaaaaagttatgccttccgttta

SEQ ID NO: 554099 - DNA, 130 bp, Homo sapiens
tcaaaattttccgggaaaaccctccccccctgggtggggttaaccccccaaaaaaatgcccatttggcccttttttaaagaaatttggagttgtgtttaatctactctgcttttcttcctttttaaaaaa

SEQ ID NO: 554100 - DNA, 418 bp, Homo sapiens
cccaaagggccaaaagagccccccccgcgggtaccccccaaaagtcctttccccccctaaacaagggttagttcataaagggcccccaggttctgtttgggtctttgggtcccagggtctgtttcaacaccccgggggaacccaaatgctcccccctgaaaaaaggccccggtagttaaaacctgaggtttcaggcaaacagccaccaaggaccaccaccctcttgttaacagttggccaaatgaccttgtaaagtagaccctctagccccagtaaagcgttcgggtaactccaggcctggccaacatgtaaacggcattttcataaaacccctaagttggcccccccagttaaacggcttttaaaatcctgacttgcaaataagccaaaaaatgttgttttaatttgttccataccc

SEQ ID NO: 554101 - DNA, 251 bp, Homo sapiens
gcagctcctgcagctaaaataacagcgtgaagttgctcaatttgagaatccatttcctgtgcttacaacagatgcagggcttgttcaatgtatcataggccgtggaaatatcggaaagaactgaccaggtcaaagcaacaccaaactgatgtcattgagtggagtttgcctttttaagagacataaaaatataaacaccagattccttaatttatagaaatctaaacctaaatatgattccatatatctga

SEQ ID NO: 554102 - DNA, 143 bp, Homo sapiens
tacataacacatgctggatctcaggcagatatttctgggctttaattacttgtactatctagcctaagtggtgtgggcaagaccggtcctcagttaacccacctgcaaaactgggaagatcaggcaacgtatctcactacgaa

SEQ ID NO: 554103 - DNA, 918 bp, Homo sapiens
gatatgtagcgaggaggaacgcgctagggcatagcacctggctaggcagctggaagagaaagaccgagtgcttaaagaagtcaggatgcattctacaaagatacagactggttagactggaggagaggagctcagagttctacagagtcacacactgaacaatatctagaaagctgctgaggaggtgtgatagctatagttcatgcgatatgagtctcatccagtctgtgctgatctgcaggccaaaattcttcatgatgttaccgtgagaacacccaccagtaccctcaaatgctccggctctggcctacccaggtatatgcacgtgtgtcgaatcgatgcccaaacagagcatgcttgagaagggaggatcaataactttgcaggaatgagcaaaagaccatcaagggttaattccagagatggaagccattttttatatcctagtgagaaaacaaggcagtttgaagagaagaccactaatgagaagatcgactaaagagagaccatcaagaatggattcagcagaattcatttcacgtttttgaacatgagcagttttgaagggccaaagtgctgatcagggatcagtcgttaaaggacactcgttgaagtattagtaaaccctcttatgatgattaacagagaagggcagtcctcttcaaccttttggtactttctatttcaaagttggaatgatcattaaaatgtttctcttctgaacgagtcccatcatttggtgaacctccatcctaacaaaagtagaggggttgggggataaatatggagtgggggagagaaaggggaaaacttgattcgaggagggcggggtgggaaagccgaaaacgatctggggcggatggtggaagaatggtaggggggaaatggagaggggaccttgaaatgtagagaataaaa

SEQ ID NO: 554104 - DNA, 356 bp, Homo sapiens
  misc_feature (210)..(210): n is a, c, g, or t
ttcgatctaaggatcccttggggctcattcaggcagggggttgaagcgtccttggtagtcggcgtgggtgggagagttgactaccaccttctggtgagggatcacgggcagaggggtctggactgggaggtgctgtcgtggagatgggaaggggacgctttgatttctgcagggtgaggctcaagttgtagctggcagacttgatctggntctgggcttccaggtgggtcatggggtctgtgtggacgccgtcaatggccaccacgaggtcacccgggctgagctgggactgggctgccttgctgccgggtgtgatccgggagatagtgaggggcatgttgaagtccttgccccct

SEQ ID NO: 554105 - DNA, 154 bp, Homo sapiens
ggaggggatgacgtaggtatgtcaaaaggtgagtaaaagaaagcccaggaaagggaaacaagacggaaccattgtacaagagcacttcccagaactgagaaccctgcataacaatccaggataaaaaagacgaaattaaatatggactctaaga

SEQ ID NO: 554106 - DNA, 1855 bp, Homo sapiens
gagtaatagagggaaataaatgaaaatagctttcagtctcaattcctcaatagatacacacttcgtcgacaacagacacacactgcttgtaaacacgtgacactgctcaagttgcccgtagcatatatagatgaagacatacacatcattcgcagaacaccactctaagagctagaccaccacgcatcgggatacagcacatatagcacaacgagcgacacccagtcagaaggcgccactccaacctcaccacgccgcgaacagctgacaatcaaacacacaacaaccacaatgacaacacgctacccacaacgaacagcctcacacccgacacgcacagaccagatgacacgaacgacaaacgaacacacgacagcgaacccacccacacgaccaggacacacacaatccacacagcaccacacaccagagagaacaaccgacaagagacacacaaaacagcaagagagcaaaagaagaacacaaacgcaccagactaaaaaaagcaacaacaagcaacgcaggcaacacaaacaacacaagacacgaaccacaccaggcgacacacgacacacacaacacaaaacaacacaaggcgacgcaaacaacaacaacccaaacaaaaagaagcagagaaccacaaggacaaagcgacacgaagaaaccaccaaagaccagaacaccacgaccacgacgaacccacagcaacgagccgcagagaagaccacaacacaagcccacaacaagaagcagacgaagcaagcagacgacacacaccagacacgcggacagcaaacaacgaaaaccgaaaacgaggcataagcacagcgctaaacaacgacgggcaaccgatcaacgaacgacgagcccacacacaacaaccgcgaataaagaggacagaaggcaaacaaaaccgccccacacccaccaccgcagtgcgaaaaaccacactcacaccagccagacacaacacagccccggaacaccgacacacacacaacacacacaaacaaccaaagaaaccgaaccaacacagaagccaacaacacgacacaagcacgcacgcgcgtacaaccacacgggacacaacaacgccggcacacgacgtaaacatacacacataccatatccaaccctctcacacacgactaacccatcaacaacaccccaccctctccaccacaacatactcaacaaaaccaccacaacaacatacgtcctcgacctacccatactaactatcaccctacaaacccacaacaacccacacgcccaccacacaaagataacccccactcaaaccttacaacaacacacacaacacacaaccaacacataatcaaaccacatcaaataacaataagaatcaccaccaaccacacaccaaacacaccaccaccaggcagcatgcggagggagctaagctagcggcacgagcaaactaactaactcagccacagagaagcaagagagccagaaggagtgtgaagaaagtctagagacgatgacgtcacgcacaagaccaacgactcaagtatccaccgacaacagcagacatataagctaagccaagaacgaggctcaggcacaccacgaacaggagtcaaagcacaacacacgaccaccacacagccacaacacagcagatcaccacccaaagcgcacgcactgacgaactagcaagcacgccagcaacaccgacagcgcagccaccgcctaggagacgcgaagccaggcacataggacgcgatagcagacacagtacgtcgaaagcaagcataccaacgacacacacacaccgacgcactcaggtaacacacaagggggacaagaacacagaaagaccaagaagaca

SEQ ID NO: 554107 - DNA, 689 bp, Homo sapiens
gatttcttgagcaatacaggtgctaggagaatctttgatcctggtcctgactcagagctcctaaatcccttggaatttcttgggtgataggagagtctcttttgttccttggtgggaccctggatagcctcaggatggggggctggttgccagggggaaccaaccatgtgatcagagggttgctgtcagccccaacccccatgccgcctccagggagggagagagcctgaaaatagagcgaataaaccaatggtcgatgatttaatcaatcgcaactgtgtaatggtgcttccacaaaaacctaaaacaggccaggtatgatggctcacgcctgtaatcccagcattttgggaggcccaggtgggtggatcgcttgagcctaagagtttgagactagcttgggcaacatggtaaaaccctgtcactacacaaaatacaaaaaaaaaaaaaaaagaaaaaaaaagagaaacaaaaaaagaaaaaaaaaaaaaaaaaaaagccgggggggccttaataggggggggcgacaaaaagaagggtgaacaaaaggggaagcacaggagacataagagggagccgaacacaacaatctggagagacacgagggaaaaacacgggagacaaccacaaaaagagagggcacaaaaggcgaaacagagcgagacacgcgaaaaaaaggaacgaaaagg

SEQ ID NO: 554108 - DNA, 139 bp, Homo sapiens
cagctgcccatgacggcactctgtccagaccttccttcctgggcatggagtcctgtggcatccacgaaactaccttcaactccatcatgaacgtgtgcacgtggacatccgtgatagacctcgtacgccaaccacacgt

SEQ ID NO: 554109 - DNA, 1612 bp, Homo sapiens
  misc_feature (655)..(656): n is a, c, g, or t
  misc_feature (660)..(661): n is a, c, g, or t
  misc_feature (677)..(677): n is a, c, g, or t
  misc_feature (682)..(682): n is a, c, g, or t
  misc_feature (688)..(688): n is a, c, g, or t
  misc_feature (705)..(705): n is a, c, g, or t
  misc_feature (708)..(709): n is a, c, g, or t
  misc_feature (728)..(728): n is a, c, g, or t
  misc_feature (735)..(735): n is a, c, g, or t
  misc_feature (763)..(763): n is a, c, g, or t
  misc_feature (768)..(768): n is a, c, g, or t
  misc_feature (1044)..(1044): n is a, c, g, or t
  misc_feature (1092)..(1092): n is a, c, g, or t
  misc_feature (1096)..(1096): n is a, c, g, or t
  misc_feature (1131)..(1131): n is a, c, g, or t
  misc_feature (1152)..(1152): n is a, c, g, or t
ggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggacgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactnngccnncggggtgttgggtggnttctnggtggntcctggagcctctctgngcnntgcactgtccatctgtacnccctaangtgcattccctagaggggaacaaccaantgccntggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgntcattcaaatacatctgtgtaaatgcaaaaagtcataaaattcacctncganctgcttgcttttgaacctgcagcaactagtcttanccggcccggtttgaacatcgntctttagaagtgctgaaaatctgcaaagttggataagtggaaatgtggctgcccctctcctcactacttcctctctgatcgttctgaagcttgcattgggaatggctgctttctctaccattttcagcttgagtgggtattgctgaagaaatccaacatcattccagcagttgaaaaaggaagccttcgggagaaagtgcttgtcaaaattttgttctttgtgctagagtatgagtaagttgccatgaataagttattattttaacccataattggcgactgtttatatgaattctttcttttgcaccaaataggtttcatcttcttaggcacaatttagtatcacatagatggatattttacattcagttatgcttatcaaatacatgaattaaagcttgatcacccttactttccagtgtgttaataagagatcaatttcaagtgtgtttcgtgctgg

SEQ ID NO: 554110 - DNA, 175 bp, Homo sapiens
acggctagcttgttcttgtgtgaaattgtatccagcaatggatacctaatggacctgccatgaggaacagtgcataccagcccagatacaatgcttttcccacagtcttcacaacccgcagaccaggagattccctcgggtgcctacaccaccagggtacaagcacaaaactggg

SEQ ID NO: 554111 - DNA, 521 bp, Homo sapiens
ggatttcttaacactcatctacatgggtgaatgtggaaaaattaatattaagtgtggatgtcagtcagggtttaccatcttcaatccaaggggacggaaataagggaaatttcatagaacattttaagaagttggtgacaatacactccggatgtgactacggatcatggatgaacttactagtctggggtgtacacctctattttctggccttcctggaatacccggtgagctctctacctaatctggtacactttactggcatagttggtacatttcacagcccatcgtgactaaaggtgcggaatcagcacattaagtccaacaaacaaggtccaaccagtaactactactattcaaggcccatattcataacaaaggccccggcaccactaggatcctcccggaatcaacccggacccctctccttcataaattattcagcttcctacactattaaggttaccacaacaaccaccccatcatactctttcacccacagcaccaatcctacctccatc

SEQ ID NO: 554112 - DNA, 132 bp, Homo sapiens
agcagtactgcgtgtcgttatgcaactcacgcaggcgaagacagtactatctgcggctcacacgttgcttccacactatctgactcggacgtccttccggtgtcactgaggtggtcgtgaagctctttgact

SEQ ID NO: 554113 - DNA, 131 bp, Homo sapiens
acaggaggacaggatgggaggcatgggagggtttgcgcaggctctgatgttgactgaatctaagtataacaaggcatcagtggctcttggtggacaactggctgtagagggacagaacggagtgggaggtg

SEQ ID NO: 554114 - DNA, 123 bp, Homo sapiens
tgaggctgaagatatgtgcaggcatgggtgacgatgacgagcatgaacagggaggtgagcatgccccatccagatgccgggggagaagaagctggcacagtcgcatggctgtaggagaactgc

SEQ ID NO: 554115 - DNA, 120 bp, Homo sapiens
gcgccccgcgttgccgggagcctgctctctggcttctcactatcagccagtttgaaaggcagtgggcaaaacgtactgttgtaggtcagcccagaccagaaactgaaaagagatcatggg

SEQ ID NO: 554116 - DNA, 132 bp, Homo sapiens
aaataagctgagtagggtggtggggccctgaagtaaggaggttaaggtgggaggatcacttgagcttgggaggtcgaagttgcagtgttcccccccgggcatttcagcctggatgacaaagcccctgtttca

SEQ ID NO: 554117 - DNA, 924 bp, Homo sapiens
gtcccccagtctgaggaatttagatgctccattgaccctgtgggatgcccaggattgaaggatgtcctcctgacagcattttgcctaccgacataggtctccaggaggctgatcacagggaaccacagacaaggcactaagcatgccttcatgaacgcggcctcaggcctgtgtccacggcctgtgtttgcgtccaaggtgtacacagcactgggagtcctgtcaccgtaagatgggcaaatccacagagacgcacgtgttgtactatgcgttgcacgccctgaaaggagggatcagcctgtggggtcctccaccttctggaggcctctaggctctatcaggctaacgtggggggacacaacagcagatgttggagagtcgtggagctgcttagttgagggccgttgattgtcccattgcagttccgaaaggcccctgcaagtctgctcagttcgaggtagcaattacctacgtgtgcaatcgagcctgaaccttatgccgtcatccccattcagttgtggctactcagatgccagaccaagcatatacatagcaagcaggtgcctacatgacgggagagggcaggagacgctgcgagagcattaatcgttggaccatgctgggccctgttgctggatagctcggaggcaaagcttcgtccgccaacgcccagtctccctccaagtgcccctgtatgcctgaggtgttccggacggcaagcggtagcactgatccaggcaggcagagcccaagatgccttgactctatgtgaggaagttgctcagccgcacattcatctctggtaccaaggatgtcgcgagtgtgggaagatgccagataaggaaccaaggaactgccatactgccactcttgggtctctggcaaccaactgcttcaggccaggcctgggtcaacttgggtgac

SEQ ID NO: 554118 - DNA, 150 bp, Homo sapiens
  misc_feature (92)..(92): n is a, c, g, or t
gcggatcttgcgcggatctcgcggcggacgtcggacgtgcagtggagttgatgggcgtcacttcaacggtagcagttctagcgagtcagganacagaaactccgtgagcaaagggaaagtcgctgatttgatttcagtacgatacagacg

SEQ ID NO: 554119 - DNA, 108 bp, Homo sapiens
gcaggcctagcagttgtgtaaggccgcggccatagtgcaggatatctagcttgtgtccatgacatcccttaagataaaccacgatcacgaactagaatacgctaccta

SEQ ID NO: 554120 - DNA, 584 bp, Homo sapiens
ttgccaaagccaggactggctgtgggtgaagagttgatcctgcctgctgctaaggacatttgtcatgcgcttttaggagaggctgtggttcaaaaggtggcacatgttgctctttcggccagcaccgtaactaggcagattgatgaaacagcagcagatattgaggcacaattgttagagaggattaacgagtcactctggtactcaatccaggttgacgagtctaccgatgttgacaacaagacaacaatgcttgttcttctgtgacatatttttcagggggatgttcatgaggatatgttatgtgtgctttagttgccaaccaacaccacggctgctatactagtctttgaattattacatatcagggaaactgaactgtatggtaacgtggtgttatctgcatggatggagcggctgccgtgactggacagctttctggtttcactactcaggtcaaagaggtcacttctaaatgtgagtctatgcagtatgtcatccatagagaagtgctggctagccaaaaagtgtcactgaacttaacaactttattcaggtgcgatgggaccccataggcgaatcca

SEQ ID NO: 554121 - DNA, 507 bp, Homo sapiens
cggctggtgaaggggcccgcctcaggaactaaaccgcctgggttcccatcctggctttggggcttgctaaatatgtgcccttgagcaaattccccccctttaacaaaagtttttttccttggaaaaaacatccgtcagggttttttggggggcccccttggatccccgggtttttcatttattgggcccccccaacatgcaaggccctgttctaggggtgaaaagcaaaaaaaggcaaaaaaaagatccccaaatcccctttgtgttctggttaacaaagctggcccagggggcccttggagggataacccccctgcagctgggggggggggttgacttatgggcccccccagccagggtcaggccaagggcccccttttttttcccccccctgattttttggtttttccctgaagttttcctgaaaaggaaaggggcctggtgccccttttggcccctttatttgctcccaatgtttataaaaaaaaaggccccccggagggggga

SEQ ID NO: 554122 - DNA, 1246 bp, Homo sapiens
  misc_feature (366)..(366): n is a, c, g, or t
  misc_feature (373)..(373): n is a, c, g, or t
  misc_feature (400)..(400): n is a, c, g, or t
  misc_feature (412)..(412): n is a, c, g, or t
  misc_feature (434)..(434): n is a, c, g, or t
  misc_feature (983)..(983): n is a, c, g, or t
gctcaatctccaattactggcatgaactgaacccacaatcagtcgcttaattaaagtctatgccctaactatagcaatgggactcaatcgctataataccgtctagacacttcaacaccctatatcaacctggctcccaagtctaactgtgcatctggccagcctctcagtagtctaacatggcacgaggaaaactcgcccgctggcagagttatccgtacagactagagttagctagcagcaaatagtcgtccacgatattcacactaataagaatacaataaaactaccatccgggacattattgagtaacacatgaacgtagaggaacgaaatcaccatctggcggttgtttatatggatgtngtttaanacagtttgcactatgttgacattcaanatcttcatagcnccattgtatgtagtcgatacanctcggcctcaagcatggaagtgggcttgcgggtgcgaaacgcgcttgggcaaacgttattttaccatcaatattcgatatattctacccaacaaagcatcctatttgggagaaactactttgaatttaccccctcagtattaattctttggcgctcagacaaatgctacgcccgttggatagttgctctataagagactagcttatgtgttcttaacgacgccatccagcatatattgtggctgcatgacacggacgtcgttgtgatgcgcccagaactcgagccgcttagagcgcatttcgttagagtttacacgaatccctatctaatcttactaacccgagttatcggtgtaacacgcgcgcattgccactttttgtaaggtaatgtccctttcgttcagttatctaccctagccccagtccatcagagttcgtgaaggcttttgagtacactctagagccataaggtggtcccccttaagtaaactccagggttgctcccgctctgatgagtggtagtaaacgcgccgtcttttacacaagctgnacagcttactgtaacttcttaccatccacgctcctctcctactcgctgctgcgtatgctgactctagtgtgcggggccggtgtcccggaccccgggtttgcgcgagtctacctctgcctgagcagtggaactgactacccagcctgggagctggctgttaaaccttattcattctcttcttgacaccttacaggtggttctctatcttacggggccatcatttcctcgccatgacttgtttcatttaacccctgggcatgatc

SEQ ID NO: 554123 - DNA, 616 bp, Homo sapiens
tgcagaagtgtcatccgcaggatttttataagtgatgagaaattagaaataacctaaatgcctcccagtatggaaagatgttaaaattagagcctattcaaaaagtgaagtgttctgcacctgctgaaatgaatatgccgaatctaagcacagcatgcaatgaacaggtacactgcacacgacagcgtgggccgccacatatgtacatgttaaacccacacgcgtgtggtaaaggtgcagctacacggctctgcagacgacaacgtgggccgccacgtatgtacacgttaaacccacacacgtgtggtaaaggtgcagctacacggctctgcagaccacagcatgggaggccacgtatgtgcacgttaaacccacacgcatgtggtaaaggtgcagctacacggctctgcagaccacagcatgggaggccacgtatgtagacgttaaattcacatgcgtgtggtaaaggtgcggctacacggctctgcagaccacagcatgggaggccacatatgtgcatgttaaactcacacgcgtgtggtaaaggtgcagctacacggctctgcagaccacagcgtgggaggccacgtatgtgcctgttaaacccacacgcgtg

SEQ ID NO: 554124 - DNA, 238 bp, Homo sapiens
ccacaaccaggaacactagtcccagccttggagagagcaggggtaccaaggatcttcctccagtgaaggaccctggagccctatccagggaagggctgctggccccactgggtctgcttgccattctggacctttgcaattaccaacactttattgactttcccttgccaaaacttgggaattagcccaagaaggaaaatctgacgaataaagacccccgctgccccataaaaaaaaa

SEQ ID NO: 554125 - DNA, 138 bp, Homo sapiens
tcggctatccttcctagtgtaaggacactagacactggatttagagcccaccctaacacagtatgacctcatttgaactaattccatctacaaagaccctgtttccaaagtaaggtcacattctgaggtcccagtgga

SEQ ID NO: 554126 - DNA, 165 bp, Homo sapiens
cagtcacttttcctgatggggacaggcgctggatctgggatcagcaggtggacgtttatcagctcatggcaaaactggcagcaggcgctggaatccaactgccaagcactgctgctgctgctgctgccgccgccgccgcccaggctgctgccttgcaactgaatg

SEQ ID NO: 554127 - DNA, 419 bp, Homo sapiens
ttcacgatggcctgcggggtggtgctgcggttggcctcggtgtcgatgggtcccggcgcgatcgcgttgatgcggatgttgcgccaccccagctcacgggacagttgctgcgtcagaccgttgatcccgaccttcgccaaaccgtagaagttggcgtaaacccatgctgccgtagacgactggttgacgatcgacccgccgccgcgctcctccatgtgcggaaaaaccgcgcgggtacacaccagcgcaccgtcgaggttgacgctcatgaacttgcggtagtagccccagtccacggtcaacaggccgtcgagtttcatgccgccgaagatcgcggcgttgttcaccaggtagccgatgccgccgaactcggccacggcttgcgctgccatgtcattggccgaatcgatgtcgggggc

SEQ ID NO: 554128 - DNA, 788 bp, Homo sapiens
  misc_feature (36)..(36): n is a, c, g, or t
  misc_feature (69)..(69): n is a, c, g, or t
  misc_feature (111)..(111): n is a, c, g, or t
  misc_feature (120)..(120): n is a, c, g, or t
  misc_feature (137)..(137): n is a, c, g, or t
  misc_feature (139)..(139): n is a, c, g, or t
  misc_feature (144)..(144): n is a, c, g, or t
  misc_feature (155)..(155): n is a, c, g, or t
  misc_feature (159)..(159): n is a, c, g, or t
  misc_feature (163)..(163): n is a, c, g, or t
  misc_feature (191)..(191): n is a, c, g, or t
  misc_feature (238)..(238): n is a, c, g, or t
  misc_feature (241)..(241): n is a, c, g, or t
  misc_feature (283)..(283): n is a, c, g, or t
  misc_feature (288)..(288): n is a, c, g, or t
  misc_feature (386)..(386): n is a, c, g, or t
  misc_feature (418)..(418): n is a, c, g, or t
  misc_feature (442)..(442): n is a, c, g, or t
  misc_feature (458)..(458): n is a, c, g, or t
  misc_feature (502)..(502): n is a, c, g, or t
  misc_feature (513)..(513): n is a, c, g, or t
  misc_feature (539)..(539): n is a, c, g, or t
  misc_feature (595)..(595): n is a, c, g, or t
  misc_feature (613)..(613): n is a, c, g, or t
  misc_feature (627)..(627): n is a, c, g, or t
  misc_feature (692)..(692): n is a, c, g, or t
  misc_feature (720)..(720): n is a, c, g, or t
  misc_feature (781)..(781): n is a, c, g, or t
gtctcattcctttggggctggtcttccacagcaggncctgaatgaacgtagacttcatcagcaggacanaaatgaaatctctcagagccctcctgaactcgggaggaagangttgcagtnagccgagatcgtgccantncactncagcctgagtnacanagtnagtctcttatttttcaggccagccacancagcagtactcatccttaaagtatcaagatgagaacttttgtatgtngtntgtctccccagcttgaatataagccttccaaaagcatcagcnctgtntgtctaatgtcggatccttatctcccagcatggtgcctcggcctctcaaagtgctgggattacaggcatgaaccaccacgtctagccttttctaagtnaaagcactattttatagcttgcaaacactgtnagaaaaatcttctggaagcacggnatcagttatctgcttnaggaatgttaggcaaacagccaatgttaaacggccacacccttnctagagccgangacagccaactcgtcccaaatgtggnagttcagcgaaaaatcagcagagccacctacccaacccacagttgacttagaaganaattccagaagagctgtncaactaatgcaganacttctgaggatcaccaacttgagagctttgtttgctcaaaatctgagttagttgcatagttganccacaggaatgtatgagctttaactggntagggttcctgtgaaggaatgggatcccgaggtgctttccaggaccgtagcaaggggaacngctggca

SEQ ID NO: 554129 - DNA, 301 bp, Homo sapiens
ttgatcaggccggcggtgtacgggtgctgtggatgggcccgcacgtcgtgcttgctgccgtgttcacagaggcgcccggcatacatcaccgcgatcgagtcacaggtttgcgccacgacgccgaggtcgtgggtgatcatgatcatcgacaggccacgctggtcgcgcaggtccagcaacaggcgcaggatttgcgcctgcacggtcacatccagcgcggtggtcggctcgtcggcaatcagcactttcgggttgcagccaagggccacttctatcattgcccgctgacgcatgccgccgg

SEQ ID NO: 554130 - DNA, 213 bp, Homo sapiens
atcagtcaacagtggatgtggattgtgtgagcatatcacatgaaggaatatgacgatgccatagaaagggaattaattaatagtgttagcagcgtcctgcgtgatatagttgtccaccaatatgaagtgatgtaacgtcatggcatggaaccagcatagatcgtatgttctcactgatatgtgggagctaagctatgaggacacgaatgtaca

SEQ ID NO: 554131 - DNA, 157 bp, Homo sapiens
  misc_feature (18)..(18): n is a, c, g, or t
  misc_feature (23)..(23): n is a, c, g, or t
  misc_feature (67)..(67): n is a, c, g, or t
gggtattattaccaaagngcggnttccaccaggatatttaggaactagacttagaatatgcgagttntacaatggggccaatgtaggtgatctggtgaaggaacacctggaacccatgtcttgtctgttgtcttcaaaaggaatattactgctgtta

SEQ ID NO: 554132 - DNA, 105 bp, Homo sapiens
aaaaaaaaaacccacggtttttccccaggaagggcccggggggaaggttttccccgggaaaaccccccacggctttttttttaaaaaaaaaattttcttggccca

SEQ ID NO: 554133 - DNA, 337 bp, Homo sapiens
ctagaaccaggacttgcgtagtaagtccagggcctcgggcacagctggatccaggagttaaatgaagtcatcgtgatccctccatgggtgcatatggctgactctccccattctcggtggccacggtctgcagcgtcaccaccgcgcgggcagatgctgagcctctggtccttagggaacaagatcaggttcctttgagcctctggtcaccacattttcaccacccatcagtctgtcactttggtctgtttctgcttaaagacactgtatttagtgtatagagttgattcattaacgttgaactcacggccaacagcacctacacaggcctgagcga

SEQ ID NO: 554134 - DNA, 268 bp, Homo sapiens
caagggctgtctctggtgtgggccccagacctccggtcagagaagacacagaaacacataaagaggcccctgctctcggggatctgagtccctgctcggaagttcaggcaggaacacccttgtgattttcctggtgtctttgacaaggcagtcactaaacaacccttgccaccggcacgggcccttggcggataggagccccaaagcccggcctcccgtgctggctctgactcctcactcagcccccctgccacgtccaggctgggcc

SEQ ID NO: 554135 - DNA, 625 bp, Homo sapiens
  misc_feature (563)..(563): n is a, c, g, or t
gctgtgtggtgtggtcttcgcgtagcatctcatcatggccttgtgggaggtccccttcctctccctcactgccttctaccccaggccgtgatctcctggtggtacctcaggcactgggggagctgggctgctgtgggccctgtcctacctgtgcctcacccaggccggctctcccctcagcagaccctgctgtccatgctgggatatcccttgtgctctagctgctggccagctgattgctatgtggcgtcacatctcgcttgagtgcccacggacacctggagagggagagacagaacggcacggagagcgcacgtaccggaggaatgacgccgtccataagagaactcgagcgaccctggcagtctagaatgctcaagggcatccacgacctctcagacaactacgtcccttgtcgtggggaaatagcgtggtacgatggtgctgtcacagagggtctcgtcgtagtaggcctaatcaatgtgaatcaccctatgggcatcttggtagggtcctaccatttagccccgtagcttactctctcgaggtataacaccaagggnaagccttacttagtgaagacctctcgttgctattactctcttgagaaatcgatctttcccgc

SEQ ID NO: 554136 - DNA, 156 bp, Homo sapiens
gtggtgtggtactcggctccgacacacactcctgtgatcacacaaaccgttctgacggtactaatctacggacttactcccgtactcgacacggcttttatgggtgccacgtgggaaaccggggaccacgtttgactgccctactttactgactgt

SEQ ID NO: 554137 - DNA, 235 bp, Homo sapiens
catataactagatcaggacttcctgagaaaggggggaaggtaaggtcagacaaacacaaactgggtgccgtattgtcctatcatgccgcgatgtcaacgagtcctgccatcgtaataaccagtagaactgaaagcagaggcaagacaagaaaatagtaacatagaacaattcagatttcaaatactgaaggacgccctcaataatcatggtgtgtaactataagggctgctcaat

SEQ ID NO: 554138 - DNA, 354 bp, Homo sapiens
cggggcttcaggcaggttcttaggagagggaatgtctgtgctgaggcctgaaggagagttggccagggaactgagagcagcgtgtgcagaggcccagtggtcagcaccacctaccatacagaacgcagccagccgcctggtgtgggagatggggggcactgaggcagggggcttgggtgcgtggcacatggggccgcaccacctggtctagcctcagaagaagtctagacatcaccctgagagagatgggacccctcagagggttttaagcagaagatagtgtaggagtggaaaaggaatatctcactactgtgttcatggctgaggcacctataataaaagactaacgcgaaa

SEQ ID NO: 554139 - DNA, 130 bp, Homo sapiens
aatcgcaaaattattaacacgcataatatagcaaggactaacccctataccttcgtggataatagaattaagtagcaataagattgagagagagagccaaagactaagacccccgaacaacagacgagct

SEQ ID NO: 554140 - DNA, 129 bp, Homo sapiens
cggggggggccccaaaccccccttttttaaaaagggggggggggcccaaggggggggggccaaaaggggggggcccccccctgggggggcgggggggggggttttttccctctttttttccctccccca

SEQ ID NO: 554141 - DNA, 247 bp, Homo sapiens
tggctgcttcaacctctattctcgctgagtataccggtctgtggttcccgcatgtattaagaactggatctatgctcggcaagctgacttccagggtagaggcctcctggcgattatcattgaagtccttccctttcttctctagggcctcctcaaatagcatggcctctgaggcttgaccattcctccatctcatcccgacacagcaccgggccacccttgagaactgctctgcaaggaacccacg

SEQ ID NO: 554142 - DNA, 254 bp, Homo sapiens
ggggggggcccttcccaaattttttttttccttccccccccctgtttttttttttaaggggggggttttttatcccccttgttttaaccccccccgggggggggggggtttttttttggcccccccttgttttttttttttggggggccccgttttttctttttttttttttcaccccctttttttttttggccccccttcccccaaaatttttccccggtttttggggcccccctaaaaattttttgggggga

SEQ ID NO: 554143 - DNA, 123 bp, Homo sapiens
ccagggctctgtgtcagggaaaaccttctgggtggactttgtaaggaatccagtttcccaaggtaggattcacatccctaaatcttgcagagactaggattttcacagctccggtttgggacc

SEQ ID NO: 554144 - DNA, 204 bp, Homo sapiens
  misc_feature (20)..(20): n is a, c, g, or t
  misc_feature (22)..(23): n is a, c, g, or t
  misc_feature (100)..(100): n is a, c, g, or t
  misc_feature (102)..(102): n is a, c, g, or t
  misc_feature (196)..(196): n is a, c, g, or t
tgcagtcagagcgggcagcnannacgtcctcctcgctgtccaggtcggcctgcgcacgagcttcgtcgcgctcgaaacggaacgctcgctcgacttcgancncacgtgcaccggacgcaggcagcgctggcactccatcccgagcaccgtgcggcgtgcagatgcagccacacctgcggttcgcgctgggcgggcnagttccct

SEQ ID NO: 554145 - DNA, 257 bp, Homo sapiens
ttactggctagctgccaggctctcctacaaggttagtgccctccaccttgtgtgaagcctgaaccacagggtccctgagtggccttcgacaaaagtgtgtatttgtcccgcgggagggtagcagtcgggccatggggcttcttgtgccctaaaggggactggccgctgtgatctcactagcgcgggcccatggcaaagcctgtaggcttcccctcgtgctggggactacgtacattgcttatactcactacctgatg

SEQ ID NO: 554146 - DNA, 294 bp, Homo sapiens
ggcacgaggctttcttataaacagtcttttaatagtatagtacattctgaatttttgcagagtctcaattttaaaggttccatcccactgttgattttgttgtatttttgatttggaaaattatagtattttgggctatataattgagggtagaggtcgcgcaacacaatattgcatctgggatatagtgacctctctcagggccgagatccacggggaggcaaactctgagataaagattaagggtgtgaaaagcttaattagggagtggtaatggagtccaatactcctcga

SEQ ID NO: 554147 - DNA, 604 bp, Homo sapiens
gcctcactctggagcgtgtctgggtcctgtccactaagtccagaacatgcagaatccagctcattgcagttgggcatgccatagatctaactcgtcccacattttcttaagaatttctatgagcttactcaatatttaagctttactgctgcaacatcttttcaacattatgaagcccattgttaatttcttctatttttctcctcattgcatacgatggtgagctttataagacttcattgctaatcttctcatctatgtcttctaaagcttttctgcattcttccacctgggattcaatctctgcagggactatggtgtacatttcggaatacttgattcgcagtttttccataatattctcaaaagttagtttccctttcttaaggatgctttgaagctcctcaaattattctgacttttctgggtgatcctggaatgccatattttggcatgaagttgtggtctgttgaaagaaattcttctaagcaattatctcttttgtgaaggaatgtctttcttggatttcagtctgcaccaattctttatatttctgaactttctgaagaagcttgttgcctcgtgacttcatagaagtcattct

SEQ ID NO: 554148 - DNA, 1001 bp, Homo sapiens
  misc_feature (1000)..(1000): n is a, c, g, or t
ggttgcggtgagctgacatcatgccatagcactccagcctgggctacaagagcgaaactccgacttaaaacaaaaacaaaaacaaaaacaaaaacaaaaacaaaaaaaacgagttaatgggtgcagcacactaacatggcacatgtatacatatgtaacaaacctgcacgttgtgcacatgtaccctagaacttaaagtataatataaataaacaataaaataaaaaagaaaggatgtggaacacaaatgtttattgaggacctggtgtgcgttgtctctcttaaagtcagtttccaaaaacctgtcgatgattttaactgagggcacactgtataaaaagtccgaaaatcagacaatcagtattactataaacagtaaacaaattgagcagaatttgagatttatttgcttcaatgcttaaatatttcccagtgtgaagcttccaccgttcttcgagcatatctgtgtaaccaattgggcatacaattacttactatctctatctattctatattactgggatttactctacatcttcagagacagggtttcactctgtcacccaggctagcagtgcaagggcacagacatgactcactgagcctgactccttcggatcagccacatctctcatttcacgcttctgagtagccagaactaccaggtggcaccacaatgcccgggtactacattgtgaacactgagatacgcgtggtttgccaggtacgttcaaaacccaatggactcaacacaatactcctgaatgacaacaaaacgctaaaattaagaataacagcaggcttgcaaactacacacggcatagacactaaaccaacatgggccacatccacagtccacaaaatcctccaacagccggacgaacacaacacatcacagagaaccaaaaagaaccaattagcacagggaatacacatacacccagcgacatccacgtccacacaaatcaagcgcacgcacatttgcctgagatcattcccnt

SEQ ID NO: 554149 - DNA, 175 bp, Homo sapiens
cgcactggtggtcctgtattttcacattcttagtggtcctgtccatatactttgtgactacatcatatagtagagggtcctgttcggtttatgcccgctgcagactgtgagtcatagggaggctctgagcattcatccagcactggtagcttgggggtggatgtcgcagggatca

SEQ ID NO: 554150 - DNA, 192 bp, Homo sapiens
ttttttcttttgagacagagtctaccctgtcacccaggcaggagtgcagtggcacagtcacagctcactgcaacctctgcttcccaggttcaagtgattcttgtgcctcatcctacctagtagctgggattgtcagtgtgtaccactcacgtctggctaatctttatatttttaatagattcggggtcgacg

SEQ ID NO: 554151 - DNA, 541 bp, Homo sapiens
  misc_feature (3)..(4): n is a, c, g, or t
  misc_feature (22)..(22): n is a, c, g, or t
  misc_feature (91)..(91): n is a, c, g, or t
  misc_feature (117)..(117): n is a, c, g, or t
  misc_feature (160)..(160): n is a, c, g, or t
  misc_feature (164)..(164): n is a, c, g, or t
  misc_feature (183)..(183): n is a, c, g, or t
  misc_feature (192)..(193): n is a, c, g, or t
  misc_feature (197)..(197): n is a, c, g, or t
  misc_feature (213)..(213): n is a, c, g, or t
  misc_feature (218)..(218): n is a, c, g, or t
  misc_feature (224)..(224): n is a, c, g, or t
  misc_feature (244)..(244): n is a, c, g, or t
  misc_feature (257)..(257): n is a, c, g, or t
  misc_feature (259)..(259): n is a, c, g, or t
  misc_feature (264)..(264): n is a, c, g, or t
  misc_feature (296)..(296): n is a, c, g, or t
  misc_feature (324)..(324): n is a, c, g, or t
  misc_feature (354)..(354): n is a, c, g, or t
  misc_feature (397)..(397): n is a, c, g, or t
  misc_feature (436)..(436): n is a, c, g, or t
  misc_feature (446)..(446): n is a, c, g, or t
  misc_feature (449)..(451): n is a, c, g, or t
  misc_feature (467)..(467): n is a, c, g, or t
gtnngactggactcgcggcganttacctttcagtcgtgcgctcctgatccggcgctcggaatttgtccccggttcaggctgcggggcctgnaaggaggcgaaaacgatccagggagncgaggcgctcctcttgtcatcccactcagcgccatgtcctggntgtncaagagggatccagttggnagtacttgnngacngtccagtatggagttnatggnaatttnccacgcctctcatatccaantttctttccacgntngaatnccaagatgttatccctccagatgatttctaantagtgatgaagaagtagattccgtttanttggaagtttgagaggtcatgtggttggantacgctattacacgggagtagttaataataatgaaatggttgnttacaacgagatcctaataacccttatgataagaatgcnattaaagtanacnnntgtgaatggaaatcangttggcatttaaagaaggagcttgcggtgcttggactatatcatggacaacaaattggcgaaattgaaggggta

SEQ ID NO: 554152 - DNA, 829 bp, Homo sapiens
gctattaggttttatcacattcagtcacagtgagatgtgaaattaacaatgcctctaagaaatggaaaattgtgctgctgacagacatggtgatgcgctgcaggtatgtagctgtggccctggggacacacccttctcctgtgtgtgtcaaagctagaactaaggcccttttcctggaaccttgatctctggagaacaaggattaagggcaactgactcagcactctgtctgccactgatagctacaaggaatttgcttacatatgtatcaagtatgccagcatgtacatacaagtatgtctatttcagcattaaaacattattttaaaatacacataaatgtaaaataaatcaacaatataagtgaaagctttctaccatccctgactcccattcaccacccagcaagatgcagccagtttcttgattatgttctcagagagatatttttggatacaatggcattctcttctgtgccttgcctttgtcacttatcgatactaccttaagagttaacaggaagaacatggactttgaagccagaatacctggtctggaacccagcaacacacatactagctttgaccttgagcaagttacttaaatggggataataagtactatccactaaaacatatgtaaaggcatttcaagcagtgcctcgcccagagttaccaataaaatagtattagccattgtggcttgacgcatgtccccctgtcagtacattacagaaaaccctcattcttattaattggctgggtgatattccattactcatcagatgtaccacaatgtattaagccagccttcaaaaaggacaatagtg

SEQ ID NO: 554153 - DNA, 315 bp, Homo sapiens
  misc_feature (305)..(305): n is a, c, g, or t
tgagacaaggtcttgctctgtaccccaggctggagtgcagtggtgctttcttggctctctgcaatctctgctgcccaggctcaactgatcctgccacagcctccccagtagctgggattatgggcatgcacccagctgatttttgtatttttttgcagagacaggatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgngcataaaatt

SEQ ID NO: 554154 - DNA, 580 bp, Homo sapiens
  misc_feature (3)..(4): n is a, c, g, or t
  misc_feature (22)..(22): n is a, c, g, or t
  misc_feature (91)..(91): n is a, c, g, or t
  misc_feature (156)..(156): n is a, c, g, or t
  misc_feature (199)..(199): n is a, c, g, or t
  misc_feature (203)..(203): n is a, c, g, or t
  misc_feature (222)..(222): n is a, c, g, or t
  misc_feature (231)..(232): n is a, c, g, or t
  misc_feature (236)..(236): n is a, c, g, or t
  misc_feature (252)..(252): n is a, c, g, or t
  misc_feature (257)..(257): n is a, c, g, or t
  misc_feature (263)..(263): n is a, c, g, or t
  misc_feature (283)..(283): n is a, c, g, or t
  misc_feature (296)..(296): n is a, c, g, or t
  misc_feature (298)..(298): n is a, c, g, or t
  misc_feature (303)..(303): n is a, c, g, or t
  misc_feature (335)..(335): n is a, c, g, or t
  misc_feature (363)..(363): n is a, c, g, or t
  misc_feature (393)..(393): n is a, c, g, or t
  misc_feature (436)..(436): n is a, c, g, or t
  misc_feature (475)..(475): n is a, c, g, or t
  misc_feature (485)..(485): n is a, c, g, or t
  misc_feature (488)..(490): n is a, c, g, or t
  misc_feature (506)..(506): n is a, c, g, or t
gtnngactggactcgcggcganttacctttcagtcgtgcgctcctgatccggcgctcggaatttgtccccggttcaggctgcggggcctgnaaggaggcgataatccggaaggggcgggggggccctttcccgggaaaaaaaacgatccagggagncgaggcgctcctcttgtcatcccactcagcgccatgtcctggntgtncaagagggatccagttggnagtacttgnngacngtccagtatggagttnatggnaatttnccacgcctctcatatccaantttctttccacgntngaatnccaagatgttatccctccagatgatttctaantagtgatgaagaagtagattccgtttanttggaagtttgagaggtcatgtggttggantacgctattacacgggagtagttaataataatgaaatggttgnttacaacgagatcctaataacccttatgataagaatgcnattaaagtanacnnntgtgaatggaaatcangttggcatttaaagaaggagcttgcggtgcttggactatatcatggacaacaaattggcgaaattgaaggggta

SEQ ID NO: 554155 - DNA, 583 bp, Homo sapiens
actcagtccgagactattttagtaagcccaagtatttggctggcaggtacacactctacattaacagagttaggtgcttttaagaacgatattctgagtggcatttattggattcacgggtaatgaaggagactgaccaaattacctactaatatgttaaagccgacaccattgctctcctttgcatcatgaggagtattagtccagccatctctgttacgattcacgttttgctgcgcattcagcctcgaacgacgcagcaaggacccggcatgatcacaacatctgcccattttatagttgttcctaatacaacgctgtatacatactgctctgccaaggaatggcactctagtccgggaatgtatgggttgaataacatgcattcttactgaaacccccttttgcccttggctgctcatgattcactgactgcgaggcccaagcgccgcatgtctgactgcttgatgatgcatgtggtgcggccttgggtatatcgctaaagatggcttaagcagcggagagacctacactttctttagagcgaggctcgctggcacccacagctattcgtttagcacag

SEQ ID NO: 554156 - DNA, 526 bp, Homo sapiens
tcaagatgggcggttgggtccttcgatcgggcatgaaagatataggacatgatcaacaggctgtggggtgacatgttcttcgacccagacaatggtgagttcatgacagatgtccgccaccagccccgacgggaagatagctgccacgcaccttctgccatctgatcgtgtaccccatcttcaaggtgtgtgatgcgatcatgaatctcacgagagaggagctggcaaacactgatagagaaacgtggaccatcgaacgggacagcgaagtgcactaggtacacctcaaggcatatccctgctgatggctgtgatgcgccgatggttgactgccggagacgccttgttgccgatgatcaccatccacctgccctcccctgtgacggaccaaaattcatcgctgcgggctccgtgtacgaggggcccccggaggacgaggctgccatgggccttagaaggtgtgaacccaaaggtcgctcttatgatgtatatctcgcaagagtggtgcctagcgtacatcttctga

SEQ ID NO: 554157 - DNA, 161 bp, Homo sapiens
gatgtgcgaggtgatctagaggatcccaggaaagatgggaaggggaaaatattttcagacatcctggctataaaatttcctttagttttatgcctggccttgcaaagctcagtgaaatgtgaaaggaataaattaatcatgtttctactaaaaaaaaaaag

SEQ ID NO: 554158 - DNA, 1280 bp, Homo sapiens
tgggcacaaggtctgttgggttggtctgccttaaaaaaaaaaaaaaaaaaaaaaaaaaaaaaaaaaaaaaaaaaaaaaaaaaaaaaaaaaaaaaaaacaacaaaaaaaaaaaaaaaaaaaaaaaacaaagaataaacaacagaaaacacaagagaggacgaacaaacacaacacgagaacgagggagagaccacacaaacaacaacaacgcgagaaaccatacaacacagacacaagaaaagaagaagtagaacagaacagacgagcaacaaacacaaacaaaaaaacaacaaaaacccagacacgcgacgctgcagacacaaacgcagaggagacaaacgaaaaaaaaacaaagagaaaaatagagaagcagaacaagagaaggaccaaaacgacaaaggacacgcagcgcaccagaggcaaaaaacaaagagacacacgaccaaaagaaagaacaagagagcacagtagaaaaggagaggaggagcaacgcggaacagcgaggggcgtaagcgaggacgaaaggaggagcaaagcaggaagaacaaggaagaacaagagagaggagcgaaaaaaatagagagaggagagcgtgaacgaaaagacaacagaacacacaacagaagagaaagagaacacacacaaaacaaaaagaaaacaaaaaacaccaacagaccacagagaaaaaaacagaaaagcaaacaacaaaaagagaaagaagaaaaaacaagacacacaaaacagcaaataacaaaccaggacgacaaagaagagacaaaggacgagacacacagagagagaacgagaagaagaaaggcagaaagagacaaggaaggccacaacgaacaagaacacaccgacaccaggacgaaagaggggccggaagaggacgcgagaacgacgaagcaaaaacgaaagcgaacgagagacagaagagaaccagcagaacacgaaacaagaaaacaaagagcgcagaccgagccgcaacagacgaaaagaccaacaagacgagcgacagcagccgacgaggagggagacaagaacagggcgacagccaagcaaagcagaccggagaggcggaacacggcagaagcagacgcagacgagaacgatgccgacggcgcgaggcagagcgagcgacgagaagcgaacaagtagaagcagaagcgagcagacaagggaggtagaaggacacagtaaggaccaacgaccgcaacgaaacagagcaacaggaacaaacaagagagaagaagaccaaaagagaacagaagagcaagagg

SEQ ID NO: 554159 - DNA, 727 bp, Homo sapiens
  misc_feature (496)..(496): n is a, c, g, or t
gccatagctcgaggatcttcgggatgaagggaaggcttcatcttccacactgtgactgaagtgtgctaccttacgaacattggcctgcagagcttacacagatggtcggtagctcgctcgaccagaggactccaaagctgagaagcctgaagttggctacgttagtgacagatcttaccaaaggacacgcgaaatgcggccatggagatctgcttgaattgtgcttgatgacgaggactggacactcgccaacatctatcctgcgaagatcatgatagacatctcctgtggacttgacgcctgctgtggagacctctgttgctagcatgcgactgccctgactcacagaatcatgataagcaggctgtgactatgtcttattactgctgattttgttgtacgtcaggctggctgcacgggaaggcatcctgataactctgtgaggctgctgctcgtgcttgccatgacatatgtgacctctctactacagtgctgngacgctgcatatactcataaatgatgtgccagagtgtcataggacaatatacctctagaggaaggacctctgagtttatcacacttacatgtgtgctctgtgccagcttgatcgtacaggtggcgtatgactcttggtctttacacgagaagttcctcggtgttactccaactatcgtgagcttcaagactattataaggggccacaaaggtacgctctggagtccccgtc

SEQ ID NO: 554160 - DNA, 115 bp, Homo sapiens
ttttatgcatttggagtttcatctgattttgctgctgctacacatcctcgatgctttttacctcagtaaaccagattaaactccaaatgcactaaacaaatgcattaaacatatg

SEQ ID NO: 554161 - DNA, 2432 bp, Homo sapiens
tgtacaaagagaaatacatcattatttaaaagcatcatcttttttttttatattgtaagataaataccattctgatgtatttctcttggaaagggatgctggtatcctgggaggtttatgatttttgatgtttttactcaggtgattggcttgtatagctgaaatgctgatgaaaaggagttttcccttctccctttttcttttcttttccttttttttttttttttgagatggagtctcgcactgttgcaggggctggtgtgcagtggcacagtctcggctcactgcaacctccgcctctcgggttcaagtgatgctcctgcctcagcctcctgaatagctaggattacaggtgcccaccaccacgcccagctaattttttgtatttttagtagagatggggtttcactatgttgggcagtctggtcttgaactcctgacctggtgatcctcctgcctcagcctcccaaagtgctgggattataggcgtgagccactgcgcccagcctgtccctttttcttaaatgacctttttggtgaggaccattataggtttgtaccaggataaggttgtagagttaatcataatattctcttatataaattctaaaaattgatgttctaagaagagaggtagaatttgaatgactgggttacttcctagactcttcctccttctcttaagtacagtatagttctttctctgaaaatcttcagtctcttagttccagatgggttctctatggtaagaatacaggacatgtagaaggccctaggggaatgctttcttccccagatctttgccctgtagtaggtttcagctgagcaaggacgagtagtttttctggtgtttggcctcctctgttgggtggaaaaagactttcttctctattttcctagttatatatgctatcatatgtctgtttttctcctcttgaagtttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaaaaaaaaa

SEQ ID NO: 554162 - DNA, 1556 bp, Homo sapiens
gcgctcgcgctctccggccgcgggcatctcccggcccggccgcagcagccgccgccgccgcgcatttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaaaaaaaaa

SEQ ID NO: 554163 - DNA, 1762 bp, Homo sapiens
ggccgccgcgcgcaaccacatggttgagaaaggagaaagagaaaatgattacttgtagagaaaaatccatttctgcagtggtatggttaaggataatctaaccataatcacattatccttgtatgcctggctacttgtgctggcctgtatgtgaatgttaaccccaaagactcctttagatgtcgctgaactagttactataaaaagtatttcgctttcaaactcccacatttcaagaagagcaaaactcaatacaaggcaattttgaagtttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaaaaaaaaa

SEQ ID NO: 554164 - DNA, 1649 bp, Homo sapiens
  misc_feature (189)..(189): n is a, c, g, or t
  misc_feature (221)..(221): n is a, c, g, or t
gcgctcgcgctctccggccgcgggcatctcccggcccggccgcagcagccgccgccgccgcgcatttccctgaaacctgggctcttgaagacgcatcactggagcagatggataatggagactggggctatatgagatggggtcttgccatgttgcccaggctggtcttgaactcctgagctcaggcantctgcctgccccggcctcccaaagtgctaggnttacagatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaaaaaaaaa

SEQ ID NO: 554165 - DNA, 855 bp, Homo sapiens
gcgctcgcgctctccggccgcgggcatctcccggcccggccgcagcagccgccgccgccgcgcatttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagtaccggcatgagctactcgcgatttccagattactgggatcctcagatacagct

SEQ ID NO: 554166 - DNA, 793 bp, Homo sapiens
gcgctcgcgctctccggccgcgggcatctcccggcccggccgcagcagccgccgccgccgcgcatttccctgaaacctgggctcttgaagacgcatcactggagcagatggataatggagactggggctatatgatgactgacccagtcacattaaatgtaggtggacacttgtatacaacgtctctcaccacattgacgcgttacccggattccatgcttggagctatgtttgggggggacttccccacagctcgagaccctcaaggcaattactttattgatcgagatggacctcttttccgatatgtcctcaacttcttaagaacttcagaattgaccttaccgttggattttaaggaatttgatctgcttcggaaagaagcagatttttaccagattgagcccttgattcagtgtctcaatgatcctaagcctttgtatcccatggatacttttgaagaagttgtggagctgtctagtactcggaagctttctaagtactccaacccagtggctgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgcagcaatcttagatgtgatgctgcctatacgacacactgatcatgttatactgtctgccc

SEQ ID NO: 554167 - DNA, 1645 bp, Homo sapiens
  misc_feature (531)..(531): n is a, c, g, or t
  misc_feature (1645)..(1645): n is a, c, g, or t
tgctagggtcgagtggtccgcgcgtccagggaagtccttcagtgtgagtgcataacgtgtgaagataaacgtggcaggatgaacggaggtctggaagcgagcagtctccatgggggacatctcgatcgcggcctcatggatggcggccgaaggactggcaggctggatctagctgcagtgctgcgctttagtgccttctactacttgaatgtctcgtactctcggacgaaacggtcacgagtccacaagcattagcatgctgcgaagtgatggccatgatgcgtgtgtcaccaagagatagtagttaactggggagtcgtacttaacattggggcatatatcaacgtgcgcgtggagcatggcatccactaggactggcgagtcaaccgacactggcggtgggctcactggtgggctgcgtcaccaggacggaacgggtccatgatgcatgtagaggggcatgttccgtattggaggcatgatccacgagcgtgcagcacatgcgcctggggcgccagtgacatgctgggncaccaagggggaacatgcggcaagatcggtacgctcgggaagcataaggtgcggaagcagtgagcactagagaggtggaagaaaggggcataggcacttgggaacacgttgcgaactggacgtgagaggagaattgatctgtagcgaaaggcgccatggactcaaaagcggatgcacctgcgaccagagagtgtatcgcgtgcgaacggggacttatggcggatgcggaacaaggtaccttgtgggcatggcgggcacgagtacttgtaaccctcggtggtcgttttagtgggcccgcaccttggttgtgttacgtggggcgccaataatgcgacgttaagctagggggaccacccgcaaattagcggaggagccacccaacggcggaaaagtatacggacccgaagggaaacgcggtccccgcacgagataagggcttcgcagagttcgcattggcgcgttccgaactggtgacctagccgcggttgtggctttcgaattaagcggagtcgcgcggtaacatcgaaatgcccacacctcgggacgctgccattcttttgatgggacgcggcgcgtgccaagatcgcgatcgctcgggggggcaaagcatctcgtggggcaaaggcggaaggccctgtgggacttgttggcgaaattccgcacgtgatacctgtggggtatgggggttgtgaccgttagtacgccgcgatatagagggcgcccggaacccttcgcagtggggccccgactcaaattccgaaggggaccccattccagatcgagggggggcgccccaaattcacagagattgtccccgataccatttatcttgggcaaaagaccgatacggtgcccataagcacggggcaacaaaaaggccaacggcacaacagaggcccgatagtacagggagcaatcatgcccccgggaagagaggcaacgcagcggccgcagaccatgggggcgccacacacgaagagggcgactacaccacaaggagcgggttcaatacttgcgcagcgaaaatgaggccgggaaccaggggtgagcgaccagacgcgaacaacaccatagagagacgaaaacgggcgaacaagaggagacacagggccgn

SEQ ID NO: 554168 - DNA, 369 bp, Homo sapiens
  misc_feature (139)..(139): n is a, c, g, or t
ttatgacaggtgtttaagaatgagtgtgactgaaaaggcagatgtttcctatcatgaccaggtaaaaatatccagcttggctgggtacagtggctaatgcctgtaatcccagcactttgggaggccgtgaagatctcanagatctcttgaggccagaagttcgagaccagcctggccaacatggcaaaacccccatctctactaaaaatacaaaaaattagccggacatggtggtgcacaccagtactaccagctactcaggaggctgaggcacgagaatctcttcaacccaggaggcggaggttgtagtgagccaagatcataccactgcactccagcctgagcaacagagtgagactctgtcccaca

SEQ ID NO: 554169 - DNA, 249 bp, Homo sapiens
accgtcaacccaatcaggtatgagctaactaggccctaaagcagcacattaccactccctagaaacacccagtaagacccctcccagtgctggacactctgcctctagtcaatgccatttggagctctttgaggaagactttccctgaataggaaaatggagaaatgactccctgtatcttccaaactcagattccaagtggactgtggttcctcaggtaatcttattgcatatgtctcctaagtaagc

SEQ ID NO: 554170 - DNA, 151 bp, Homo sapiens
gacatcagtgagtgagctacagaattagctggataggtagcaggtcggcgttcgcctatattagaacacagtttgaacacttagcagcctatgggtggtaataagtatagaccccgtagggtatggccaagaactcagactatggtataca

SEQ ID NO: 554171 - DNA, 182 bp, Homo sapiens
gtcccagagagttgcataaataatttgtggcttgggtgtatacatgtgtaagttacattttagttatggaaatggatattagtgaaattgacagctttctatggttaagagcttatccgtgtatggtgagccagaggttctctggtttttctagatttctctatattcattcgcctataatt

SEQ ID NO: 554172 - DNA, 685 bp, Homo sapiens
  misc_feature (170)..(170): n is a, c, g, or t
aatgtgtaatccagccgtataggtgtttgctatacagtcagtactctacactcggcggagtaaccgcttagaccgagcgcattcctgtttcacctgatctgtctcatgtctcatcttcctagatagcttctgttaaggtccaatctctgaatatgtacatctctgagcancatgtcctcactattatgatctcaagcacagtcttgtctgtgacattgttctcacatattgagtgtagctccagagacctagtacgcgacaaatgaatatgaacaaaacatatatgctagtctgagaggccctcccagaataagtgaagtctggtcttgtggagtcacgctcctggactgggtaagctcttgccacacactcaggcgtctctgtaccagctcagccgtatcaacggggtcttggtacacacgatgagtcttgtgacgctagtttgccagctaggtgcacgcgccatctgactctgggcatcaaggcactgactctcagtcataatgcggggatagccggttcttccctatgtacacggggctcaccacacaggagtgctgactgcattttatcagcagttaattgtgcaacgtttgtgactttacattttacgcaacgggctccccagcgtgtagcattgtcttctttccagtctggtcgatttttccaatcgggaataatgtag

SEQ ID NO: 554173 - DNA, 265 bp, Homo sapiens
gatgcaacaacccgtcatggcctgaagacatgatgtggcgagccacgccatgtacaacatcacgagcttcttgccgtcgcccttgctgacggggtgatgcagtctccagggcatcggcagggagtcggcccaactccgcaggtcgtacttgcccacatggatgccatcctcgaagcaagtctggccgctcccctcatcggcggtgccatggggctggtacttcaagcgcttgagcccgtaccgcttcagccagcttcttggtatc

SEQ ID NO: 554174 - DNA, 690 bp, Homo sapiens
ggcagctggaatcgcggtggaacgaaggagtaggtggtgggatctcacgcgtgggtccgattagccttttctcatgccttgtttgcattgagcgtgtcagactggaatttcgataattggcatgtgcggtaaggctggactaggactccggaaaggccaagacgaaggcggtattcgcgttcgcagagagcgcggcgttgcagttatcccagtgggaccgtgattcagtcgatcgaccgtagataggatctggggagacgagtctaagtggatgtgtgggggcgagtgtcgttgtgtaaacgtgcagtaatccgtggagtatctcaacgtaggaggtacgtgtgaggagctggcagggaaatggatcagtaagagcttaatatggtaaatgacgtataaactcacctgagtaacgtatgcgacttgctagttcgtggagattgagtgatatggatctcgtggtcgtcaggggctaagaatggctggtggtggtggtcgattcgacgaatcgcgagaagatctcttgatggggtaggaacaggacgagagaagaagtgtttaaaggatgctgtggataacggttgttcatgctcaggatctgaatactctaccagagtgccagtgttggtgattcagtggatgtatcttctgggaaaaacaaattttgcttttgtatctatttgagaagtg

SEQ ID NO: 554175 - DNA, 252 bp, Homo sapiens
  misc_feature (24)..(24): n is a, c, g, or t
ctgtgctcaagtgatccaccctcnggctcccaagtagctaggaccacaaataatgtgccactgtgaggctaaatttatttttaaagttttgttttagtagagatgaggtcttgctatgttgcccaggctggtctcgaactcctgctcaagtgatccgcccacctcagcctcccaaagtgccaggcccagcccacaaatcctccttcagactcttcctcggggtctgaatccccacccttctgtcgtcttctc

SEQ ID NO: 554176 - DNA, 188 bp, Homo sapiens
ttagccctcacttctgtgaaaccccgcttgtgtgagcacgtgcagaccaatgagcaaactagaaccagaggagctacaggaaaatgaggcagagtgggcaggcttgggggacaggcagcattctctgagtacccacctaccccgtgcccagggactcagcaagcctttagcctgtggtccaacaggcc

SEQ ID NO: 554177 - DNA, 1011 bp, Homo sapiens
gctcgtgcgaggattcttgcattctgtccatccggccggtcccccgtcgagtctgtctaagccgagttgcgatggtcgagaagatcaacccgactggtccttgaccatggcttcggcgtgtgcccccctggcctgtgctcggggcgctacgctcatccgagcgcgatgatctgcttcacaatcgctgcgcggcgcgccgcgagatcacgcaagggccgtcttgtcctggtgacaatgttgtcaataaatgacatccatacgtgggagctgacagcaggcacagaggccaaggtctgtgagtctaccgtgggccccatgcatagtacctccattgatccaatgtgcgagtcgatgcgacccatactgggcggacagtaccctggtatcaatgaatcgtagggcatactacactctatcgtatgaacgtaagctgctcgtggtcccgggaagggatgcaccccaggtgctagcttgatcgaggcccgctctgaaacccaaaggaccaaatagagagaagatgacgtcagattatgtttgagaccttcaacaccccggcatgttcgtggccatccaggccgtgctgtccctctacgcctctgtggcgcaccagtggcattgtcatggactctggagacgggggtcacccacacggtgccatctacgagggctacgccctcccccatgccatcctgcgtctggaccgtgggtggccgggactgacgacgttacctcatgaaagaattctccactgaggaggctacagttcacaccacggccgagccggaaatcgtgcgcgacatcaaggagaagctgtgctacgttcgcccggacttcgagcagagattgcaccgcggattctcctcttctttggagaagaacttacactgccgtggccaggtcattcaccctggcatgacgggtccgtgccggggcctgccaccttcttctgggtagacttgggtccgagaacccttatcacatactgtcggatcccaacttcccggttggggg

SEQ ID NO: 554178 - DNA, 1042 bp, Homo sapiens
  misc_feature (1042)..(1042): n is a, c, g, or t
tataaaatatttaaaataaaaggggggccccccccaaaaaaaaaaaccccccgggcctcctttttttttacccccctttacccgccggtccacccctctgggggggggaggcactacaacggtaaaaaatagccgccatactgggaggaccggggcaagcccggttgccccaaaaaatttcttatatttagatagttccccctgaagccatacttttataattatctcacacattacataataaaaggggggtcttttaaacctttctctcaacctttaattaaacaacaaaagagaaacacctttttgaatatctcctggggacaaataatgacccctgttggggcaaatattttgtttttctttctcccacaatgtagagaagaagacacaacggaaaccccctttgtcagacttgtgtgcagagaaggggggagattccaaacattatgtctagcgtgcgtcaccaaatctaagaatatacgcgcggagggggcacccttgtcgccccataatttttataatggcgccgaatatactcagaattgtttgttttttaaaataaaaccccctcagtcaaataaaattttccttgagaaaatactattgttaaggacgtctctcgcggtggagttctaaatcacaatattttgcgtgcccaaagccccttattattaacccgccgcgcgttttagaatttgtacgaggttacacggttttgcggttgagaaaacaaattatactgtctttgaaaaaaaatttctaccctccccccaattttttttttgattgtctcccaaccatgaaaatttcgggattcccccaagttagaaaaaaagaaacatcaacacaaacacaagacaaaaaaggggcgggtcgataatcactggggccatacacacccttatggaagaggcccagatggtaaaaagggggggtacgacagagagacatcactgtgtgagacctcgctgtgtgacacccacacgccgaaaaatttgtcctctgccggtatacatacaagctgggtgtacaagacacn

SEQ ID NO: 554179 - DNA, 221 bp, Homo sapiens
taacaaacccacggtccccgcaagaaacaattcagtaatttccacaggcttggagatgactcaacagttccactcttacacgaccacccgagagttaccctgatagccgtccatttgggcgttcatcacagcatttgcttcttacatgaattcttaattttggaataatttcagattcacagagaagttacaaatccaatacagcgaattcttgttttcta

SEQ ID NO: 554180 - DNA, 116 bp, Homo sapiens
ctaggtggaggaggatttggatctgggacacctccatttgggtcagacacatagctgagatctgctgcagaaacagcgggggtatcaaaatatgcatagttgattggtccacaccc

SEQ ID NO: 554181 - DNA, 552 bp, Homo sapiens
agcctcttgagtagttaggactacgggatgtgtactactgtatccagataatttttttttttattttgagacagagtcatcgctctgtggcccaggctggagtgcagtgggtcgcgattcataggctacactagaaagactaccgccatacccgggcttaccacaccatattctaccatagcctacagaccatcccaagtagagatacggactaaccaggttgcatgccacacatgaccacggatagtatactctaggatactttaacacgatagacgatagggcgtttacaacaccatagtatggcacaggcatgggtacatactataacataccatgaactcactagactccagacacagacatacgagcctatcccaacggctgctggagcatatcacagtggcatgaagccccacgcggggaccacaacaacactaccaatcagcggacaactctatccctcaaaccctctcactattacatcgacattgcatctccaccgctactttatacaatccaaccaccacacaacccaggctcggcgccaca

SEQ ID NO: 554182 - DNA, 633 bp, Homo sapiens
ggcttttggcttaagtattcgtgatttctgctgtcgatgcccaagttctgtgtttggctttggtcgcatctctggtgctccgtgctatgtgtcctactatttccagctccctggtgttggcagtcactggagttcttgtgtttgtcactgtcgtctgtctgtagttagcgcttcagttgtgtttcctctgttgtccagcggccatgcacactgtaatgcatcacttcttttttatgttgtgggtatctttgcaagttagttgttgcatctgatttttcaggtgtacacttttattttttgatctggtcttattttaggggattttttttttgtaccatgtccgattcacacgctacacacccagcatgaacacattcgaacttcgaaggccacacagctacctggcattgcataggcgcgccacggtaagtagagttcacacctagaacactgtcctagaccgcaggacgcgtgccttggacttggtattgctacatgtgactggcatttcttgccctcgtctcatgaatgtgttagactcatgtaagaatcatatcctgccccagaatttcgaaagtaatgaaatgaagatatttcaaacagatctgtgaaacttcagacttcggtggtgcc

SEQ ID NO: 554183 - DNA, 329 bp, Homo sapiens
gcacgagctgggatttgctttaaaatgttccaggctgggcacagtggctcatgcctgtaatcctaacacgttgggaggcccaggtgggaggatcgcttgagcccaggagtttgaaaccagcctggcaacatagcaagaccctatctctacaaaaaaaaaaaaaaaaaaaaaacccctaaaaagttacccaggcagttagcttcgtacctgaggtcccagcttcttgggaagctgagctgggaggatcagttgggcatgggagttcgaggctgcagtgagccatgatcatgcctgcactccagcctgggtgacagagtgagaccctatct

SEQ ID NO: 554184 - DNA, 300 bp, Homo sapiens
  misc_feature (18)..(18): n is a, c, g, or t
ttagacaccgcatggcancgatacagcttttgtaagatcgcttcgccttcttttgcgactgagtccgttacaactggtttcgcatttttcattttttcaacccattgatcgaactcttttctaggaagcggcttcactttgaagtccattaacgcatgggacgggccgcaaagctctgcacactttccgtagaaaataccgcctgccttgtctgttgccttttgatcaaactctaaccaaaactggtttttgttatcaacgttcgtatccattttcccaccaacagtctaaatgcaatca

SEQ ID NO: 554185 - DNA, 422 bp, Homo sapiens
ttaaaggaggtagtgagggggcggaagcacttcagagtcagaatccatattagactctggggagtgaaaaattaacttaaatcagtaagatgggagagccattcatgtgagaggtgcatgcagataggcgtagtttaatctctgacctggggaagggagagatggaagttgagacgaaatgtctgggcatccgtggtccgtaaggtcatgtgctttgtagctgaatatcatagaagtagcaatgttcaaagagtgggaagaagtataacataatgacatacttcaggccacataccaatcgttaatgaatttaataaaagtttaagaaattccacagagttataagtattggattatgaactcataaaaaatagatataagaaggaataagaaaaatacgagagagaaaggaaggaggtgaa

SEQ ID NO: 554186 - DNA, 159 bp, Homo sapiens
ggggggggttttttttggggggaaaaaccccccccggggggggttttttttggggggggttttccccttttgggggggggtttaaaaaaaaacccccccccccccccccctttccccccctgggggtttttttttttaaggggggttggttccccccca

SEQ ID NO: 554187 - DNA, 374 bp, Homo sapiens
gccgatggctgcgttgcgtgaggcgctggtgaaggtgcgcaaggtggtggcgtggtgagcgatcttcagtacttgtaagcctggcgaccaatcagcagccattggccgtgctgtttttgccaaacctgaaagttgtcgatatcggttggtgtgtccacaccgctgttcaccgccagggcatggaagtggttgcgcaccagggcggtatcgccgttgagggtgatggtctggttttgcatctccagggttttgaatgcgctggtatgggtttccaggtcggcaatgaattgcgccttgttttgcaccttgccgctggagtggccgtaggtgagcttgtcggacgtcagtgcatgaagctgcttgaggtccagatg

SEQ ID NO: 554188 - DNA, 978 bp, Homo sapiens
  misc_feature (863)..(863): n is a, c, g, or t
  misc_feature (885)..(885): n is a, c, g, or t
gagtctcttcagcaaaagctcagtccccagctttgagtcagagtagggaccatgctgtcccagcgttcaaggataaaaaccatcaggcccaagtgccatccgatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggtgcacaccattggggtttgaaaagctcagaatggtaattaagtccgatttgagctactatgctacagatcccggtttgtcttgtaacccttttggaaggcttataggaccangaggattggaaatctttgtaancgccatgttcgtccacaaacattacagatgtggccccattatgtgcgtacaggcggcttaaaattgtctctccaataaaagccagaggggcga

SEQ ID NO: 554189 - DNA, 967 bp, Homo sapiens
  misc_feature (772)..(772): n is a, c, g, or t
  misc_feature (776)..(776): n is a, c, g, or t
gagtctcttcagcaaaagctcagtccccagctttgagtcagagtagggaccatgctgtcccagcgttcaaggataaaaaccatcaggcccaagtgccatccgatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggtaattcaatggtccgggtganactngtggctgcatacaaatttttcatccatggtcaggataatgattcctggtaaaagcaattttttttggaagaaattaatggaatgatttttaggtaggaagaacctttgggttacattattcactgggtttgttaaggggggcgcgacattggtgcacaaatcgtgtaaaggttaaatacccagggggttag

SEQ ID NO: 554190 - DNA, 276 bp, Homo sapiens
  misc_feature (1)..(1): n is a, c, g, or t
  misc_feature (15)..(15): n is a, c, g, or t
  misc_feature (17)..(17): n is a, c, g, or t
  misc_feature (43)..(43): n is a, c, g, or t
  misc_feature (45)..(45): n is a, c, g, or t
ncttgtcgttaccgngnttattaccctttttggttaaacaagnangatagagaaaggaaaatgttatgaagaaattcctaaggaagagaaaatctactgactattcattaggtgggagtggggcacgatcaaggtctccatcctcgtcgtcttcacgtcaagtgggctgaggaggagcagaaggaggaggaactggtcttgctgtctcaggaacggccgaggaggaagaaaacctcgtattagtggaggaacatgggttcagttggaaacatggaa

SEQ ID NO: 554191 - DNA, 91 bp, Homo sapiens
gactatgtgtattgagcactaagtggaagcccctacagaatggacattagtgattaatgcaagggtccttaacagcagaaacggggccaag

SEQ ID NO: 554192 - DNA, 887 bp, Homo sapiens
ggggtcagtgtcacctccaggatacagacagccccccttcagcccagcccagccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttcaagacttcattggaggaagtaaataaagatctggtggaaatagcaagacaactaaagctggaagtggagtgtggagatgtgactgaatggctgcaaatctaaaaaaaacaacaacaaaacaacaacaacaacaacaacaacaacaaaaaaccacctgagcagatcaggagttgcttcttatgaataagccaagaaagtggtttcttgagatggtatctacccctgctgaggatgctgtgaatatggttgacatgacaacaaatatggagaatattccctaaacttagtggataaggcagtagcaggatggagaggattggctccaatttggacataagttctactgtgggttacaaatgctacccacacagtatcatatgctaccaacgaatttttcattgacggacgaatccatggagccgcaaaatcactgtgcttattttaataatggccatcatcaaattcgcatcttaccgatccgcgcggttttcacattggatcactccccacaaattacttgaggcaagactagattttgcaaaattgacacagggctgttgcacattgtttcgcccgttttgtgtgaagcgcactttgggagaa

SEQ ID NO: 554193 - DNA, 584 bp, Homo sapiens
ggcgccatcttttggcggaaattgcagagaaatcgtgcccccccgggtgtgtccggtccatttcttcggcgggttccgccgactttgttgggggattgaccacgcgcccgcggctgtctttctccttgggtgtgggccctttcccccccaggtggctcagggggatgccccgcgtcaacggctctagctggtgtgcgggtctcggcgcaccggtgtagatgtggggtgagtgctgacaagctccccccttgggtgggaattcctagggcctttcccactagggagcacatgttggatgtgtcccacgctacctcgctctaccctgaaacagacgggttaaccccgatgctcatctatagttgcagcagtaagtaatagcggcactgaacgattgaatggggccccaataccagacatgtccaacacactgatggagccaaacaaaccaacaacttttgggttaggaggtggtttgaagatgatcttagagggcccccattgtcatcaagtgtgcccagtatcaggagctgcactagagctttcggggtccctccccaaattaaaccccaaaaggcccacataaa

SEQ ID NO: 554194 - DNA, 475 bp, Homo sapiens
attcggccataagggccggggataaaggtttcggccatccggttccaggcaatcctttaactgggctaagtttccaaataatgcttaatggcggattaaccatggggataatatccatctactaagaaatggtttaattttaaaataaattggctaacctgttggtttggaggctaaaataatgtccggtaaagggaaattaaccatattaaggaacccattattaaaaaggtgggcctaggttttttcccttaccatatattaccaggcttaacggaatttaattcagcctaaaaggtaataaaattttgggataccggttataaatccttggaaaccttggaatagcctataaaaggtatggaaaaggttggaatttaaggggattaaaagcaccattatcagaaccttcgggttaatacggaacctgggtggtggatgtcaaggaaaaaaaagatggtttggtaccacataa

SEQ ID NO: 554195 - DNA, 1108 bp, Homo sapiens
  misc_feature (833)..(834): n is a, c, g, or t
  misc_feature (878)..(878): n is a, c, g, or t
  misc_feature (976)..(976): n is a, c, g, or t
  misc_feature (987)..(988): n is a, c, g, or t
  misc_feature (996)..(996): n is a, c, g, or t
  misc_feature (1004)..(1005): n is a, c, g, or t
  misc_feature (1011)..(1011): n is a, c, g, or t
  misc_feature (1021)..(1021): n is a, c, g, or t
  misc_feature (1024)..(1025): n is a, c, g, or t
  misc_feature (1027)..(1027): n is a, c, g, or t
  misc_feature (1041)..(1042): n is a, c, g, or t
  misc_feature (1044)..(1044): n is a, c, g, or t
gagtctcttcagcaaaagctcagtccccagctttgagtcagagtagggaccatgctgtcccagcgttcaaggataaaaaccatcaggcccaagtgccatccgatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatgttaaagttccagattttgagctactattgctannagagtcccaggttatgtcctttgtcaatcccctttctggcaganggtccatttaataggactcctaagggatggatatctgagaatattcctatagtgattacaaccgaacctacagatgataccactgtaccagtatcagnagacctatgtnnagaaagtngtatgtgnnacattnactctggatntannanttgctgttctatannantcactatccggcttatcctcttgcatctgttattactagccatcattgtaaatcaggattctcg

SEQ ID NO: 554196 - DNA, 983 bp, Homo sapiens
gagtctcttcagcaaaagctcagtccccagctttgagtcagagtagggaccatgctgtcccagcgttcaaggataaaaaccatcaggcccaagtgccatccgatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatgttaaagttcctgtaatcaggcagttctgcctttccttcaggcttgaaaagtttaggatataaagcctctaaaagctccggatcattgctaagtgattgttccccgctagcggggaacaatcactttgtaaacttaccactattacatgaacacttaaaatgagttttactaccaagttaatga

SEQ ID NO: 554197 - DNA, 101 bp, Homo sapiens
gctgcagctgctgggcggcgccggcggttctttgttccggtggctaaggtcttcatctgcgccggcccggaccgcagccggggcccacagcagcggaacca

SEQ ID NO: 554198 - DNA, 1578 bp, Homo sapiens
  misc_feature (1303)..(1304): n is a, c, g, or t
  misc_feature (1348)..(1348): n is a, c, g, or t
  misc_feature (1446)..(1446): n is a, c, g, or t
  misc_feature (1457)..(1458): n is a, c, g, or t
  misc_feature (1466)..(1466): n is a, c, g, or t
  misc_feature (1474)..(1475): n is a, c, g, or t
  misc_feature (1481)..(1481): n is a, c, g, or t
  misc_feature (1491)..(1491): n is a, c, g, or t
  misc_feature (1494)..(1495): n is a, c, g, or t
  misc_feature (1497)..(1497): n is a, c, g, or t
  misc_feature (1511)..(1512): n is a, c, g, or t
  misc_feature (1514)..(1514): n is a, c, g, or t
cttttttatttttttttggccttgaatttttttaatttttcatccagttgagaattctcaagttcttggaataggggatttcataataaatataagggatttcaatttaagcttggaccattccccattatgttttaagaaggcttcttcctttaaataacctttctttttcatctgttcctaatctgaccctgctccaacaagggtgcccactccattactgccagggtgaatgtagaagttttgggttccctaattggctccacttaaacttgaggggagcctctttgttattgctggaaaaggacaggagttcagcctccccccgtagtcttcactaagactgcggagacaaggagctagttactggccaaaaggaatgaaagtcccaacttcccactcggtctctctgacaccaccctagtgggagtattggagaaacttgttacagcctcacagggtgaaattctgggctccccacaagatcttaacgtgggtgagagcgaagtcaaagtgttttctgtggtggttggctaaagtagcgcggccattgtctaaacattttctgtcttgcagaggcagctcctttcctggtcctttagctggagagaacagcctttcgttggagctttgtctgtctggacctcttggtgtttctgggttgccatcatcttcagcttcaagtctgagatttaggggcttgggatttttactcatatgaatattgttttacagatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatgttaaagttccagattttgagctactattgctannagagtcccaggttatgtcctttgtcaatcccctttctggcaganggtccatttaataggactcctaagggatggatatctgagaatattcctatagtgattacaaccgaacctacagatgataccactgtaccagtatcagnagacctatgtnnagaaagtngtatgtgnnacattnactctggatntannanttgctgttctatannantcactatccggcttatcctcttgcatctgttattactagccatcattgtaaatcaggattctcg

SEQ ID NO: 554199 - DNA, 838 bp, Homo sapiens
gacaggactcgctaagtgttcgctacgcgggctacccggatcggtcggaaatggcagaggtggaggagacactgaagcgatgagagccagaagggagtgcagggaatcatcgtcgtgaacacagagaggcattcccatcaagagcacatggacaacccacacaccacccagtatgccagcctcatgcacagtttcatcctgaagggcacggagcaccgtgcggtgacattcggacccaagaaggatctccaccttccttcgaattccggttccaagaaaaattgaactttatggtgtgccccagataaaagacttattcccgtgatggtggattcaagaaatccaaagcgattaaaggcacactctctgtggctccccgtgttgctcattcccttaattaaagtgccccccgcgaggaattggttaagtgttcaactccagtgtcaggcggcgacttaggcacactattggcaagtcgggttgtggaacccccatttcaagcaccaattccagtggaccgtgttgttgagaactgggagggactctttcgtccccccaacaaaagggaacccccccgttgtggttggcaccagaactttcccccagaagacttccgtgagaggcggccctacttccttcaatatcccaagggtttggggaggcaaaggaagcattggagtgaaagcccaggcaaccccaagatttccttttcgttggacgcttgcaagttccactttgtgtccgcccttgtgcgagaaacagctggttttctttaacctaaaattaaccaaagtggcaccacagaacactaacaaatatacacacaaaaacttttctg

SEQ ID NO: 554200 - DNA, 330 bp, Homo sapiens
aaagggctgggattacaggcctgagctaccatgcctggctttgtttctgtttaaagacaccttatttaatatatattcggttggttcattaacattgaactttactgacagcagcactattaactcatgcctgaactaagcttctctaacatgtattttctctgtgaggcatatcactatcttctgcactgaggaactctagacagcacttcagcactactgtgggggacattttatacagcaaatcatcatgaaagcatgacactaaatatactgcagaaggataacttgtttacagtatgccagctgaaacagaaggcagggtgttgc

SEQ ID NO: 554201 - DNA, 493 bp, Homo sapiens
  misc_feature (86)..(86): n is a, c, g, or t
  misc_feature (127)..(128): n is a, c, g, or t
  misc_feature (493)..(493): n is a, c, g, or t
ctcccctcaactcaccgcctcaccctacccaggacctgctgaaacacacacctgtggaccaccccaactacccgatgctgtagacnccctccatatctcccataactttctgtccaacatgaacgannagcctgaaactatccttcaaccatgatgataagaagtagggggattacaggtgtgcaccaacacgcgcagctaattcttgcatttttggtagagacgtggtttcaccatgttggccaggcccatcttgaactcctgagctgaggcaatccgcccggctgagtctaccacagtgctgtgattacaggcgtgagccgccgtggttggccccatatcactgctttaaacgaattagactacaaaatattacaaataaatttgtaactacaatacaggatagcaccataatagggacactaaattagggaataccaaggttccttgaaggtcttctactttaaaaaaaaaggtataataatttcaatan

SEQ ID NO: 554202 - DNA, 332 bp, Homo sapiens
tgtagattttccatgtagaaagaaccctagcatatacagtcatggcctctagcgggtagatgggcactgggccattgataactcacatttgatatggacacacattattttcctgagaaactcacaatgcacagtctccactcactgcccagccccaccctggccaattgtgctaagttcttcagagcatctgagtgtcaaaggtcttgtctggcgtaaggattgtttccagcaggcagctggagccccaatgtgccctctgtgttaccctctccgctctcctgtttctgtataggtatagctaagaatgctttttccatttttcagtggtt

SEQ ID NO: 554203 - DNA, 164 bp, Homo sapiens
ctgaccaggtgatgacagtttatttactttgatctattttactggtaggggagacaggttgagtgttgtggtgaaagcccatagtatatcagtaatggggatgatacaatcgtgccatgcagagagagaggttggcagagtcggtcagcatgcatcaacttcac

SEQ ID NO: 554204 - DNA, 384 bp, Homo sapiens
  misc_feature (148)..(148): n is a, c, g, or t
atttcttcctcctccccttggtgactcaaaagccttgggcatttctttttgcaaaggcccctgaatgggtttgggttcctgttagcataatgtgaggaggtggaaaaaaagcccacccttgggtccactgtgaccccggttcccaagntgacctgtgtttcctccccagtaatttttcttgttccaaaaaggggggggggggaggtccccatttctgtctcaactttatgggcactgagcgggaactttttacttcccccctgaaaaaaagaatttgaaaaaacatttgttttctcaaaaatttgctatgaaagggtgaggggttaattaaaaaaggcaattcctggaatgggaaaaagcaaaaaaagccctgagacccttcca

SEQ ID NO: 554205 - DNA, 225 bp, Homo sapiens
ccagtgatagatgttctacacataaacaggctaaaaccagatgactcaaaagaatcatataattgtataaatagacagccgtatttctcaatgctggtgtttaacaagatctgtgttccttgatcaaggtacctgtgaacacagacagcctgaagtgattcgcataatttctttctgttgcacacataccactggtggttctccttcctgccgaccgcggccgct

SEQ ID NO: 554206 - DNA, 390 bp, Homo sapiens
taatggccgttaaaactgctttccaaagggttttgaaggcggccctcttccccgatggcctagcaggtggaatttgcgaagctgccaaagccttaggcaagggccaagcccttttttgtgggcttgcatccccctgtattgggcctatgtttgcacagttgggggaggccctttgggctgagcgccttatcccccttattaaggttggggcaccaaaaaactaggagaatgggggggcctttgttaaattgccaaaaaggggaaaccccgtaaagtggttggttgcagttgggtggtagttaaggactatggcaaggggtcccaggcccaggatgtcattttagggtttttaaaaagcaaaaaataaaaaaataaatttttggcccccca

SEQ ID NO: 554207 - DNA, 452 bp, Homo sapiens
tgataagtgaatagactaaatttcaaatgtgttcctttttatatttctatgagagtcatgattttactttttttctgaaaattagcttttaacacacatatctccttatggatctgtgtagaaatttacttggagaaatttatcagagaatagcattgctggatgtgctgggcattactgatgttcatcaatattcaatccttgcctccttctggaaactcagagcgtacttccagcaatgtggctcattctgtccccaggctgggaatagccgtgacagtgtcattagtgggccaaagcaatgataagctatggtgagatccttatgccacacactctcttcccttgccacagtgactgccagtgttttagctcagggctggcaaactggcccgggggccacatcccactcaccacctgtttttgtaaataaaactttattggaaaaaaaa

SEQ ID NO: 554208 - DNA, 100 bp, Homo sapiens
caagtagctgtgagtacaggtatgtgccaccacacccggctaattctgtttattttttctgtagagacgaagtctcagtatgtgtccaggtggtctcaaa

SEQ ID NO: 554209 - DNA, 756 bp, Homo sapiens
gaaatcgctaggtaggttactatctggctaatccatgtcttatccttgacgaatttaattcatatttgggaaactttgtagggaaatgaagaaataaaagtcactgagtctgggtgagatgtcgttaagaatgaatgatgaagattccaggtttcaaacgtcttctcacgattaaaattgtggctgtgaactcttactgaaaatgagtttgtaggttcgtgtaagtggtaaaaatgtgctgtctatttgatggggccatttgtaccacaactaatcttgcctgtggtttactaagcatctgcctgcgatcccacagaggtactgtggtgtgccacaggagcttgaatagtcgagaagagtgggatttgatgccacggtagtggacgtggtacgtcatgtcctcagatgtgtacctcctgccgctgtatggaggggatgggggcaaacgccattcgtgacttacatcttgggtgtgtgacctatgtatggaacttacttgtactttttgccttactatttttaatgaagatgcaagattttctgtgatggggttctctctctcttttttcggggggtggagtcactaaataaagtttgcaaaaatagtttaagacaaggcaacatctggttatggtatatgatacttcatttaaagaagaaaggcaaagcgaatgccttgcaagttttgaggttcaggaaaaatgggattgggtctcttcgaaggtgaatattccagggatttttattaatctaagg

SEQ ID NO: 554210 - DNA, 934 bp, Homo sapiens
  misc_feature (51)..(51): n is a, c, g, or t
  misc_feature (62)..(62): n is a, c, g, or t
  misc_feature (68)..(68): n is a, c, g, or t
  misc_feature (95)..(95): n is a, c, g, or t
  misc_feature (103)..(103): n is a, c, g, or t
  misc_feature (106)..(106): n is a, c, g, or t
  misc_feature (132)..(132): n is a, c, g, or t
  misc_feature (138)..(138): n is a, c, g, or t
  misc_feature (166)..(167): n is a, c, g, or t
  misc_feature (170)..(170): n is a, c, g, or t
  misc_feature (181)..(181): n is a, c, g, or t
  misc_feature (185)..(185): n is a, c, g, or t
  misc_feature (196)..(197): n is a, c, g, or t
  misc_feature (203)..(203): n is a, c, g, or t
  misc_feature (206)..(206): n is a, c, g, or t
  misc_feature (232)..(232): n is a, c, g, or t
  misc_feature (250)..(250): n is a, c, g, or t
  misc_feature (293)..(294): n is a, c, g, or t
  misc_feature (303)..(305): n is a, c, g, or t
  misc_feature (311)..(311): n is a, c, g, or t
  misc_feature (313)..(313): n is a, c, g, or t
  misc_feature (319)..(319): n is a, c, g, or t
  misc_feature (325)..(325): n is a, c, g, or t
  misc_feature (330)..(330): n is a, c, g, or t
  misc_feature (335)..(335): n is a, c, g, or t
  misc_feature (344)..(344): n is a, c, g, or t
  misc_feature (352)..(353): n is a, c, g, or t
  misc_feature (359)..(359): n is a, c, g, or t
  misc_feature (373)..(373): n is a, c, g, or t
  misc_feature (379)..(379): n is a, c, g, or t
  misc_feature (385)..(385): n is a, c, g, or t
  misc_feature (392)..(393): n is a, c, g, or t
  misc_feature (469)..(469): n is a, c, g, or t
  misc_feature (487)..(487): n is a, c, g, or t
  misc_feature (580)..(580): n is a, c, g, or t
  misc_feature (636)..(636): n is a, c, g, or t
  misc_feature (768)..(768): n is a, c, g, or t
  misc_feature (800)..(800): n is a, c, g, or t
  misc_feature (812)..(812): n is a, c, g, or t
  misc_feature (821)..(821): n is a, c, g, or t
  misc_feature (852)..(852): n is a, c, g, or t
  misc_feature (923)..(923): n is a, c, g, or t
ttctaaaaccccccaaaataaaaaaaaaaaaacaaaataaaagaagcaaanaaaaattctanaaaaanaagaaaggaacagtttattaaaaagtntaaaaaanctntaaaatcctttaagtatatggaaatnttcttnaaacttcctcgtcaaacgtcgtaccganntcntcctcctcttntgcngtggcatcctnntacttntgntactcatagacgagtgttcgttcatnttgctctcaccctcggtnaactccatctcgtccatgccctcccctgtctaccagtcgaggnnggccttccnnnggttcntngcagtnaactgntccgngttgngctttatgntctcctgnnttgctnttctatttccaatnaaggtnacttcnatctttnngccacgagatgggatttcacagacggctgtcttgacatttttggggatccattccacaaagtagctgctgttcttnttctgcacgttaagcatntgctcatcgacctccttcatggacatccgaccacggaagacagcagccacggtgaggtatcggccgtggcgggggtcacaggcagccatcatnttcttggcatcgaagacctgctgggtgagttccggcactgtgagagctcgatactnctggcttccacggctggtgagaggggcaaagccaggcataaagaaatggagacttgggaaggggaccatgttgactgccaacttgcggaggtcagcattgagctggccagggaaacggaggcaggtggtganacactcatggtggctgagacaaggtggttcanatccccgtagtntggtgtggncagcttcagagtgcggaacagtatatcatanagggcctcgttgtcaatgcaataggtctcatcagtattctctaccaactgatggacggagagggtggcatngtagggctcga

SEQ ID NO: 554211 - DNA, 592 bp, Homo sapiens
aagggatagtcaaccatcctcaatcaagactgagatccaaaacagcagcgtgctttcctacaaggaaagacatcaaggaactacgtgagtctgaagggtgacataatcaaccacaagaaacatgttacggtttagcctggcacagaggtgtcatgcctgcggtcccaactactggagaggctgaggtgggaggacgtgtttgggcccaggagttcagggaacagtcgcggaaatataatgagactctgtcgtctaagaatcgaaaattagagaaatataaaaattataaagattaaaacacagaaaagtgtcatgatagctcaggttgtcagagaggatgctgcagtagtctgggaaaaaagtgaagtgacagtcaggcctgacagaggactaaagggtgatgatgaagaggctgagctgtagagctcagcctggaccacaggaggggtagttgagttcacagagggatactgccatataagctggttgtgaatggggtggtatgaagaccgatgactagtatcctctccaggttacaaataacatgaaccaaactgtgtaatgtgatactaatatgcagaataaagtatat

SEQ ID NO: 554212 - DNA, 108 bp, Homo sapiens
tgggtatcacatacagtttaatattatactcctaaaatttaacaacagaaagacaaaaaacccagttaaaaaaaatcaaaatactcaaaacagacattacttcaaaga

SEQ ID NO: 554213 - DNA, 112 bp, Homo sapiens
acgtctcacgcttatacttctcacgcttatacttctcaacgctttatacttctcaacgctggatacttctcaacgctttatacttcctcaacggtgcgccgtcgcctacgca

SEQ ID NO: 554214 - DNA, 123 bp, Homo sapiens
cagaggaggtggacagcacagaggaggtggacagcacagagggagggcacagacctgggccacgggtaggaaaatcagcatcctactctctcctcaattccatctgttaatccacctcctctg

SEQ ID NO: 554215 - DNA, 272 bp, Homo sapiens
ggcaaataatgtatgaggcgattagaaagtgtaccctggcgcaatagtatatagtaccgcaggggaaatgatgaagaaattataaccaagcatcatatagcaaggactaaccccatataccttctgcatcatgaattaactagaattaactttgcaaggatagtcaaagctaatacccccgaatccagacgagctagctaagaactgcttagagagcacacccgtctatgttgcacaatagtgtgaagattcataggtagaggcgacgaacc

SEQ ID NO: 554216 - DNA, 211 bp, Homo sapiens
ttttgggggtccccccgggggcgccggtttttttaaaagggcacctccggagatttttttcttttttctccccggccaggggggatttaatccccccccttggggtccccctttggggggtttttaaaaccgctttttttttagccaatttgggggttcttttaaaaacggggaatgggaaaaaaaattatttttttccccatccttccca

SEQ ID NO: 554217 - DNA, 755 bp, Homo sapiens
gatagacctaacaccaaacccactccagcttaataccagtacaagcttaggcgaaccatttacccaaataaagtataggcgatagaaattgaaagctggcgcaatagatatagtaccgcatagggactagatgatcaactgatatacgccgagcataatatagcaagggactaacctcacgaataccttctgccgagtaatgacttatctagagaaataacttgcataggagaaccaacaggtatgagccgccgaaaccagacgagctacctaagaacagctaaaagagcacacccgtctggtgtgagcaaaatagtgggaacgattggtaggtagaggacgagcgaacccgtaccgagcctgggtgttaagcctgggtatgtccacaggataagagatcttcagattcaacctcttgaatttgcccacaagaatcctgctacaagtccccttgtacagtcttaactggtgcagtccactgaggaacaggctctttgacactaggataacccaccgttgtagagatgagtgaacaaaagtggaaccacccatagttaggcctaaaaagcaggccacaatttcatgaccacgcgttcaagctcatagccataagctaaattaaattcgcagacatgtgactgagctcctcacacgcaattggaccgtctatcaccctggggcacgaactagggtaagaatcgggcagatggaaacattcgctccgaaaagccaggttaggattaaaccctgactga

SEQ ID NO: 554218 - DNA, 150 bp, Homo sapiens
actcaagaggatacccaccaacgaacggtgacccaaccccaacaccaaccggcacaccgagtacaaccctgacacccatacaccaccaccactatggtgaccccaaccccaacacccaccggtgcaggtagtagtgacgggtaccgagct

SEQ ID NO: 554219 - DNA, 1009 bp, Homo sapiens
tggactagtcttttttaacagtcattaatattatataggaatatgggtgtacatataggaagagaacaggttctggtattatagtcttttaagataaacttgacaaagttaactgaaatttatctggtccattttattcatgctactacgatgggaatcatttaaacacaagggtcagcaagcttggacccatggactggccacctgattacgtaaataaagtttactttgaaacaagcctacagctcattcatttatgatttgtcatgtggttgcattatccacaacatgacagagttgtatggcttgcaagatctaaaaacagttatactatttggccctctcaagacaaagcttaagacaccatagatctaatggacctatgtagggaaaaaacaaatacacataacctcagtaatcaatttatatccagttatgagctgcataactgtaatgctataggtcacagggttaaggtagaaataaatattcagcactgactaaactgttctaacatcctcaaaagaaagtaacccaaacaacatgcctcctaacaaacatttacctatctataacaagaggtatgaaacaataagataggggataacacagtgtgaaatctagaaaattccaaatggatacatttagaaatgtaaattaagaatagaaaagaatggacaggaatgaacattaagatgtaacaatgaaatgtacagcaaaatagtaataaagaaccatagaaaaatgaaatgggaaaaaagcaacaggtaaaacgacatcacaacatccaaaataacataacacataacattaagggaacaccaaaaggggcagaaaacaacactaagcaagggcaaaaggagaccaacaagtacgcaaagcagggagatcagaaagaataagaggggaatgaaaagagaagaagacaagaagacacacagaagacaacaagggaacatgagacacaaaaaaacacaaacaagaaagataacagaaagacaaaagacaa

SEQ ID NO: 554220 - DNA, 774 bp, Homo sapiens
ctactttatgtaacattacagaacagctagaggtcctggggtaagagaaaaaaagcacatcacaacaaatgtgaaagccttcattattacacgttccagttgtctcgctgtgtaggcataagctaatggtttattttcagaaagctgcctgaaacgttgcttggtattcttctaggaagaactttaattcctcctgaggaactctactttctgagccaaactgctaattttctgcggaactgtctagaagatcattcaagagaccctgcagtgcactttctcgtaaaagttaaaaaaaaaaaaaaaaaaaaggggttttcccggggccttgggaacatttgggcctatgaagaagtttgggcatatattttatactggagttgagaacaactttagataatccatatttatactatccgcagaaagccattggggcaaagcgttcagcccattagcactcatttaacccggggttagcaataattctttgtgaaaacagggtgccagtccttatgtggtgataaactaagaaagccccatgggaattttaaaagtgtggtgtaggatgtgaaaccaggtggaccttatattatggccgagagggaatttgcagcattaacgttcctaacgggggccaaaaccaagagaaagggttccagcaactttcgatgacacgtagttgggccacatggtcaggccaatttggtgtggactatttatggtacctttttcataactgggattggcaaattaagctggggagatctaaatgag

SEQ ID NO: 554221 - DNA, 358 bp, Homo sapiens
cttccagagttgggaaccagccggctggccgcatccagaatctcctgcgttctgatgtcgtgcccagtacagcatcagaatttccgctgcctgtgcactcctgaaaagggctttggcttttagggaagcagcttccaccgcattatcccccagttcatgtgcccagacggtgatttcacaaaccacaatggcactgggggctagtccatctataggaagaagttcgatgatgaaaacttttatcctcatagcatactggaccaggtcctactatccatggccaactcttgccctaaaaccaattgctctcaattctttctgacatttgacaagacatactggcttgataacaagcctt

SEQ ID NO: 554222 - DNA, 162 bp, Homo sapiens
tacgacacaggactattaagagaagtataaactgagatggctgttatactacgtgcctcctctttgctgccagaatacgaatgaacgactgaaactcaagtagcaatttcggacaggaagtaagattaacactgggagctatggaccaatggtggagcaata

SEQ ID NO: 554223 - DNA, 468 bp, Homo sapiens
  misc_feature (59)..(59): n is a, c, g, or t
  misc_feature (70)..(70): n is a, c, g, or t
  misc_feature (72)..(73): n is a, c, g, or t
  misc_feature (78)..(79): n is a, c, g, or t
  misc_feature (83)..(83): n is a, c, g, or t
  misc_feature (101)..(101): n is a, c, g, or t
  misc_feature (111)..(111): n is a, c, g, or t
  misc_feature (113)..(113): n is a, c, g, or t
  misc_feature (117)..(117): n is a, c, g, or t
  misc_feature (124)..(124): n is a, c, g, or t
  misc_feature (133)..(133): n is a, c, g, or t
  misc_feature (145)..(146): n is a, c, g, or t
  misc_feature (151)..(152): n is a, c, g, or t
  misc_feature (155)..(155): n is a, c, g, or t
  misc_feature (168)..(168): n is a, c, g, or t
  misc_feature (193)..(193): n is a, c, g, or t
  misc_feature (213)..(214): n is a, c, g, or t
  misc_feature (218)..(218): n is a, c, g, or t
  misc_feature (221)..(221): n is a, c, g, or t
  misc_feature (229)..(229): n is a, c, g, or t
  misc_feature (242)..(242): n is a, c, g, or t
  misc_feature (254)..(254): n is a, c, g, or t
  misc_feature (259)..(259): n is a, c, g, or t
  misc_feature (262)..(262): n is a, c, g, or t
  misc_feature (284)..(284): n is a, c, g, or t
  misc_feature (297)..(297): n is a, c, g, or t
  misc_feature (303)..(303): n is a, c, g, or t
  misc_feature (329)..(329): n is a, c, g, or t
  misc_feature (334)..(334): n is a, c, g, or t
  misc_feature (405)..(405): n is a, c, g, or t
  misc_feature (423)..(423): n is a, c, g, or t
tgctgacagaaatagttgctgtatggtcgtacttttaactctagtatcctttgcttctncttaccccctntnntaggnnaatnctcccacagtggtctgtntctcaacatntncttnttaaagnaaaaaatanatatatatagtnnctttnnatngatcaggtctgtnaatgtgtactaaaaaaatcagagtntatttataaacagaatagtnnattnaanggagaagntctcttccttatngatatcatggtntgcantanttccatttgttactattgtgcncaaaagccctgtncacagnggaatggtgtaaacatttatactgtnttgtncactgtatttagtagacataactgtcatctagtagacataactgttgaatagttactgaatcatgatgtanagaatatgtgaccatctncaggtatgggatttctgaacgtttcaaatttcaatcaatgagcac

SEQ ID NO: 554224 - DNA, 212 bp, Homo sapiens
tctagaggatcccgaaaatgcatagaggcaggggctgggaggaggggaaaatagagagatgtcaacagatgtagagtttcagtcatgcaagatgaaaacattcttttttgtttgtttgtttgaaatgaagtctcactctgtcacccaggctggagtgctgtggcatgatattggttcaccacaacctcagcctcctgggttcaagcgattct

SEQ ID NO: 554225 - DNA, 529 bp, Homo sapiens
  misc_feature (20)..(20): n is a, c, g, or t
  misc_feature (51)..(51): n is a, c, g, or t
  misc_feature (61)..(61): n is a, c, g, or t
  misc_feature (93)..(93): n is a, c, g, or t
  misc_feature (110)..(111): n is a, c, g, or t
  misc_feature (181)..(181): n is a, c, g, or t
  misc_feature (291)..(291): n is a, c, g, or t
gggtaaactggcggtatgangaaataaagggattcattatgggcacctgtngggaaaagcntgccggattctaatgatctgaattaaatcggncaactccaaattatggnnagttatctagtcctacaggtaccttttaatgggatgtttcagctgcttaaggctatattcctttaaattnggaaaaacaagttatgtgatgcttattactttcttattactttcataacctaaaaactgtgttattagtaaccgcacactagtctctacactgagtgtacatattcaagngcttgatcttgttgtcttgttcaaagtaattggtaaagaggaagtcaaactgttgctgtttgctgatgatatgactctatacctagaaaacactaaaggctactccaaaaagctcctggaactgataaaagaattcagcaaatttccagatacaaaattaatcagtagcacttctatacaccaaaagcaaccaagcagagaatcaaatcaagaacttaactccttttacaataactgc

SEQ ID NO: 554226 - DNA, 448 bp, Homo sapiens
  misc_feature (59)..(59): n is a, c, g, or t
  misc_feature (70)..(70): n is a, c, g, or t
  misc_feature (72)..(73): n is a, c, g, or t
  misc_feature (78)..(79): n is a, c, g, or t
  misc_feature (83)..(83): n is a, c, g, or t
  misc_feature (101)..(101): n is a, c, g, or t
  misc_feature (111)..(111): n is a, c, g, or t
  misc_feature (113)..(113): n is a, c, g, or t
  misc_feature (117)..(117): n is a, c, g, or t
  misc_feature (124)..(124): n is a, c, g, or t
  misc_feature (133)..(133): n is a, c, g, or t
  misc_feature (145)..(146): n is a, c, g, or t
  misc_feature (151)..(152): n is a, c, g, or t
  misc_feature (155)..(155): n is a, c, g, or t
  misc_feature (168)..(168): n is a, c, g, or t
  misc_feature (193)..(193): n is a, c, g, or t
  misc_feature (213)..(214): n is a, c, g, or t
  misc_feature (218)..(218): n is a, c, g, or t
  misc_feature (221)..(221): n is a, c, g, or t
  misc_feature (229)..(229): n is a, c, g, or t
  misc_feature (242)..(242): n is a, c, g, or t
  misc_feature (254)..(254): n is a, c, g, or t
  misc_feature (259)..(259): n is a, c, g, or t
  misc_feature (262)..(262): n is a, c, g, or t
  misc_feature (284)..(284): n is a, c, g, or t
  misc_feature (297)..(297): n is a, c, g, or t
  misc_feature (303)..(303): n is a, c, g, or t
  misc_feature (329)..(329): n is a, c, g, or t
  misc_feature (334)..(334): n is a, c, g, or t
  misc_feature (385)..(385): n is a, c, g, or t
  misc_feature (403)..(403): n is a, c, g, or t
tgctgacagaaatagttgctgtatggtcgtacttttaactctagtatcctttgcttctncttaccccctntnntaggnnaatnctcccacagtggtctgtntctcaacatntncttnttaaagnaaaaaatanatatatatagtnnctttnnatngatcaggtctgtnaatgtgtactaaaaaaatcagagtntatttataaacagaatagtnnattnaanggagaagntctcttccttatngatatcatggtntgcantanttccatttgttactattgtgcncaaaagccctgtncacagnggaatggtgtaaacatttatactgtnttgtncactgtatttagtagacataactgttgaatagttactgaatcatgatgtanagaatatgtgaccatctncaggtatgggatttctgaacgtttcaaatttcaatcaatgagcac

SEQ ID NO: 554227 - DNA, 111 bp, Homo sapiens
tacagcagacacagcagccaactgatgattaattataaaagccaaccagtcaaccaatcatcgagtagcaaaccacgtatgcggtctactaatcaatctatctaggttact

SEQ ID NO: 554228 - DNA, 529 bp, Homo sapiens
atctattgcacgaaaatacataagtagcaaaaataagagtgagaactcccactgataaaaagtgagagtctcaaagaggggaaatgagggaagagagagaccctctcatattgttttatattgttttatactcagtacctcttttaagaaaaaaacaacaaggaagtagaaccaaagacaagcagcccagcgccaggcccaaaaccaggcctgggcctgcctggcctaaacccagtagttaaaaatcaactcataacttagaaactgatgttattcatagattccagacattgtatagaagaacattgtgaaactccctgccctgttctgtttctctctgaccaccggtgcatgcagcccctgtcacataccgcctgcttgctcaaatcaatcatgaccctttcatgtgaaatctttagtattgtgagcccttaaaagggacggaaattgtgcattcggggagctcggattttaaggcagtagcctgctgatgctcccagctgaataaagcccttccttctacaaaaaa

SEQ ID NO: 554229 - DNA, 930 bp, Homo sapiens
gtgagtcttctgcatatggctagacagctgttccagcaccatttattgaattagggaatcctttctctgttgcttattttgttaacttgtcaaaggtcagatggctgtaggtgtgtagctttatttctgtctgttccattccattggtctatgggtctgtttttatatctgtaccatgctgtttggttactgtagcttccttatagtatagtttaactcaggtaatgtgatacctcagctttgttttatttgcttaggattgattttttggttccatatgaattttagaatggattttttcttttttttttttttggaaagggagctctgtgatgtgtcttcccaggctctgagtgcagcggttgcaatctctcagctcacgtgaacctctttgcctccgtgagttcaagcaattctccgtgcctcaagcctcccaaatagctggggattacagggagcccgccaaccagtgcccagctaatttatgtaatttcagtagagagggggttcaatcatcttagccaggcgggtcttgaactcctgacgttgtgatccacccgcttaagctcccaaagtgctggggatcacaggcgtgagccatgggacccgggcagggattttctaatcctgtgaacaactgactgttggtacgtttgataggaatagccttggaatctggggatggcttggggacaggtggggccatttaaggatatgggaagtcttcaagctcaatgacctgggaatgttttcacatttgttgcgtcaacctaggattctcaccaggaggtaagaagttctggcccaagatcacatttatatcttcacaaattggagtaggccccttccagaatggatcacccaggggcggccttaggtctcctataagattttgggtttggcctcaaaacaattcattttttaagataa

SEQ ID NO: 554230 - DNA, 119 bp, Homo sapiens
cctcttttcccacaactgatagttttcaggcaaaggtcactttggaataggatgaccctgggaagacattgacagaagaggtgtggcttgggctgaaccctgaagaaaagagtgcttgg

SEQ ID NO: 554231 - DNA, 666 bp, Homo sapiens
gtcccctgtctgaggagggaggaggcctctgtctgaggggggaggatgccgctgtctgagagggtaggaggaggcctctgtctgttgcaagaggaggcccatgcctgatgatgatgccgatgacctgatgccctgccagcgtcagccagagaagacccagtcctgactagtcttaggatctccctagacccttctcaactgcatcaccagtcatggacgctgctcctgcccgatgccagtctacgaccttctctgacccctgcgctatccttcccatcccctctggtataacgcaccctagcccatcacctcgttcataccaccttattacctcccctcttactgttcactctcctcattccgcactcttccattcccttcctcctgactcttcaaccttatctctctactacatcctaccccttctcctttctcaccccgctcccctcccctctcctcaattccttcccctcgcaccacttctctcaatctcctgacctctcacccctctcctctacacacgcctcctacccccccccttctcactacctccctgttattcatctccccctccctctctccttcctttccccctcttctacccatctcattcctctcttaccccccgccaccccactttcctcctacctctctccctctattccg

SEQ ID NO: 554232 - DNA, 644 bp, Homo sapiens
  misc_feature (1)..(1): n is a, c, g, or t
naacaaactgtcctttgcccgcttgcaatttagccatggcccgtttcataaacgcctcgtgggtgccctctgtgtttacagctttcacaccacagacacccagtgcttgcgcttacagggccggtccataagagaaacttagttcacagggctttgatagagcgcaaaggttgatagcattgaggttaagagtggcatcctcttcactcatgccaccagacaaaacgcaaatgccaggaacagttgcaggcacagtacggtgaagagctgttacggtggccatagctacttgttctgaagtatacttcttggtgcaggcatgtccagcagtcaccatgttgggcttaagcagggtgccctccaggtaaacatgatggtcattcaggcccttgtagacagcagccagcaccttctcagtaacatactgacagtgttccaggtcatggtctccatcaggaattacctgtggttcaacaataggtacgtgaatagcgaggctgaatggacactggtcggcaatcctcagcacagcacgccacttcccaaagtcaacaccatctttcttgtactgagcacagcgctctgagaggccatcaagcccttgaatggtggtttctgtgtgtgctcctgcaagaggagcacct

SEQ ID NO: 554233 - DNA, 394 bp, Homo sapiens
  misc_feature (211)..(211): n is a, c, g, or t
  misc_feature (346)..(346): n is a, c, g, or t
  misc_feature (354)..(354): n is a, c, g, or t
  misc_feature (374)..(374): n is a, c, g, or t
aacaacaaaagcactggaggggctcaatagttagttagtttgtcccagacccttctagaatattgagatcctggacagtgcttctgagaaacctgcagtctctgtccaaggagcccttaaggaagaaaggcaggagtgtggggcaggaagaccggcttcccctttccattccacacggctggctcgcaatattctgtttctcctgcgacanctgggttcctccctgctccccagctcgcctttgccaccattcttccctcagtccagatcaagagttcaaggggacgggggacagatgatcagaaaggcccagttcagggcaagggaagggggagaaaaggggaantcgtattntggcggttgggttgggattnggaaagttagttaccattca

SEQ ID NO: 554234 - DNA, 109 bp, Homo sapiens
  misc_feature (24)..(25): n is a, c, g, or t
  misc_feature (28)..(28): n is a, c, g, or t
  misc_feature (39)..(39): n is a, c, g, or t
  misc_feature (42)..(42): n is a, c, g, or t
  misc_feature (60)..(60): n is a, c, g, or t
  misc_feature (68)..(68): n is a, c, g, or t
  misc_feature (88)..(88): n is a, c, g, or t
  misc_feature (94)..(94): n is a, c, g, or t
  misc_feature (100)..(100): n is a, c, g, or t
gggcataacagggagagtggaaannttnaaagacaaagnggngcattgagaaagaccatntggcaagnaaaatcccatccaaaacatnaccganttttancaagcccaa

SEQ ID NO: 554235 - DNA, 152 bp, Homo sapiens
ggagtacgacttgactactcgcatcgcactttttggatcgtccatctagtctatccgcgttcttgaatgttctctcgtgtaaaggagcatatataatgaaaaaggaattattacaaggtgaaattcggaccttctttagtcgataccaacaa

SEQ ID NO: 554236 - DNA, 184 bp, Homo sapiens
cattcggctatatgcgggttcagaaagcttcccaatagctgaacatgtggaggttcctgggagagtggtgtgcccatggtagggcatggaagcttcaagcctcttcccctcataccttgaccctagcgtatcttctgtctagtatttttatccatgtataagagcaataaactaggtgaactaa

SEQ ID NO: 554237 - DNA, 276 bp, Homo sapiens
gcccacgcgtccgctgagccgccgccgaggattcaagcagcctccctgagcctcgcttccgacgtcgttccctgccgctctccgcacgcgcgcgcttcgaggcgttcacgagaacgaatcgtatcgatgtcgctatcagaacttcatcttcgaccctttgcctgatgcagtaggtgaatgactgctctgctgatgggaatatatccatatagaatccagaaaggagagagaccttacatgtccaagggatccgatgatacgataaactagtggagc

SEQ ID NO: 554238 - DNA, 131 bp, Homo sapiens
ggtcgacggggattcaaaggaagagtaggtttgaaaacgagttcagttttaaacataatgaaagtctgaagtaacgcatgagataccccaggtggttgaacctagtggggtttgggtgctcagcccagcta

SEQ ID NO: 554239 - DNA, 381 bp, Homo sapiens
taaaatttccaaaacccggattccttttttccttccaagggtccacactccctcgccagcagggggaacaaaactggatggagaatgaattgacagaagtaggcttcagagggtgggtcgttacagactcctccaagctaaaggagcaggttctaacccaatgcaaggaagctaagaaccttgaaaaagggttacaggaactgctaactagaataaccagtttagagaagaacatatatgacctgatggagctgaaaaacacagcacgagaacttcgtgatgcatacataagtatcagtagccgaattgatcaagcagaaaaaaggatatcagagattgaagatcaacttaatgaaataaagcgtgaagacaagattagag

SEQ ID NO: 554240 - DNA, 404 bp, Homo sapiens
ctcccacgcggttacgaagactcctgttgtggtgatgatggatctagactgtattaacacctgttgccaaaataccagcaggaaggttatattttatatagctgctgtaagagtctcagagtttaccttaatgtaacaacacttggacaaactccgccatattaacactatgtattagattgtagtaggtttagtagaattagccaattcactgtggttaaagtgctgtccagaggcctgtctttacaggtgccacatttgagctgccctgagatttcagctgtgaagatggcagcacaccctggggtgtgtaggttctgctgtcatccaagcccagagacaagtccttcctgggggctttaattgtggaaacatcatcagtcatgcacatctgcttctgtggg

SEQ ID NO: 554241 - DNA, 306 bp, Homo sapiens
  misc_feature (4)..(4): n is a, c, g, or t
cggnttgctgtgagtaagcaggagataaaggtacatagtatataatcccacttataagtaccaaagcaggaaaaactagtccatattgtcaagaaagtgattacccttggaagacagtggcagcaagcaagcatgagggggcttcagatggtgctagcagatattttttttgtttttttgagacagagtctcagctctttccccaggtctgagagtacagttggcgcatatctcgtgctcacctgcaatcctctgccctcccaaggttcaaggtgattctcctcgcctcagcatggctgcaaacga

SEQ ID NO: 554242 - DNA, 677 bp, Homo sapiens
ccaatgacgcagacctgattacggcgagaattgcgataatcagcggatcaccgtcagcaagctgtaccgattgcacaatgtcatcaggatcaagttactgatggataactggatctggtccgtgtctatcaatgaacacacgagcattggtaacattctagtcgactctgtgcatagccggctgatgatcatgccagagcatgatcagacacgttactatgagcgaaccaggatcatgtcatcacgttgctatcagatacaacaatgttcacgtgactcgtggtaacaatggctccttgcatgtaggacgtcatcatctgtctagacagtgacctgcgcacgctgtacattatcatgctcgcataggttactagagcatccagagtcgtcatgctgacactaggccttgtagcaggctgagatgctacggatattgcctgctaggcatcagccgttcataacaagcagctgcaagttgatccgcagatttgcctagtatgctgatcagacagtcagatactgacgagtgatgatctatcatgcacatactgtgatccgtgcaactttgcatagtcacgttgtagtattgttgagactaatgtaccagaccctaggcacttaagaataccgtataaccattgtcatactactattactgacgaccgcatcgagacccc

SEQ ID NO: 554243 - DNA, 116 bp, Homo sapiens
caccatggtgatcaaggtgctcctggctccgttggtgctgctggtcctaggggccctgctggtccttctggccctgctggagaagatggtcgcactggacatcctggtacagttgg

SEQ ID NO: 554244 - DNA, 254 bp, Homo sapiens
ccgagagtcagagacagctccggagagcagagggggattccagccatttgtgtgctacctgggggcttccacttctcatttggtgttggtgcttttcgcctttggctttttcaccacctgtcttcaattgcccatgcagcctttccgcctggggtacatggtgtcggatcgtgggccatgggtcaccgcacgcctccacggtggcacggcttccctcattccgtgtggctcgccaatcttcttcattttgtggg

SEQ ID NO: 554245 - DNA, 117 bp, Homo sapiens
attttctagtactctaaggatccgagtactgttctcgtgtgcctgagtgcatgaagcttttgcagagctgcagacggacatcaatgagctgactaaccacatagacgaggtgcagat

SEQ ID NO: 554246 - DNA, 242 bp, Homo sapiens
cgcggtaatacggaggattcgagcgttatccggatttattgggtttaaagggtgcgtaggtggctgattaagtcagtggtgaaaagctatggctcaaccatagtcttgccgttgatactggttagcttgagtgtagatgatgtaggcggaacgcgtagtgtagcggtgaaatgcatagatattacgcagaactccgattgcgacgccagcttacttcgtacacacgtgtaaccggagctcga

SEQ ID NO: 554247 - DNA, 151 bp, Homo sapiens
gagtgttgcgaggtgatctagagatccccgatttcaggtctggttggtcgaggcagatggagctggtataattatgcctcatagggatagtacaaggaaggggtaggctatgtgtttggtcaggggggttgagaaatgagttgtagaggcg

SEQ ID NO: 554248 - DNA, 164 bp, Homo sapiens
cctttgcccagacacccggcctggaggtgccgggacctttgaacgacaagattttggtggcaaaagctgccctcggtggtgggtgggggacctgggtttgggtgggggtgggccggcttattttgctctcattaaatatttgaaattttcccaaaaaaaaaaaa

SEQ ID NO: 554249 - DNA, 383 bp, Homo sapiens
tgattctgtgttcacatccacagtgtaagctgtgatatggtttggatgtttgtcccctccaaatctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctcactcccgctctcaccatgtgacacacctgctcccccttcgccttccaccatgattggaagcttcctgaagcccttaccagaagcagatgccagccccacacttcctgtaccacctgcagaaccataaaccaa

SEQ ID NO: 554250 - DNA, 106 bp, Homo sapiens
cctgcatatcaggaactttaatatctaatgttttgaaagtatttgaacctctttgaatttgtaaacgcctttctagtaatacctgtttgatatagtaattggattg

SEQ ID NO: 554251 - DNA, 91 bp, Homo sapiens
ggggtttttcccccccccccccgggggggcctttttttggggggattttaagggggttcaaaggggccaaattaatttttttttccgggga

SEQ ID NO: 554252 - DNA, 269 bp, Homo sapiens
  misc_feature (8)..(8): n is a, c, g, or t
ggtgcacngcaggtagttaccacagtttagctttgtattgtctcttggtacttttctttttctttcctttcctttttttccttgcggagatggcagctttgtttgcggcccaggctgttttggaattcttggcctccagcaatcctcccacctcggcctcccagggtgctgagatcccgggcttgaccctaccacacccagcctagatgttatttccctaaaggttagtctccatgtgacgagacctgctgtgccggggttaccgagct

SEQ ID NO: 554253 - DNA, 263 bp, Homo sapiens
  misc_feature (240)..(240): n is a, c, g, or t
ggtcaaccgaatggggttccatcaaggcgactgggcccaaataaccgggggtccccgtagctttaccacatttcttggggcgctttcgggtcttggcccgtcgctcctatcttggcatatcccttgcttcgcgcttaaatcacacggtgtggacccccccgttctatggggtggaaacaggtttaaacgccgttactctttggacaccgggcggatcttttttttgagatttttctcacnacacccgttaagggagaccccgg

SEQ ID NO: 554254 - DNA, 403 bp, Homo sapiens
tgcccattatggccggggggggacaaaaaaaaaaaaaaaaaaaaaaaaaaaaaaacacgtgggcgcggcgcgcgccgcgcgcggccccgcgaaaaacgcctttacaaaacacacccgcgcggggggcgcggcgggggccccagtggggaaaggggaaaacggtgggccaaaaggcgggtgttcccataggggacacccgcggggccaagagaaaagggggggggagatttctccacccacaaaaaaaaaccgcccgggggagaaacccgaagggtgttttgagaacaaattccacaaagggggagatttgagagagggttctttgaggggaatttttattaaaggaggaaccccaaagggaaactgcgaaatttaaatttaacccccggtcgtgtgggtggat

SEQ ID NO: 554255 - DNA, 438 bp, Homo sapiens
  misc_feature (391)..(391): n is a, c, g, or t
tgaaatccaggctgagctggtctcagatggagatgaggaacttgttgggaactataaaagttgttcttactatgctctaaccaagagactggcagcattttgcccttgccctagagatagtgaaactttgaacttgagagagatcatttagggtgtctggtggaagacatttctaagcagcaaagtattcgagaggaaacagagcatgaaagtttggaaaatttgcagcctgacaatgtgatagaaaaggaaaaacccattttctggggagaaattcaagccagctgcagaaatttgcataagtaatgaggggccgaatgttaatcaccaagagacaatggggaaaatgtctctagggcacggcagagacctttgtggcagcacctcccantaccctagaggcctggggggagaaatggtttagtgccgcggcccagg

SEQ ID NO: 554256 - DNA, 293 bp, Homo sapiens
  misc_feature (67)..(67): n is a, c, g, or t
tgacgctgatagcctcccagcttcaagaaatgtacaatcaccaattccaaattgcatgaagaggaancacctcagaatatgacacaccatcaggaaacgataagccattatccaaaacagctcttaaaaatccaaggaagcctgaagcttattaaagctgcaaagcaggaagcaagaagtgaccagcagtcagatttggcacctactcctggcccacagagcacaccacgaaacactgtctctcagtcaatttctggggaccctgagatacacaggagggctatcagcgagtt

SEQ ID NO: 554257 - DNA, 173 bp, Homo sapiens
gcaagtgtcataggagatggaggatagagctataccagaggagaagggcaggatggagctgtatcagaggagaagggagtgatggagctatacataggagacagggaggctggagctatgtcagaggagacgggcggctggcgctgtgtcataggagacgggcgtatggagct

SEQ ID NO: 554258 - DNA, 1454 bp, Homo sapiens
  misc_feature (251)..(251): n is a, c, g, or t
ttgtgtggcgtcactacgttggttgttattcatatcccggtggggggggggcccacacgaggttgtcgccctcatttaataggggggtcactcgtgcgcgcctcctgtttgtctccctgtcatattctactctgcgggcgaagcatcttgtcaccactttatgatagtgtctaataaatagtttgttgtcgttgttttcttgtgttgcggggggaatcattcctctttgtctgttgtacctagcgggaatnagttttgttgtctctacacacccaccatccttggctgctcggccatattttccggcttttgtatcctccacaatgggggggtgtggaactccacatcccccccgcggaggaggtttgaatttttcactaaccgaaaaccctcgcttggggagcgcgcgcgaagggggcgtttaacacgcacgcacacttgggtcgtggcgcgggccctcgtgtgaatacaaacatctcggttccacacaggaggggaaagcctgtggtgagacgccacacgcgatgactcatgtggagggggccgtcgtttgcgtctgggggagagaggggagtgcccgtcccctcaacagaggggtcacccgggcgcccaccacacctgttgtgggatggctgaaacctcttcgcgcgccacacagtgtgtgtccttcgggaggggaacctgttctttatcacacgggcgcacacacacagagggggcgccacacgagttatccccacgcgctgctttcacgcgccctcttgaaggaagggccccctcctgtaggaagggcccccctctgcgtggtgtctttccccaccccgcgtgtgcttcgtctccacgccctcctgatactcctgtggggagagaatgtggagaggttcttctgtgtgcccaacataaggtacacacacatggggcccatatatggcacacacatatatgtgagactcttcgacacacacatgagaatcccgcacaccgcacacacatgtgggagacacacacagaagggcacacaactctggtggtgtcctgcgggagacacacgctgggtgtgcctgcgtgaagtgtgggcgcctgtgggagactcttctcgacacacactacgtgtctgtgggagacacacagtgggtgagggacctcgtggacacacgtgaagtgtctgtggggagacacctcgggacacacacaggtatcccctgttttggctcttcccacatttctctgaggagccaccacgaagaagaaggggaagaaagccctgggagttgacacacagaaagcttcttgcccaccctaacttttcttttccctcaccagagtcaatccacagaaagttcctcaagaggcccgagacatttatttaataacactctgtgtgctcctccttggtgcctggcctggcacaacatcaggagattccaataaaagtctgttgatgacctggttta

SEQ ID NO: 554259 - DNA, 621 bp, Homo sapiens
  misc_feature (12)..(12): n is a, c, g, or t
  misc_feature (238)..(239): n is a, c, g, or t
  misc_feature (248)..(250): n is a, c, g, or t
  misc_feature (252)..(253): n is a, c, g, or t
  misc_feature (256)..(258): n is a, c, g, or t
  misc_feature (261)..(262): n is a, c, g, or t
  misc_feature (266)..(267): n is a, c, g, or t
  misc_feature (269)..(269): n is a, c, g, or t
  misc_feature (271)..(272): n is a, c, g, or t
  misc_feature (277)..(277): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (295)..(295): n is a, c, g, or t
  misc_feature (303)..(303): n is a, c, g, or t
  misc_feature (327)..(327): n is a, c, g, or t
  misc_feature (329)..(329): n is a, c, g, or t
  misc_feature (334)..(334): n is a, c, g, or t
  misc_feature (339)..(339): n is a, c, g, or t
  misc_feature (342)..(342): n is a, c, g, or t
  misc_feature (350)..(350): n is a, c, g, or t
  misc_feature (371)..(371): n is a, c, g, or t
  misc_feature (377)..(377): n is a, c, g, or t
  misc_feature (382)..(383): n is a, c, g, or t
  misc_feature (385)..(385): n is a, c, g, or t
  misc_feature (387)..(387): n is a, c, g, or t
  misc_feature (391)..(391): n is a, c, g, or t
  misc_feature (393)..(393): n is a, c, g, or t
  misc_feature (406)..(407): n is a, c, g, or t
  misc_feature (412)..(412): n is a, c, g, or t
  misc_feature (414)..(414): n is a, c, g, or t
  misc_feature (452)..(452): n is a, c, g, or t
  misc_feature (612)..(612): n is a, c, g, or t
cgtcttctttgngggcttccattgcctaggtggcctttttcttgttgttaggcattcttagagctctgggcatgggcttgtcttggccaaaatgtcttttagcaaagtaatcatatatgccaataggcaaatagtgagccaggcagatccacaagtcagcgcctttccctggcgtgttataggcaaaagggctcttcgccaagatagcatgctggatgtcccgcagcaccggagaganntcctttctnnntnncannnttnntacnntngnnggcanttccnctntnctncantntcgtcctngccgtcgtcattcctgtccactcnanggggnggtgntcncgcctgtnctatactcacagcttttcccncttgtncactnntncntgcnanatttgtatcaggnngcctncnggttggctggacagcccctttccttccccacttggccngctccagtctcctaactgatgagaacatggtcacagccgcctttgatgagccataagatagccagcctttccattggggcccctcctcccctgctgctgcccttcccccgcctccctttggattttctaagaagaggcaaaaacgtctttgtgacctccncagttccca

SEQ ID NO: 554260 - DNA, 113 bp, Homo sapiens
ctctcagatcccatcatagttcctgaagactgtaagaccagatatacgcggttcagaactctctataaaggtgcgctgctaatcaatacgtttaagaggagctgaatcggctg

SEQ ID NO: 554261 - DNA, 474 bp, Homo sapiens
  misc_feature (1)..(2): n is a, c, g, or t
  misc_feature (24)..(24): n is a, c, g, or t
  misc_feature (26)..(27): n is a, c, g, or t
  misc_feature (31)..(31): n is a, c, g, or t
nnaaaaaagaaaatattttttggnannaaanaaaaaaaaaaattccaagttgcagattagattaggatgaaggcataaacattactatcataaaattataaaaagaacatattaaaaattttatttgaatcattaatgaatgaaggaacagcaatatcaaaaaaagaagaaaacttaaaaatataacacatttaaagttaaagaaagcagaagtaaatttataaaaaaaaacaaaagtggccaaaatccacaagggtgaaaaaaaaatggatttcaaaaagaaaaaatttttgaaacaaaaaataatttgaacttacaaaaaatttttaaaaagtaaaaaaaagtccaattctgcaatggttgaaaaaaaccccaaaaaaaaaaacgaagggaatgtacaaacccaaaaagaaggttaaaaaaaggaaaaaaaaaatttaaaaccttcaaaagtttttcctaaaaagggaaaga

SEQ ID NO: 554262 - DNA, 735 bp, Homo sapiens
ttccgagtgaacttcttgatgctggctgtttctctcaccgttcccctgcttgggagccatgatgctgctggaatctcctatagatccacagactctcactcttctaagaacccccgctcttgcttggtgttctgcagtccaagatacgatagctgtcgacaggcatgaaaggctgtttgagaaatcaacttgttgcgcaccgtgactccatagcgacatattgggcgcatgtgagttgttctactgcggagcaagcagatggcgcgggtctgtaaacacttgaaacatggtgcaacatagagaccattgcccggtttggttcggggcccttgcgaaaaccgagatgatgagcctgtgtgtgtggagacccctggtgtatccgtgcaggacccaagtgtggactctctttgtggccgatgcagtacaagggactatttgaatgtaaatccctggaaacgtgaagtgaaagtgcgtgatgtcctccgagacaccattgaggggaagaacatgtcctttgtgaatgatcttacaggtcactcaggcatgggacggacagattcatttcagcgattctagcagcaaatggcaaagacgagactacctgcttctggtgatggagggcacagactgacgggcgcctgctggtagtatgatactgtgaccaggaaagtaaacaccgtttcttggaccacgctgcggttcccgaatgggagtccaggctgtctcctgcagaag

SEQ ID NO: 554263 - DNA, 309 bp, Homo sapiens
atcagcaaatgaacagataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaattaaaaaaaaaa

SEQ ID NO: 554264 - DNA, 1146 bp, Homo sapiens
taacgggtgaatatttacttttaatttagtcattttggtttacaattgaaactcttgggaattcaaaattaacatccttgcccgtgagcttctttatagaccaccagaaaaagtttcaaccttgtgtcccacattggttctgctgtgcttggtccaaatgacacctttatgacccggctgccatcatagttttggacgcgcggagatttctctttgcccacaaatttctccgctgggagaagagacccaaggctccctcaagggattgcgcatctctgtgcacaggcttgtcaagaagtacgggcctcctgggagaccgctttgcgctataatattttggatacacgggctttttattcgagagggtggggcttatagcgcaaagaaatttctctcctctctgtggagcgagatataaaagaggacagacaaatgtgcttctccccaactgtgaaacccttttttcctccaaattctccgcggatacatacgcccgggactttgggaatttctccgtggagaacgagaatttccgagttgtgaagcgacacacgcgtgacacaacaaaagatattatagtgaaataaagatcttatccgcgaaaaccaacccgaacgcaaaatctttaccaaattgtcccctatgaaagcgtgcccgggtaacactatatctcccgaggtctccccccgtgaagcgcgtgaagaagccgctttgagagggttccccgagaaggttaacaatctctgcccgaggtctcccccagaagaaaacagcctcttgtgggaagataataggccccgggaatcttttcgaaaaatatcgcggtaccgcgggagtatattccttccgcccccaattgtggaggggctcttctaccagcaaaaatctttgtgggggcggggctctccgaaacctttggaaacccaatttggcgcattatatccactcccccgtgagggagaaaaaacctgttgtggccgcccccccagaaaatgtttgctggggacaggcttggctccctctttattaagcaccggacgcgcccgcggagaaaaaaaaaaacaccgggggggaaacccccacgcaactccatgtgggcaagacccccagcgcctgcttgcgaaaacaacggaccctctttatggg

SEQ ID NO: 554265 - DNA, 949 bp, Homo sapiens
  misc_feature (917)..(917): n is a, c, g, or t
tcccgactctgatcttttttatttggtaactcaaaaaatctttatttctggacgggtatccaaacttaaaagtaaaacctcgcaaagaggaaagtctgcgtctcttcgcaattggtcccgtggcgctttcctccttatagccctcctttcattctctcgtgggcccaaaaggtatagcattattcgtgcagccctcttcagttgtatttttctcgtgggaaacgcgtgcatctctctcagagcaaatacgccgccgttgggtgcgtgacaaggacacggtggtagttaacaaggcacgcgtgaactcgggggagcgcttgggggctccatgaggttcctataacctatcctttataatatacagagggcctatctcttaacacaacaatagcgtgggcggaacattcatctctcttagtagaagcagcaattgcaaaaaggtttgggcgagaaatccgtggaaataaccctccttgtggggggcccccaggggcggcggaggacacctggtttagtaatcagtcacagctcacggggacatatccattcgtcctccctttttgtcacaattaacccacgggctttgtagcacccgcctccaagattttgtgccttccccacttagggtcgaccccgacggaaacggatttttcctccttatcatatccgcccacgatcctccctggggccctttgataccagcgagaatgcccccataacactcaagtcgtcgcggggtggacacctggtccacgtgtctacaggcctagtgtgccaaacgggggcgcggttaacaagggaggaggaagcccctctgttgtcccgcgggcgcctgtggaatcccggacgaaagggtctctgggcgcgcagtactcccccatagtgggtggacacggcgttaagcctgttgctcctgntgtgcacgcacggccgagttatgtcgcgcaga

SEQ ID NO: 554266 - DNA, 107 bp, Homo sapiens
gccccccccccccccgggggccttggggaaaatttaattgtttccaacccccgcccggggccggttaaacaaaggccacccttccttaataaagccttgggggccca

SEQ ID NO: 554267 - DNA, 199 bp, Homo sapiens
acgtgtgggtacggtgacgagcagcgtagcctctccggcagaagggaattgcctgggctccactagtgcgtgggtgaagcctgctgctgggttttcctccgggagaggggacgagcaatcctgtgggtagaagacagagagaaacatagcagcttctctccactgaaagacggggacttcccgacgcctgaagcctgcg

SEQ ID NO: 554268 - DNA, 253 bp, Homo sapiens
agatgcttaacttcgacggacgcattcactacctgttggaacaccaggatgcattgccctgagaaacatgacttactgagtgaattgctgtggtcgctgggagaggtgcaaccgtggaatcttttcttggggaaggagcagttgaccccaatgaccctatcaaggcaaatacactaagtcagctttcaaagaccgagatatctcttgtccttgaccaagcaacatatgacatagaggacggagaagctctaga

SEQ ID NO: 554269 - DNA, 208 bp, Homo sapiens
ctatttcaggtgaagtgcttatggcttaaggaactcttggccattcaaaggacttttcattttgattaacaggactgagcttatgcatgagagccctgcaggggaaagggtttaagaaaaacaactgcctgctgttcccatgagtgcagagttggaatgttgtgcaggcacgcctgaaaatgtgctgcatacgccaaaacattttact

SEQ ID NO: 554270 - DNA, 416 bp, Homo sapiens
  misc_feature (372)..(372): n is a, c, g, or t
  misc_feature (384)..(385): n is a, c, g, or t
gtttttgatttctagtttaatttcattgaggtctaagagcatacttcgtataatttctattcttttacaattgttaagttgtgttttatggcccagaatgtggtctgtcttggtcgttgttccatgtgagtttgagaagaatgcatcttctgctactgttggatgaagtattttgtaaatatgaattagatccaggtgattagtagtggtgttcatttcagctgtgttctgcctgctggatctgtcagttgctgatggaagggtattgaattctccaactataaaagtggatttgtcaattttactttgcagttctatcggtttttgcgtctcatatgttttataccagttaaaatgcatactagggtagcnttaaaaaaaagnnaaatcagtcagttaatagagtaactaaaaaa

SEQ ID NO: 554271 - DNA, 303 bp, Homo sapiens
acatctttatatgtacctggctacctaggcggggaattgactaagtaacgaagccaggagtcagatctagatagcagagaagtccgtctcatactaaaacattgcacctactgtaagcgtccaccccatgacgctgcaacagatagagtatcttagactgcctcctctaagtatatataggtacagactaaaacaaatgttgctacgctaggtgggctagtgctgactcagtagtacatggacagactccagcataccccctctggagaccttggacctaagtgccaaatgcataatgcgacc

SEQ ID NO: 554272 - DNA, 1042 bp, Homo sapiens
tggcctccctctagttgtcccgggcccctgcggctggtgtgcttgccccggtgggggcagtcagttgatgctggtgggagctcggcttggagtggctgggccagtgtgactggtcccgggccatgcctgaggaagaagccattcagctgtgaagcagaagaagaagcagtttgcagtgacaaactgggagcggaagagagggcttcaagatttggctgctgctccagttccaacatgcctgcagctgtggagccgggagcgggcgagatgtgaacatgacctgacacctcggacgtgggagtctcgtgacccatcatatcctgcaggcttaaccagcagccttctcagtggggctgggtccacgaggctacgaccaaatctgatacccgactgcatttttgagagagacatgcaggggagtgaggtacgagaggcgaaaggagaagcagccccggggagcaagttcatacaagccgggtcagtgctgagttgtataggagcttggacatccggggaggtgtatcagccttggctcaagttcttggacattttcctcgaaggtacttcattgtggggctatgagatgtccaagggagcaattaatgagcgaagaggaacggagcttacaaggactaatttgggaagattcatggggttactcttttggagaaatcagtactttgagcacaatctgaagacattgaggtagttgtggcgggtgttaggagatggtatggacagtcgtagcgtggtagtaagtgagattcagagattcagggttgtggagttatctggcaggagttaatgaggttgtactgaggaatttggtggcgtggtgtggtttgatcatggtggtgatggccggaggtatggggtgtttgaagattatgcatcaggagtcaagtagcagtggcataggttttataggcccgagacagactttgtgttaaggttggggtaagttatgcatagaagggatgggtaagtggagaaagggagaggagtggtaagagggggaggagaggaatgtgtggggaggaga

SEQ ID NO: 554273 - DNA, 639 bp, Homo sapiens
  misc_feature (536)..(536): n is a, c, g, or t
cccttgggaaaaaattttttttcaagaatcaacagaaatcatttctgctttttctaataaaaaacaacatttgatgggctcaccaccaacgtgtttactaaaaataaaaattaggttgataggttgaaaggccggccgtggtggctcagcaaaaattgaattttaattttccaaaataattttttttgactaaaagccccaccttccaaacacactgggaggggggtggggctccccaggctccaggtagccctgcttttaatggctttgaggggcacagccaatggggcagtttttatgggttgaagttgcatgcctgcaactttcccaggcaggagttgcacactgatggctctactggggggaggtctttgccctgggggggctttgcccttatggctttgctaggcactgccttagggggggctctttgggatgatgctggcctcacagccctagtggacattgccctagggggggttttctttggtgggcccacctctgttcttttttttggccccaaggccccacacggngttctttgaaatttaggggggaaaagccatgtccttacctggttgtgcaccctggggattggtgtagtggcaccttgtaaaatctgccaagttttactaccct

SEQ ID NO: 554274 - DNA, 523 bp, Homo sapiens
gggggttataatagagctgaaatattattatagccaagtgatgtcttgatgatcctgagcctatgtaggcctaggttaatgtgtatgtttgtgtcttaatttttaacaaaaaaaagttttaaaaggaaaaaactaaatatacaaaaagattacggaataaggatataaagaaaatattttagtacagctgtacagtgtatttgtgtttaagctgtgttatcacaagagtcagagttaaaaaattaaaaagtttataaagtagaaaggttacagtaagccaatgttaatttattactaaagaatgaaaatttatttttataaatttaatgtaggctaattatacagtgtttataaagtctatagtagtgtacagtaatgtcttaggccttcactcactcgttgactcacccagacctgacttctagtcctataggttccatttctgttaagtgcctaatacaaatataccattttttatctcttatgccatatttttactgtaccttttctatgtttagatatg

SEQ ID NO: 554275 - DNA, 267 bp, Homo sapiens
gagctataaccgaaaaacagatgttgacagcggcgatcacctgacaccatcatcacctcaagccacaaaggcactaattaacacctctacttcctctctttcttcttcccactcatcctgaccctactcctactcacataacctattcccccgagcaatctcaattacaccatatacaccaacaaacaatgttcaaccagtaactactactactcaacgcccataatcatacaaagcccccgcaccaataggatccttgagctccag

SEQ ID NO: 554276 - DNA, 357 bp, Homo sapiens
tagattgtagtttagccataactgatgttttttaaaaagggatatattttcttgcacagttgttcaaaaaaaagccaagtttcagtcctcaatgctgtcctttgttttacaggcacaagttttctagctcagccaaactatgaaaaactgtagactattctcaaggtattaactcccagaccctctgggggtaggggctgttttctaagttacagccaaagtgggactaaaatggtccagtgtgcccaaccaggtacttagctcacaccctgggattttttgtactaaaatgttcctttgtatcaaaagttaaccaggctttagtccaccaaataaaggtcaatttttgtaaggcta

SEQ ID NO: 554277 - DNA, 312 bp, Homo sapiens
ggtttgcaggagagttagaacagaatccacacataaaagaaacacgtaggctccaaaaaattcccctctcctcttccaaacaaaacatacattgatctctcacatccagctgccaaaagaaaaccccatcaaacacagttaccacccatatatcactcacacacacatacatacgcaaacacacacaagaatgagatgaggttcaaacaaccagccttgcctggtgcgtggctccctccgtgggggggcttggctgccccgccatggatccacgccgctatgtgtggcaggcaggaccccgccggtgggtgg

SEQ ID NO: 554278 - DNA, 787 bp, Homo sapiens
atggttggctgtgactatgagatcgattccaatgccaccgaggatcgctgcggtgtgtgcctgggagatggctcttcctgccagactgtgagaaagatgtttaagcagaaggaaggatctggttatgttgacattgggctcactccaaaaggagcaagggacataagagtgatggaaattgagggagctggaaacttcctggccatgaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcaccagatgtacttctggcagtacggccactggacagagtgcagtgtgacctgcgggacagatcagagatccatgtgaaaaaatggcaagacaatagtctaaactgagctcactggtatgagagccagccgactttccacaggttagtgcttagaggtaaagggactctcagagaccacccgtgacagttttgtctccaaaccagttgttgtttttttcctcccctaagcggatttgcttttacttttgccttacaatgaaaagtgacgctctgacttttagggaattaagactgacttctcctcaggaacttgaaaaaaaattccatgctttacggagggtt

SEQ ID NO: 554279 - DNA, 169 bp, Homo sapiens
gctaccaggactcctggacacctacagagtgtggaggagtggtctccccaacttacctagcaatcgccttggccctagggtagagctagggctacctgagacagtgggcgtgaggctggacagtggtgaccagctactagcaggactcatggagatcctgcaaaggtct

SEQ ID NO: 554280 - DNA, 880 bp, Homo sapiens
gcccggagagcgtatggaagatggccgatgaggcgagtatggactagctggcgtgtgcgccctgagacgctcagcgggctatatactcgatcggtgggagccggcggtcagtctgcggcagcggacagcaaagacggtgcagtgaaggagagtgggcgtctggcggggtccgcagttatcagccagagccgctgacagccatggccccaatcaaggtgggagatgccatccccagacagatgtgcaggtgtttgacaggggagccagggaacaaggtagaacctggcagacaagctgttcaagggcaaagaagggtgatgctagtttggagattcctggggccttcacccctggcatgttccaagacacaccatgccaggggctattgttggcagcagagcatgagagctctgaacaggaccaaagggaagatccgagagatgagatggacctgatcatgcgatgattaagtgaatgcactttgtgacatggcagagatggaggacgagacaccacaaggacagagaacggcaacggattcaggcatccttgagctgaatcccaacatggaggaacatattggagaaagcgacgaaccagaaacttcattactcagatagattacgactgggtgtccactcttcagggagaaatcgaacgatcttcaggcgcgttctcccataggtggataccacgcttggaatatcgtgcagggccctaaaatgtggaaacaagatggaacagagcttcacctagcaggcactagaaccccagactactactcaaacaatctaggccctgggaccaacattaaattcttcaaccatacattttcactgacaacggtgctgaggcctggagatgaagttggccaattcgc

SEQ ID NO: 554281 - DNA, 683 bp, Homo sapiens
  misc_feature (36)..(36): n is a, c, g, or t
  misc_feature (56)..(56): n is a, c, g, or t
  misc_feature (221)..(221): n is a, c, g, or t
  misc_feature (298)..(298): n is a, c, g, or t
  misc_feature (557)..(557): n is a, c, g, or t
aaaaatgtctcccccaataaaaaaaggaatgtttgnaaagctgcccagctcccgcngttagttaagtagcgtgggtaaaaaaaaaaaactgctgttgccattcaaaccatgaaggagcatcctgcatcttttgactgagcttcttttaagcaaatgggatttgaagtatcatttctgaagtttcttgaggagtctgcagtgaagcagaagaaaaatactgncaaaggccatccgaattctggaaacaaaaaagggtcccattcaaattcaagaaaaaatattgataaggctgctgtgnctagtggaaatcatgtatgtccttgtaaaaaaaacgaaacgtttgtacagtttgccaatccctcccaggttcagggcagggataatgtaaaaattgttttaaacaagaattttaaaaattgccctgagcttgttttaaagcaacttcaggaaatgaaaccccccgtcagtttgaaaaaacttgaaggacattcaaatggtccaaaaatgtttgttatgaaaaatatcagtataggtaaagccccaggcaaaggtcaggncttataattaatgtaggataaaaacctcctttcccctttttttttaaataggaagccctcaagcatgctaaaattgtgaaactttcattaaatttttttgttggtgacaagaattaacctggccca

SEQ ID NO: 554282 - DNA, 589 bp, Homo sapiens
tagtcagtgctaaacaagtattttaagagtgtgtgttattttgtgcctaactgagatggagattggcaagctgaagaaattgggatttggccaagaaccagtgcttgttgtttagtagagaggtgatagggaactatgatcctgccagtttggagggacgtaacatgaaatgacttcttggtccaagctggctacagctgttccaaaaaagatgacaaaggctgctgattcagagggggatactcacccaggctgtcacgtctgtctctccaccaagcaagacttttttaatcctctaacacaacagcaacacaaaatttactgtctgcaggcacaatgctaaggcactttgtgcacactaaatcgttaggcactgaaaacaaccctgtaagggagtactctgattcatctgcactttatgggttaaagtaaccgaaacctaaagaggttaagttaatctgccccaagccacagaactggcaagtggcagaacaggaattcaaactggcttcagagcccacccagtctttgcaagcctactttctaatgcctgaattccttctctttaggaagaattatctgtgtaaag

SEQ ID NO: 554283 - DNA, 164 bp, Homo sapiens
cataagcgaggcctgtcctccgggagagaccctggagcggggtgtgggacgaacggtctggaggaagggctccgagcacttcgaaagtataaccgcggtcccaaagaggcgtgctgtgtctgcgattttcctgggagtgcacggtttacattctgtaaagcagt

SEQ ID NO: 554284 - DNA, 237 bp, Homo sapiens
  misc_feature (193)..(193): n is a, c, g, or t
  misc_feature (202)..(202): n is a, c, g, or t
agaatggagggccgctgcgaggggataccaagtttttgagggtttgcattcctcctgcaggcacacagcctgcgggcacacggcctgcagacacatggcctgtggacacacggcctgcagcccaggcgccaggtggacgggtcagcagaggcgtttcttggatttaatttcccgactgggaatgggttgagcnccgtctgtncctctgtgtattggccacacccgtttctttcctgt

SEQ ID NO: 554285 - DNA, 925 bp, Homo sapiens
gtattttccagcgttcagttcacatcaaggatgggtatgcactggcggaaaaggccctcaggaggaagcactcatctttaagcaagacctgctttctcaggactgcaaacaagagaaaagcccaataagaggaaagtgaagtgtgaaaatccatttcaaagaactttactgagaactcaccatgtcagagagcttccattaatacagtggcttcaagaaccaataggcagaacccaaagtaatggagtgactcaccaggacttttagcagctaatggagtactctgagaaatgctgtaaatccaatatttttgctgaaaaattaatgtgttatgggagggagcctcttttctaatcacgttacccacccccaccctctacgttctagattcaccatcagcatctttagctcttctaattgtgtgccaaagctgaatgcagttctttcccaattttcttatatcattttaagtattatatatgctatcttaccaggcccactcagagaaacagcacttatctttaaaattatttattaactacatccccaaagcctacggccaataaaaactctgtaaactatgttacatataccaaagtaaagtttccagaattcacagagagatcgataaatatttactaagtgccttctacagacaaagccctgggaagtataaaggagcaaaacatgcacagttctagtctctaaacatggcttacaatgtccattaggcatatgaacaaagctaataataatccaaggcaaaaaattgggagatcatataccaaacaaatggtataggagttcaaagtagggaaaggatggtggcaggtagtggtccaaggacagacagttggcacataagctgaaaaatgaaagatgtatggagacatttaacaaaaaagaaattacaataaagagaaaa

SEQ ID NO: 554286 - DNA, 239 bp, Homo sapiens
gtgttgtccccccggtgttcttcatcgaggactctgctgtctgccctcgagatcatagaccttgtttacttgtcagttgcactgcgcatgctgggcctcccgggtcttggggtcgcatccatcttggtcctatcggagcgtgtcctgagcaactagcagcgctgcctcccccttgcatccctttcccccttgtgtacggaaaattggcatatggttctttttgtggggttattttccta

SEQ ID NO: 554287 - DNA, 238 bp, Homo sapiens
tgtgtgtgtgtgtgtgtgtgtgtgtgtgtgtgtgtagccgtcaatctcctgggctcctgggttccgtttgccctgttcatagagatggaatgagggcgtccccaggtggtgagctcagggacgggcgtggtggtgggtgcctgtggtcccagctgctcgggacgctgaggtgggaggattgcttgagcccaggagtttgacaccagcatgggcaatatggtaagaccccattatctac

SEQ ID NO: 554288 - DNA, 444 bp, Homo sapiens
aagcgttgtagtccaggattgctgggtttggtatcccagagttacctaaaagtgctaggcaagttctgaattctcagtcaacagactgtaaaataggtcaaataacggctattatcaaaaattgtgataagcattaaatcaaataatgtaagtaaaagagctggtccagagcctacaacacaattgtctctgaacaaatattagtatctcttgtttcttccatccttgaaattctgctagaataagcttaatttatattgaattgtacatttaaaacaaaggaggaagaagctctaccagattttgattttgaaagctgagaaagccagggaagtagcttaatgctaacataacctccaacctcctcttccttgaggctttttttttgggaggaaggggtacaggcatacctcgttttactgtgctttgcagatactgctttta

SEQ ID NO: 554289 - DNA, 500 bp, Homo sapiens
tggtgatctacgatctagggagggttacatgtggagtagtctcgattcttgactcatgatcaccgctcgactccaagtgtgtgattcggtgtgagcactgggcggctgaaatttttttaaggtgaaaatgtttgcaagttcctttttcagaataggttttggagcagaactctttcagctagtaagacccaactttgcttaggtttagcttcacagcatagctgaaagtaggcaaattggacatggtgcactaaagtagaattctatgtggataagcaacctatttccaaactagaaaggtgatagataaaagtgtgatcactcaattgatatgatcagagtaaagaagtttgccatttggatcctttgacttggtttaagccacctatagtgtaaccaaccatctttatccttgtgtgcagggataataatgacctaaggtagtgttctaagataatttaatgatactatctttccaaactttgttcgatttcacatgt

SEQ ID NO: 554290 - DNA, 705 bp, Homo sapiens
agcggggaggtctgctcagatacagagccggaagtcctcagtccccttaccctcgtgaataccagtggggaggttggcaggaagctaatgtgatttctaggacatttcagcgtagaaacgccatggaatccaggttctgtcagctttaacgtctatctagcgactgaattcagctgaataaccagctccctttccatcagttatgcaatagagcacctgactgcgtggtacagcaggttaaggaatgtctgtgaatctctcatcggttcacagccaacctactgaactcttacgtgttgatatttcgaggtttataccgtgtaagggtcatattcttaatgctgaaacacaaactattgtccaactattttaacatttttttttccgtagaaattccattttactctttttcacattatgatgcattttccctaacactacccattaaatcattctccattttcactccttcttgggccatttctatacaagcttcctttgtgtttgtgattattctgtataatcagccatatttcattttcctgcactaatttggcagatttactactattactattactgttaatgatatcttcctttcagaatgtttttctaaataattattgcgtgatcatcttgtacttgaaaaaattgtgaatctataatttgttttaaaagtgtatctaatgattgtctttaataatg

SEQ ID NO: 554291 - DNA, 268 bp, Homo sapiens
ttttctctctccacccatacacacttcagagttatgcagaaaggccaggtgcggtggctcacgcctgtaatcccggcactttggttaggccaaggcaggcagattatatgaggtcggaagttcgagaccagcctggcccacatggtgaaactccctctctactaaaaatacgaaaattagccaggcgtggtggtgcacgcctgtaactccatctgctcgggaggctgaggcaggataatggcgtgaacccggggtgggtggagagcgg

SEQ ID NO: 554292 - DNA, 430 bp, Homo sapiens
  misc_feature (44)..(44): n is a, c, g, or t
  misc_feature (160)..(160): n is a, c, g, or t
  misc_feature (354)..(354): n is a, c, g, or t
  misc_feature (367)..(367): n is a, c, g, or t
attcggcacagggatggagtttcactgttgcccaggctggggtncaatggtgtgatcttggctcactgcagcctccacctcccgagttcaaatgattctcctgcctcagcttcctgagtagctgggattacaggtgcatgccaccatgcccggctaattnttatatttttattagagacaggaattcgccatgttaaccaggctggtctcgaactcctgtacctcaggtgatctgcccgccttggcctcccaaagtgctgggattacaggcatgagccaccgtgcctggccttattggcttagtttttaaattatcctccaaaaattttgggccttttatctgtggggaaacangtgaaagctgctntttcagcatgagacacttaccttttattcccattcatttttagttaaaaacttaggttttgtt

SEQ ID NO: 554293 - DNA, 241 bp, Homo sapiens
gcaagtccatcgctgttgaacatcctgcctatatgggagctgtacgacctttcctgtgatggccaatggtctccttggcttggaaaccacttatataacttagaccttcaaagagttgggaatcataaaaatgctatctgaaatacagtcatctggatcttgggaagtttgcaaatagctctaagatgtcaaacaagcaaaataaaagcctgtggatatttaaacttcagttgtccaagac

SEQ ID NO: 554294 - DNA, 142 bp, Homo sapiens
aaggatccggctccactgggttgcatttacacatgcaacagtaatacagccagattcccaattatctgtgaaatccatgtaatactggcaccttaaaagtaatcacccttattggcagagaatgcagtaaagtggggtaact

SEQ ID NO: 554295 - DNA, 146 bp, Homo sapiens
aaaaaatttaacaggtcaatttcaataaggcctcgccttatggatgaatggtattccctggctagatttattcaaaccatgaggcaaccctatttttatttaaatatggaaataaaaacaaacatgaaataaaaacctccaaatta

SEQ ID NO: 554296 - DNA, 402 bp, Homo sapiens
agaaataagtcaccaatcaaggtgcccttgttgactgtgcggagcgaatctgatggggttcaagcatgcaaatctatggatctcgtggatccgtgcctcgatgtaggctgtcttgcccgagtccccaaactgtggtcggacggttctacaagagctctctgtcaatctgtgcatggacattgacctcctcttctggtggcttcataggcagcaggtagccatagcccaggtgtgatcttgacggtaccggtggcgccaatcacagaggtacaacgtgtgtcatctacgggtctaccaagtagaactgcgggttggggctagtctgtctcttcgtgcatggatatgagaaggtagtcaaataagtcccgtgggatattgatatccagtgtgcacaggttgtgt

SEQ ID NO: 554297 - DNA, 146 bp, Homo sapiens
acctacttatcgccaacaccccttcccatctgcactgtgtgtgttggattgcgtttgggggaaagagatgttattcttagttgtctactttgtatgaacacttttgttgtggttcaagtgctgttttgtgtgttggggatcacata

SEQ ID NO: 554298 - DNA, 374 bp, Homo sapiens
  misc_feature (227)..(227): n is a, c, g, or t
ccccatgagcgatgaatgtcacatctatcccactgtcaacaggtggtgtgcgtcattggcattctttgcaatactgcttaattgctgatacatatgaatgaaaccttggctggtattacctggcattcactgtgctatcggcaatgatgctttggaagatgcgaagcataataaagtacttgactacctactggtgtaatctcagtggcagccccactttcttatcncactttttcaatagtaagtgcgaagactgagcccaattggcccattaaaaacgaaaacctgactaggttctgttgagcccaattagacttggaatacgtttgtgtctctagaatcacagctccagcattctgttccttcgctccctg

SEQ ID NO: 554299 - DNA, 207 bp, Homo sapiens
  misc_feature (79)..(79): n is a, c, g, or t
tccttcttacttgctccgccttccagagcacagcgcgctctgagctgcccccaggtccctcccccgcgcagcagcccanttggagggaggaagtaagggaagaggagaggaaggggagccggaccgactacccagacagagccggtgaatgggtttgtggtgaccccgcccacaaacggcacataagatggtggacagaaggacgcg

SEQ ID NO: 554300 - DNA, 372 bp, Homo sapiens
ataccagggaacttttggaagggtcaggttccttaggctggggaattaatccagaggtggatttatattttaaattctttacggattttcccgaaaggaagttttggggaatttattggaaaatggggtttttaagggttacgttttccagatggagatgatggttgggccaggacagttgaataatactatgggcaaggtttgcaactgaggttaaatagggggcaaggttcctggtaaaggagcagtagggtttagaattttaatattaaaaggttaaactttaataactgttaaatggtggaggccttttagtggttaagattattaatgcccaaggggtattcttttttaaatatttaaaggttccgg

SEQ ID NO: 554301 - DNA, 164 bp, Homo sapiens
cccccgggctgctgttagtaccacttaaaaacaatactaaaaaaacctatgaaggtgcatgctatttccccagagctaaaaagatagtgaaattgtgtttgaactcttaagtggaggtgaagcagaatttattagccaccaaccacataagtgattgttccgct

SEQ ID NO: 554302 - DNA, 762 bp, Homo sapiens
gctaggtagagctgcgtgggtgaatggcagaggttgtagtgcgcggttcccgggcttctctgcaaatgggctcgtgtgctacgcccccgtcccgccaccgtgatcgtgcgccgattgccggagtgggtcgctgccatgattccaccagccagcaagctagagcatggggcatcccctccagcggctcgctcgtggcatccacgatactacgggccgctgtgttccacttccagcaacagctcctgcagcagtaccgagtgccccgggaagccattccccaccccccagtgtctccccaaggctgatccgggtcattggtgggccagcttcttgttcgggaagtccaccctcccgttcatggccacggtgttggagtccgcagagcactcggaagctccccaggcctccagcagcgtgaccggctgtggcctggttcgggacgcccgagtaagcagcccggcggtcagtaccagcatagcagcgctgggccctgtcctgacctgagccggttaccaccagccgcaaggcctgcggaggcggctagtcgaccagagactcgtggacgaggtgtagagccagtagaaggacgaagctgttgcacaatgctacagactctcccaccttcttccttttgcgctggtcatccacgcaggtgttcgaactggagatcttccaccctgaagggcttgtcatcgcggaggaactctgcatctcgcttccgccaggtgtcgactgtgcaggttgctgcgatggtaccaatgc

SEQ ID NO: 554303 - DNA, 386 bp, Homo sapiens
  misc_feature (144)..(144): n is a, c, g, or t
actcagaggatcccaggggggaacaatcacttggtgatggtttccttggctgtacataagctttttcacttcatgtaatcctattggttcactttggctaggtggcctagcaaaagtgattgttccccgctctaagtgattgtnccccgctaagtgattgttccccgctaagtgattgttccccgctaagtgattgttccccgctaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554304 - DNA, 638 bp, Homo sapiens
  misc_feature (327)..(327): n is a, c, g, or t
  misc_feature (333)..(333): n is a, c, g, or t
  misc_feature (352)..(352): n is a, c, g, or t
  misc_feature (400)..(400): n is a, c, g, or t
  misc_feature (438)..(438): n is a, c, g, or t
  misc_feature (446)..(446): n is a, c, g, or t
  misc_feature (486)..(487): n is a, c, g, or t
  misc_feature (494)..(494): n is a, c, g, or t
  misc_feature (504)..(504): n is a, c, g, or t
ctctaaatgctagtatatggcacaaaccagaaaatattttcagccaagttaaggagattcctatttctctaagcaagtccctagaaacatcatcaatctgtctctggcaggcgtttttctatttaatgactctaaagagacagaaaagctttaatcaatgcccggaagtgaaatgctaagaaattatatgcacggttacgaaaaaaaaatcaaagatgtttcccacacattgtccagcagacaaaaacatatttgacatgctgttcctgcaaggaaagtggactgagttttctagataatgtttgagcaattcatccttcccgcaantgtccnccactttccaggcaaatantacctccagccaaataaggggttcactccctcaagttcctaccatggntccctgggaaggaaacacagaatctctgaacctactcntgcaggcnacttccttgcactttgagattgtggtctcactaaatcttnncaacaanccaataaagngtctatcatttctgccattctacagttgtggaaattgacacttaaagaggctaggaaatttggagtcatcgggacttgaactaaggactcatgaatgatgactcctgctcaggatcatgatggcctgctcaggc

SEQ ID NO: 554305 - DNA, 403 bp, Homo sapiens
gacttgactcaggaggcagaggttgcagtgagccgagatcatgccactgcactccagcctaggcgagagtgagacttcctctccagaataaacaaacaaacaaaacaaacaaaccattgcctacaaccaacctagccaagtattttccccaggaagattacacattctaatccccattatcagaaataatcacttctactgttgttattctagcatcagtagaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554306 - DNA, 353 bp, Homo sapiens
gcttttctgttgcatgacacacatacattatctggtgagaggagaagactcggcgtgacttcctataacgtatatcacttagatcctatttcctccactcactctgaatgaccacagccaacaggacttgaaattgccagtcctgttggctgtggtcgccagactgagtggcaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554307 - DNA, 116 bp, Homo sapiens
gaggttcccgatgaccaaattaccagttctgaggtttccccaagataaatttaacagctccagcttcagtgtttatcagaatacaatagaactaagtagaggttgtctttgttcga

SEQ ID NO: 554308 - DNA, 318 bp, Homo sapiens
acttttactctagcgttaggagggggcctccttaaggaaagcatgctgggtaaactgtgcgatgttacagagcgcattgagtctgtggtcatcgtggttgggaacaatcacttaggaacaatcacttaggaacaatcaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554309 - DNA, 1311 bp, Homo sapiens
  misc_feature (374)..(375): n is a, c, g, or t
  misc_feature (377)..(377): n is a, c, g, or t
  misc_feature (1311)..(1311): n is a, c, g, or t
ccgaacacgcccaatacgagatcgatgtctagcaagcctgatcacttctcagctgtgacgagtagcgctatctgtctccgatggcagtatgcggtatcaagtgtcgatccgcttgcgaagctgcggacatctacatatcagccatggtcatttagtaacgagattcacccagccgtagcaacactgttagtagtagaaaagtgctagcgagaccgtcactcgcacagcttggaagccgtcatctacatcatctcgtaacaccgactatccttcgaacacaactgacacactcccgtggttcgagactgaggatcggtccttgctgtggcactatgtgccgccggccgttgtccacgcacgtgaagaggcgctgnngntgacgctaagtacaggcttggagttcgttcgtaccaatactcggtgtgctacgtctgcgtgaacgcgtaggccgacgcagtactgctagaccactcctgctagggcaggacgactggcttgggaggtgcttgctccgcaccagaggcctaacacatgcggaataatgcgtacgcacaacggcaacatgcaacaccgagttgcagagaatgcgcatataccggcagccaatcgtgtctgccgctggaactccaagggcgaaacggttgggccactgtgaaagcgagtgtcctagatgtgcgtactgacaaaccatacagagcggatgggaagtagatcctgactggatcctgcgcgtgacacgttcacaagagaatctggagcggaccaacgtgacagcggagtaaacagcggacactttggtgagcgtcactgcagtttcttttagcccgcacgttactctgtgggtgggctggaagaacccggtatcgagggtcaaattccgttattctccctcgtgaacagaggaggcgacaccatctgtttgcgccaggtgcccaaataggacgtgtaagccggtggccaggatcacggggcctcggtgtaccctgtgccccgggacttatattcgggactgcaccaacgacaggcccgcccgcaagtgtgttcgagacactttacctgggattagtcgcccgtccccgggagtatgagaaattgatagagccatacacaaattgtcgaacaggggctttgcaagggtggattggccaccatcggtggcggaaaccagccgcgggttccatttcgcctgtggggcccctgtgttacctaaccgacatatgtggagcgctccaatcttcggagaagcaaagaacaccgtgtttgggcgctagcagtaaatcattgcactggacaataggttggccccccagn

SEQ ID NO: 554310 - DNA, 178 bp, Homo sapiens
ttacttcttgtaagcatctatccctctctccttgttgcataacatcccacgccagcacgcatctatctacagtgtatacctgtgcaccgatccccaccccaattcaatcccggaagggatcctccttaggaaacccttactatatagctagatatccaggaccccgtgggcttgtgaa

SEQ ID NO: 554311 - DNA, 292 bp, Homo sapiens
tgaacctggggacggatacaggcgtgtgcaccttgcctagctaatttttgtatttttaatagagatggcgtttcaccatcttggcaaggctggtcgtgaactcctaacctcaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554312 - DNA, 747 bp, Homo sapiens
  misc_feature (401)..(401): n is a, c, g, or t
  misc_feature (452)..(452): n is a, c, g, or t
  misc_feature (459)..(459): n is a, c, g, or t
  misc_feature (471)..(471): n is a, c, g, or t
  misc_feature (485)..(485): n is a, c, g, or t
  misc_feature (505)..(505): n is a, c, g, or t
  misc_feature (511)..(511): n is a, c, g, or t
  misc_feature (538)..(538): n is a, c, g, or t
  misc_feature (554)..(555): n is a, c, g, or t
  misc_feature (578)..(578): n is a, c, g, or t
  misc_feature (584)..(584): n is a, c, g, or t
  misc_feature (676)..(676): n is a, c, g, or t
  misc_feature (681)..(681): n is a, c, g, or t
gaccagctcgtgctgcctaagaaggtctgtctggatgtttataggcagcacctctgaagtggcctaaattcaccctgatctgatagttttcctgcttagaaagtgtgccttggccagatcagtatcccacatgggagtgttccctatgttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacacagttttagatgggtttacaatgtcttctaaacaatgtgatctaaaaataattgagtcagatgctaacgagatactgcaggcataactgctgtttttctnacaactgattgtgaaaccttaaaacctgcatacctcttcttacagtgaggngtatgcnaaatctggaaanatattctatttttntatataggtagataggatcnccattnatttcctatttagatatactgacattnatccatatgtatgcgnncattagcttactataatttactnttgacntaatggggcataaatgggctttctgtgggttagatgtaaagccacatattttatattcactattttaatgagcactgctgagggaatgcagngtcanaacctggctatttttaactagggtataccctagtatccattcagatggtggttttaaatgacactt

SEQ ID NO: 554313 - DNA, 86 bp, Homo sapiens
gttacaatcgttctgtgtttgatatttgtgtaaagtgtgcatgcgtcttgtactaggactaagaacaaaactgtaactgcatagaa

SEQ ID NO: 554314 - DNA, 247 bp, Homo sapiens
gcaaaaccttctgatctatctatagcgtccaatctggatagttttttatgatctgactcgcctggcaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554315 - DNA, 663 bp, Homo sapiens
  misc_feature (401)..(401): n is a, c, g, or t
  misc_feature (452)..(452): n is a, c, g, or t
  misc_feature (459)..(459): n is a, c, g, or t
  misc_feature (471)..(471): n is a, c, g, or t
  misc_feature (485)..(485): n is a, c, g, or t
  misc_feature (505)..(505): n is a, c, g, or t
  misc_feature (511)..(511): n is a, c, g, or t
  misc_feature (538)..(538): n is a, c, g, or t
  misc_feature (554)..(555): n is a, c, g, or t
  misc_feature (578)..(578): n is a, c, g, or t
  misc_feature (584)..(584): n is a, c, g, or t
gaccagctcgtgctgcctaagaaggtctgtctggatgtttataggcagcacctctgaagtggcctaaattcaccctgatctgatagttttcctgcttagaaagtgtgccttggccagatcagtatcccacatgggagtgttccctatgttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacacagttttagatgggtttacaatgtcttctaaacaatgtgatctaaaaataattgagtcagatgctaacgagatactgcaggcataactgctgtttttctnacaactgattgtgaaaccttaaaacctgcatacctcttcttacagtgaggngtatgcnaaatctggaaanatattctatttttntatataggtagataggatcnccattnatttcctatttagatatactgacattnatccatatgtatgcgnncattagcttactataatttactnttgacntaatggggcatataataaaactttcatagtacacatgaggtgatattgatacacaggggatccgtctagagcgacctac

SEQ ID NO: 554316 - DNA, 243 bp, Homo sapiens
agtcagagcggtcaaattaagttgaaatctcctaagtgtaagttgggtgctttgtgttaagcaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554317 - DNA, 242 bp, Homo sapiens
cgcgggaaccatcaccttgaaccatcaccttgaaccatcaccttgaaccatcacttgaactaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554318 - DNA, 373 bp, Homo sapiens
tacttctgtcgcgcgggctctgcctcaataggtagcccgccctgggggccaaactcggtggcggtgaggcctgatctgcttcatctcggtgaggactcgctccggcgtcatctggtagccccagttcggaacctcgcagacgccccagctgatgggcgctccggcaatcttcatcgatgtgctcctcgtgtcttggaggcctgagctcctgtgcatcaggccgctctcggtagtatatgtcctgtcaaatagcggggcaatagctgtcgctggcgtgggaatcagtattgatggcgggctttgtgctaacattatggagtcttgccgttactggtgagaatccagctttgtcagaacacagacgctcttaccg

SEQ ID NO: 554319 - DNA, 650 bp, Homo sapiens
atccctgagaatccaaaattctccgggccaccctatcagcaaccccatcctaagagataaaaaaaacaaaaaaaaaaaaaaacaaaaaaaaacaagttgttgtgcgcggcgcgcgcgccccggggcccccggaagaaagagttttcaaagaaacaccatgcgcgtgtgggggcgcgcgccgcgcggggcccccagatgggggtaaagggggacaacgtgtgggccaatagcgcggtttcccataggaagaaaactcgcggggggatccaagcgaaacgaaagaaggcggacgggggaattctcccacaccccacatatatcaacaacagagcgcgcgcggggggggaagcacccccgcggaagagcgttgtctcgtgagaacacacacaaatcacgccagagaggggagagatgcccgggagaggggtcccaactatcgcggggggggcactctctataatcacaccgaggggggagttccccccaagaagggggaaagacctgcgaaatatactccaaaatatgatagagcgccccgcgacgacgaggggggaaccatcgacgacaacgacaaatcaatctcaagcacacaagacaacaacacaaagagccagcagcgaccgaccgaacaacaacagaacaacagcaaa

SEQ ID NO: 554320 - DNA, 2044 bp, Homo sapiens
  misc_feature (1067)..(1067): n is a, c, g, or t
acacagcgcagctgcatgacttccactgtggcgtgcgttcctccagtctcctgctcgctcggtcgcctcgctctcgtgctgactactggcgtggtggtcgtcggggtctgtgattgttgtgacttctgtcataatgacagctgcacgactcgagtatcgcctgttcagccgtgtcgtcttgcttcattgctagcgtggtgctgtgagtgcgcagatcttcgtccactcgtcgttggctcgcgagccgtgaggcctgcgatggttgagctaggtggatggcgaggatctcggacgtccgcacaacagggtgtctgcactcagtgctggagtgccggtccgtcccttttgcacaatacgatgcaatacacacgtcgtgccaatcagcgcatacatagagacccagcatacggcgtacactcacagagctagaggactatcctctcgcacagtctactacctacgcgcggcatcgtcatctgtttgtgcgacagaacagaggacgaagcagagaggcgctataagtagagcagggcagcaggtagcgcagggtgcataatatcatacaatacatgtagtcaggcaattcacagtcagcacagtcactctatataatgcactgtcacttctcgcgtaggggagacggactacggccagctggtgtcagtatcagcagctagcatgcgctagcgcagtaggatgtagtgtagtgagtaatcgtacggtggtgctgtgtgtctatagactgatcggcagtgtgtgtccactgtcagtgccgtggacgcatggcgctgccagagcggggatagactagacggcgcgtcgccgtacatgtacaccgtacctaggtagggtagtacgcagatcctctgctctagcacagtatagtgtcagcacgacgttgaggctacagtgggagcatggagtgatgtacgaccgtgaccgctatcggatgcgctcagtatagaaccgtctatggatcaacgcgtggctgtgttaacattagtcagattgacagactggatatgacgatagtatacactagtgcgttggtgatgaagatagtgagnatagtatgaagactagttgaagactgtggtaggattgcaggtattcgcactatgtagtgtagcactgtacagaatgagacactgtactacagaactatagccattttgtcacagtacgaacctacatgtccgatgtacacctttgtcacctactcttcgtcgctacttcgacatacgatgacgttgatgagggatcattccagtcgtccgatgtcgttggcggctactgtatcgacgttgggcccaggagacccatgaccacgacgctaagtactgcacgcgagtgtgtcgcatgcctaataatacactacactactgtgacagagacagtttgaacaacacacacacgagcccatacgcgcagtgaccagttgtatgtggcgatgttgcgactgtctccattgacgcactgtccgcctatcctagacgtcacgcctaacgtatcagcactgttgggcttcttgggctctattcgattgcgatatcacttgcagcgagacgactgaccgagtggctgcgcgtagaatgctagtacccgcgataccataattatcagaacatacatcatacaacacgtcctacatctagcgtagacatcatcagacgaagagtgttgacggatatatgcgatgcgaggatgcaggagtacgaacaattgtgctatgtgtcaatcgcgacggtaacgtcgttcttgtgtgtagcgccgtaactgggcaacctgcttcccggctgctcgaccaggccagcgcacggcttcagtgtctgactgcgggtgcgcgcgctgtggcatagtctctggtgtactcgactcgctgtcatgactatgtcacagtagcatgacttactgcgtagtctatcatgtgatgtacttctagttgatccggaccccttatgtctggatagtagatgtcaggttgtgtgagttgtggtggatagcggttgattctactatctcgcagattccgtatgttagtatg

SEQ ID NO: 554321 - DNA, 255 bp, Homo sapiens
tcgatagactgggcctaagtttttttagcggatgtgatgtttacagagtgtcaccacaattacaggtatttcccaagtgattgttccccgctaagtgattgttccccgctaagtgattgttccccgctaagtgattgttccccgctaagtgattgttccccgctatagtgattgttccccgctaagtgattgttccccgctaagtgattgttccccgctaagtgattgttccccgctaagtgattgttccccgct

SEQ ID NO: 554322 - DNA, 301 bp, Homo sapiens
ccccagcccagggggccccaaaggtttccagtgccttggataaactgaaggagtttggaaaccccctggaggacaaggctcgggaactcttcagccgcatcaaacaaagtgaactttttgccaaaatgcgggggtggtttttaaagaccttttagaaagtgaaggagaaactcaagatttactttttggggccttaagggtgacatcccaggaggggccttttaaattttcccccccccagggcctgtgttgagggctccctccatgtggcccccggggccccccataaaaatccttcaga

SEQ ID NO: 554323 - DNA, 104 bp, Homo sapiens
tgaccatgtaggaggtagacaaaacagtccaacctcacatgaatcattagaggtgatcattgcactcccagacaccaagacactgagggctccacgggttgaaa

SEQ ID NO: 554324 - DNA, 606 bp, Homo sapiens
  misc_feature (201)..(201): n is a, c, g, or t
  misc_feature (208)..(208): n is a, c, g, or t
  misc_feature (227)..(227): n is a, c, g, or t
caccaccccatctctgacataggccaacctgaagtgctgggcctgggattctacctcgagaccacgctgactgtcagctgcatgggatggaacagcccaggacacaaagcttttgagccaggccgcagggattgaaccttccaaaagtgggccctttggttggtgccttcgaagagaacagagaacacatccatggcagcncgagggnctgccccagcccctcatcntgagatgggagcagtctccccagcccaccatccccatcgtgggcatcgttgctggccttgttgtccttggagctgtggtcactggagctgtggtcgctgctgtgatgtggaggaagaagagctcagaaagaccaaaggagctacttctcaggctgcaggaaagttgactcatactggtgtccagtgaagaaacccaggcgcataagagggacagttggatctcagggaggactgtcttcttctcacctccccggacgatgcttcttgacacaggaaagaggatgtgctgctagggtcatcatgtcctggtttattgtgttgtcagtagaatgaaatcaaaatacatacttcataaataataaaataacccataataaga

SEQ ID NO: 554325 - DNA, 325 bp, Homo sapiens
aatcatttgtcatcacactgcacacttacaaagaatgatatttggctggtgcgatgactcacgcctgtaatcccagcactttgggaggccgaggtgggtggatcacctgaggtcaggagttcgagaccagcctagccaacgtggcaaaaccctgtctctacgaaaaatacaaaagttagctgggtatagtggcgcatgtaatccagctatttgggaagctgaggcaggagaatcgcttgaacctgggaggtggcggttgcagtgagctgaggtggcgccactgcaccccagcctgggtaacagaatgagactccatctcaaaaaa

SEQ ID NO: 554326 - DNA, 364 bp, Homo sapiens
tatagcgcctaggtacccactgggggcttcctgttaacctggggactggtgtcattctggggcctaatgaccacctgggttgtattattcacctagggcctggtgtccacttggggcttgagtgtaaccttggacctggcacccacataggattgggtatcaaactggccccttggtgtccagttaagacatcatgtgaacctggctcctgagtgtccacttggggccaaatgactactgggggcctgaatgtcaacctagaatctgaggtttactaggggcctaggtatccacctggggcctaatgtccacccgagcctgggtgtcaacctggggcctgatgtaaacctctagttcagtatcc

SEQ ID NO: 554327 - DNA, 95 bp, Homo sapiens
accatggcggctaggaaccctatacaaggatcctgaaaactcgagggccttcaaggtcctcatcgctgcgcagtacagcggagggtcaggtactc

SEQ ID NO: 554328 - DNA, 322 bp, Homo sapiens
caaagccttatggattgaacattgcataaaataggccttgtgtgtggcgcagtggctcacgcctgtaatcccagcactttgggaggcccaggtgggtggaccacctgaggtcaggagttcaagaccagcctggccaacaaggagaaaccccatccccactaaaaatacaaaattagccaggtatggtggcgcatgcctgtaatcccagctacttgggaggctgaggcaggagagtcgcttgaacccaggaggcagaggttgtggtgagccgagatcacgccattgcactccagcctgggcaacaagagcaaaactccatctc

SEQ ID NO: 554329 - DNA, 247 bp, Homo sapiens
taatcaaccctaaatttattatcgggcttcatacggcagctggccaatgaaggctgtgacatccatgctatcatctattcacacaaagaaaaaagttgtctgtgtgcgcaaatccaaaacagacttgggcgaaatatattagtgcgtctcctcagataaaaaagtcaagaacatgtaacaactgtggcttttctgggaatggaattcggacatagacccaaagaacagacaagaaccttgctagggg

SEQ ID NO: 554330 - DNA, 396 bp, Homo sapiens
gagctcggtaccccgctggccagtggcagagcagattgcagagcagatgtaacagatttgttacagagccttctattctgggccccctcaaaactagcagcttttctggtcacttggtgattgggccggagtaacactcaaatgaggaatgtgttgcctccaaaatctagataaaggagttaagtgttatgcctttttcttggtagtaggaggagccagatgcaacaagtttatcctttaccctagaagagatagcatgacatgcctcacaccagtagatccctagacattacactgaggtagaaggcccttgaattttagtcagatttatttcccaagcccggctggcccaatggcatgttctcactcatgagcatctctcactctatttggagt

SEQ ID NO: 554331 - DNA, 417 bp, Homo sapiens
  misc_feature (285)..(285): n is a, c, g, or t
  misc_feature (289)..(289): n is a, c, g, or t
  misc_feature (309)..(309): n is a, c, g, or t
  misc_feature (342)..(342): n is a, c, g, or t
  misc_feature (374)..(375): n is a, c, g, or t
  misc_feature (390)..(390): n is a, c, g, or t
gctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatcccgccagggttntacntctcgagactatgtaatacntgccagctctaggtttcaaccctggcaggtttnattctgacttatctctcattttggcatgtggnnacactctaataaggngagtaccccgcgaactgcggatcctta

SEQ ID NO: 554332 - DNA, 100 bp, Homo sapiens
  misc_feature (85)..(87): n is a, c, g, or t
aattcaagcttctaacgatgtacggggacatgatgtcttttcttctttttcttttttttaacaaaacagaacaaaaccaaaaaannnccagaaaaaaaaa

SEQ ID NO: 554333 - DNA, 1104 bp, Homo sapiens
  misc_feature (298)..(298): n is a, c, g, or t
  misc_feature (306)..(306): n is a, c, g, or t
  misc_feature (342)..(342): n is a, c, g, or t
  misc_feature (643)..(643): n is a, c, g, or t
  misc_feature (654)..(655): n is a, c, g, or t
  misc_feature (665)..(665): n is a, c, g, or t
  misc_feature (681)..(681): n is a, c, g, or t
  misc_feature (683)..(683): n is a, c, g, or t
  misc_feature (1089)..(1091): n is a, c, g, or t
gctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcagtccagcgcaccgtaagagagacattnactgaccnatgtactacgtgccagctctagtttcagccttgggnaggtttattcgtggcttcctctgatttcggcatgtggagacactcctataaggagagtcaagcctgtgggagtagaataatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttgngctggcagctnnagagccctgntgtgggacgagcgaangngggtcaaaggaagacttgaagcacaagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgcttccctgtagctcttgcctccctctccatatctccttccctatacacctccctccccacacctccatactcccctgggcatcttctggcttgactggatggaaggagacttaggaacctaccagttggccatgatgtcttttcttctttttcttttttttaacaaaacagaacaaaaccaaaaaannnccagaaaaaaaaa

SEQ ID NO: 554334 - DNA, 668 bp, Homo sapiens
gaagctgggaggtaggcgcggggcggtcggctgcggtggcggcgtgggatgatggtctctcggcggcggagtcggaaacactgtgggtgacaactatctctgtacatgcatcaaatcttataaaatgtggctgggcatggtggtgcatgcctgtaatcccagctacttggaaaggctgaggctggagaatcacttgaatccaggagacggaggtggcatgtgagccagcagatttgcaccattgcactccagagttggcaacacggcaaagacctccgtctccatagaaacaagaaaacaccaaaaactttacatatgtgtataaagcctgtgtcagggattctggtactttcccttttaatctacagttggcaatatagaataattttcttacagcacatatatgctgtttccaagtactaccagcttttaataattaaagcctttatggtctggatagaacaacagagttttccacattcttacaaaaagtttttcctataacctaataacttttcctccatttccatgtggacaattgacaagaagtatggctaatacaaggctctctatggaaaaaaattaccatttggtacgtttggcatgcgaaattgtatgtagacacttttggcgtgttaacatttgaggaaaaacaaattggacattcg

SEQ ID NO: 554335 - DNA, 1057 bp, Homo sapiens
tagcggagagacgaacgaatatcgtcccgatggaccccgtccggggttgaggaccaaccgcgcctttgaacacggccaggccccaggccgtctgcgacagggagaggacccccggaggctgccttgcccaccgccaaagaagggaaacctcccggcgtgtagcgataggctccgaacccgccgtcccgaggcggacaaacccctagcgcgtggccaccaaggatcgccacgactggcccgccgggatcagtacgcaccttcatctgagcagttgcgaacaccaccgaagtaccagccatgtcctaggcgtgggaggcgcatcgtgcgtaagtagtaggcagctggagtgccaccgcatgcgtaggagctgacctcccagagagacctcattggcaggcggcaggtgccacagtgaggaggatgagcgtcgtcacaccggtggcagcggagatgaagcccccaacgccttcctcagaggcaaccccagagccatacacaagcccactcaggcacgctggagcaccagctcaccccagaagcccccaacacctgaagagagcaaagcagccgtcaccagtgctccaggaagatatatacattgtagggggtacagtcagaaggacaggacaatggggcggaagattctgccggacacagagtatgagctgagtatggggaagacacgtatacaggctcccagatttcttccagggcaagcacttctttctctatcggggagttccctgtggacgagcggcggaaactcatccgatatgtcacagccttctatggggagctcgaggactatatgagtgaccgggttcagtttgtgatcacagcacaggaatgggatcccagctttgaggagggcctgatggacaacccctccctggcattcgttcgtccccgatggatctacagttgcaatgtgaagcagaaatacttcctcaccagctctatgtggtgtgccacaggcctgaagatgtggctaacacacacaagacacacacacacacaaacacattaaaccagcagcgatgcatttaatattagtttt

SEQ ID NO: 554336 - DNA, 1203 bp, Homo sapiens
ggagagtcggagccacagacagagccctgcccaggccgagccggagctgcagcccgagctgctgtgtggtgccctcagcccctgtcctcttgtcctcctcagcctcgatctgccggaggctgctgggcaatgaccccgggactccaggccagcaggggtctgaagctgtttgggaaatgcagcgggactccattgaggaacgattggacatggcacccaagccacttccctgagtgcacggtagtacacacatgccaccagctggctgctgagcagtgtagggaataggcaggaccgggctagggcacctggacacccctacatgtgaccacacgtctgacagacattcatcagagcagcacgttcgtccagacagaacggtgccaacgttattcgggcattgggagcctggacccacagccataccccttgtggccagagcagcaacccctcgcatggccccgttacaattattagacactccacacacgctggaacccagattcctggcagagacaccaggacaaccatgcgaggctgtgccggaagacaacttatacaccaccagacactcagaccctggccgaggtagatcgactgggcagtggcttgagcgaccgatgcgactccctgaactcgctatgacagcccagcgtctgtgactatctggagccaacacgtggcagggccaaccagctccggacttggcgcccctgcggtacaaattaaacctgtcaacctacatcaacacaacagcagaacaaacaggactaccagccaatatgccgcaccgtagcgcgcgccaagaatcagccgccttaaccggtgacacccatcatcgctcgacccggccacaactgcgtcgcctgcactgcccccaatgccccatggcgagcaaaaactgtgaccccacgataggacacaccgcacaacaggatcacaccccagaagatgccgggccagcatgccacccaagcagaacgcgcaaggcgctgggtcacaacaggcgtcagccgagaagaaacacagctccgacccgctggccctgcgaacacacgcagagccgagcacccacagtaggacggcacggcaacaacagaagacacagcggacaagcgaacgcccaagccaccaaagacaacaacaacaccagagggcagtccgagtcacaagtagtagaagaacaaacacgacgagtagaac

SEQ ID NO: 554337 - DNA, 891 bp, Homo sapiens
tatgatggtgtgctcccaagactgaaggctctggagcaaggctgtgccgttgcttgggttgctgaagtgagaggaggctgttctcagccctttgccttttctgaaagctgtcctggccgggatcccagggaagaatggaggggactgagtagtatcatccatccagacatcatcccatttgcatccccctagttccagtccctgggcaacacccacaacgccctgggaagagtaatgaaggcaagccacttcgttgctcagacctgcttacaagacctttctcatgaggcctttgcaggggaatcttggaaagacttccttggaggggctacacgcgacaagatgcacacagaaggacactacggaaatgacacagtggagttattggaagtatcacatggacgacccatttattagagtattttggaaacatacatagcgcaaattttcctctcatgaccaccactctacaccaaaagcaattaatagatatggggaaatcatcaagcccataattttgacagagaaattagagcacattgggtccaaaaggaattcttcaacaaacagggaaataaaatttgtgtctgaagacagaaagaatgaagatgggtggagttatggagcaaggggggacaggcaaactttggaggatgaatgcattgaatgccaatggaaaagaaagacaatatatagggaattgatggatgagggaggaacaatagaatacacccagaggtggggtagaggacagggaaagttaacttgaataatcaattatcaacccaaaaataatactagcacgtggatggaataattctaattgaaatatcaggtatcatgataacgaagcatgtcttacatacaaggctcccatgtgagatcacaaac

SEQ ID NO: 554338 - DNA, 209 bp, Homo sapiens
catactatacaatcgagctggtaccgctcacctcggaaatcagcatttgaactatcagcatcttgcctgggaaacgagtgtctgtgatgcttcactagtatatttagttttgcagttggttgtttatttctgccctttttttgtgttgaagaattttggcacctggcgaagaagataatttggaatttgaagaagatttgccgaggtgg

SEQ ID NO: 554339 - DNA, 925 bp, Homo sapiens
  misc_feature (44)..(44): n is a, c, g, or t
  misc_feature (69)..(69): n is a, c, g, or t
  misc_feature (72)..(72): n is a, c, g, or t
  misc_feature (82)..(82): n is a, c, g, or t
  misc_feature (125)..(125): n is a, c, g, or t
  misc_feature (133)..(134): n is a, c, g, or t
  misc_feature (136)..(138): n is a, c, g, or t
  misc_feature (140)..(142): n is a, c, g, or t
  misc_feature (144)..(144): n is a, c, g, or t
  misc_feature (148)..(148): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (179)..(179): n is a, c, g, or t
  misc_feature (181)..(181): n is a, c, g, or t
  misc_feature (184)..(184): n is a, c, g, or t
  misc_feature (205)..(205): n is a, c, g, or t
  misc_feature (212)..(212): n is a, c, g, or t
  misc_feature (216)..(216): n is a, c, g, or t
  misc_feature (236)..(236): n is a, c, g, or t
  misc_feature (263)..(263): n is a, c, g, or t
  misc_feature (294)..(295): n is a, c, g, or t
  misc_feature (301)..(301): n is a, c, g, or t
  misc_feature (323)..(323): n is a, c, g, or t
  misc_feature (332)..(332): n is a, c, g, or t
  misc_feature (344)..(344): n is a, c, g, or t
  misc_feature (349)..(350): n is a, c, g, or t
  misc_feature (364)..(364): n is a, c, g, or t
  misc_feature (366)..(366): n is a, c, g, or t
  misc_feature (369)..(369): n is a, c, g, or t
  misc_feature (395)..(395): n is a, c, g, or t
  misc_feature (398)..(398): n is a, c, g, or t
  misc_feature (417)..(417): n is a, c, g, or t
  misc_feature (421)..(421): n is a, c, g, or t
  misc_feature (436)..(436): n is a, c, g, or t
  misc_feature (446)..(446): n is a, c, g, or t
  misc_feature (450)..(450): n is a, c, g, or t
  misc_feature (458)..(458): n is a, c, g, or t
  misc_feature (468)..(468): n is a, c, g, or t
  misc_feature (475)..(475): n is a, c, g, or t
  misc_feature (477)..(477): n is a, c, g, or t
  misc_feature (488)..(488): n is a, c, g, or t
  misc_feature (491)..(491): n is a, c, g, or t
  misc_feature (507)..(507): n is a, c, g, or t
  misc_feature (510)..(510): n is a, c, g, or t
  misc_feature (524)..(525): n is a, c, g, or t
  misc_feature (540)..(540): n is a, c, g, or t
  misc_feature (544)..(545): n is a, c, g, or t
  misc_feature (549)..(550): n is a, c, g, or t
  misc_feature (553)..(553): n is a, c, g, or t
  misc_feature (555)..(556): n is a, c, g, or t
  misc_feature (903)..(903): n is a, c, g, or t
tagtatagctatgcctctagtagccatggtggtgatgtggtgtncagggctgctattgcgtcgagagcnctnagacaccganatctgaggatgcgtcaagtccctgatgggcaatggcatagggngtgcgggnngnnnannngnggcntgcctgtataatttaaatcancgncgnagantncgntataatacgcaaatacaatanaaatgcnatgnaaagtagtgcgtgacaccanattgtttagggaataatggcgagaganaaaaaggtctgtgcgtgttcagtaccaatgnnattgcntttttcaaatatttcctatccnaggctggtnggatctaaatgnggggnncacagttatagagngnggngtgtgctggggaaatgctttagcggnagngacatttcttagagatggnttanatcagcagccactgnagagagagcnatanagggatanctcattctantatggcntngtgaatgctgngtntttttgtttttaaatnggngggttgtaggaggnngggatcaggcgagtntatnngggnncantnnccagacagcatgtgctcactttgcgtttctgtgtcagcattttgaacagtaaatatttttaaattaaggtttgtatatttgttagacataatgctattgcacatttagtggactgcaatatgcagtaaacatgacttagatgcactgggaaactaaaacaatgcgcttccttgctttattgtgatgttggctttaccgaggtggtctggaactgaacccacaatatctccgagatatacctgtactttttactaaaaatatttcatttgagaagtaaacctcaagaactaccaggacttttcagatgggaagagcgaggccctggcagggcgagtctaggtgtgcanctagtgggggcggggtcaagtc

SEQ ID NO: 554340 - DNA, 646 bp, Homo sapiens
agcggattggtgtggcggcggcagggcctgggcctgagcgggtccccggggctgagcgccgggctccgcgccgccctcccgcgccacctgaccaagcgggcgcatatcctctccgagacaagatggcaaccccggcggcggtcaaccctccggaaatggcttcagacataccgtggatctgtgacagttgcccgttggcccctatggcaggcgcaccggacgaggtgaccgatggcgggggccatgccatgcccgtggaggaaagcggcgttccggaatggacgttcgatgatgaagatggatgaaggccccagtaaatgctcacgagagaatcatagtgaaatcgaacggctgcaggacggaacacagatgactcagtacatcacggagctctccgacatggtcccctacatgcagcagcaactgagctcggaagccgagacaagctcaccagtcctccgcatggccagtctcgcacatgaagtccatgaagggtacagggaacaagtccaccgattggtgcgtacaagccttccgtttcctcacagagcaggaactgaaagcatctcatccttgaagcagctgatggatttctgtacgtaggtggctgctgagacgtgggcgagtgacttatgtgtctgactcc

SEQ ID NO: 554341 - DNA, 242 bp, Homo sapiens
tttttttttttgaggtattgatgctttattattctgcaggttacgtgtccaggtgcccaggctcggggcccagtaactcagcgtactcttggtggcttacttcagggcttttatggggggcggccacgcccatcttaatcaccagaatgaggaactccgggaagttaactgcaccatccagtgtggatatccaacctcttggaacgcgacgggaccatggcttttatttcacaacactatat

SEQ ID NO: 554342 - DNA, 422 bp, Homo sapiens
tcagcaccactgtgaggactggtgcaactaactctgccttggcaaaatcatggtaaggctcgccatcacacagtgccagtttgatgtcagcgttgaaccacggaggcaagaaacaagaatccaaaccatgtttctagcctgggtcaaaatgcggcaagagttactctcgaacgtcccaggcagagactggcccagtccgcctctttggactaagagctgagtgatgtgacaagggcgacacaccaggtgccgtgaaggcagggccatctcctccagctgagcgaagctcctccctggcaaccgtaacggcactgaacaagctgtttcacctggagggggttgactgaccccgcatgtcaggccggggtttggctttcccaacagttaccatctttccccgctgtcgcccttgtcttctgacc

SEQ ID NO: 554343 - DNA, 367 bp, Homo sapiens
  misc_feature (14)..(14): n is a, c, g, or t
  misc_feature (22)..(22): n is a, c, g, or t
  misc_feature (48)..(48): n is a, c, g, or t
  misc_feature (50)..(50): n is a, c, g, or t
  misc_feature (54)..(54): n is a, c, g, or t
  misc_feature (66)..(66): n is a, c, g, or t
  misc_feature (69)..(69): n is a, c, g, or t
  misc_feature (76)..(76): n is a, c, g, or t
  misc_feature (105)..(105): n is a, c, g, or t
  misc_feature (111)..(111): n is a, c, g, or t
  misc_feature (147)..(147): n is a, c, g, or t
  misc_feature (208)..(208): n is a, c, g, or t
  misc_feature (255)..(255): n is a, c, g, or t
  misc_feature (279)..(279): n is a, c, g, or t
  misc_feature (290)..(290): n is a, c, g, or t
  misc_feature (294)..(294): n is a, c, g, or t
  misc_feature (312)..(312): n is a, c, g, or t
gggcgaccgccgcnagtccgcngtagttcggggccaaggaggcggacngngcgnctcacccagcanggngggggcngcggggccgcaggcgacgaggcacctgcncggggncccggacgggccctaggcgccccgctgtgagcgacnctggtggcgcgcgctagcgcccaagcataccaagcgacgcgtaggcgcacggtatggacgncaggcacgctactaccgccgcatagccgccctgggcgtgcgcgaacnatatcgtgctggctcgccagacgnacggggtgcantgcncaccactacccggcagtntacctgggacctcctagcacgagtgcaccgactcgaatccttagcacctaccgac

SEQ ID NO: 554344 - DNA, 430 bp, Homo sapiens
ggtgccctcagctcaaagggaaagccttacgtgaccaatggagtgagctctaccaaaacctgacccgggaacaagccgactacggggtctcccacatgaagccctacgttgacgtgaaggtgccgcgagcccccccccgggttcgactacttggagttcacccgctcgcttaaggagaactgagccaatccctgggatcacccaccccatcgctgcttgccctgcgtcgccttgctgcatgtccgctcctctgtgtgctcatcacttatccactgtacaccttaagccggcattagctgggaataagacttaggaaaaaagggtgcttcaataacccgctatcggggtccggtcaacaatcatcatgtcactggggggacccagatcggtgtctatgaagcagaatgccctctttccgactatacagaaa

SEQ ID NO: 554345 - DNA, 951 bp, Homo sapiens
atgctctctctggaccgatcccactgaagatgatgagaagcttattgaggaaatccagaaggaggctgaagaggaacagacaagaaagaatggagagaacaccttcaaagcgcacttgtgactcctccgactgtgagaaggcctgtggagtaaggtgctagaggtgtggaggccctcccgaggatccgtatacctgcagtagacctgaccagcagccagcagatgctcaccctatgcctttcgcggcacccgagctcctttcgctccctgatccttcgccgatggcggctctgtgatttcaacatagaattctcgcacctgcgaacgatggaggaaccgtgatccgcagagcctccgtgaacgttgtcgccgcacttctgtccacagacgatggccgtgggtgcagaactaaattgacatctctagggttccccaatgcccagaagtagaaccccttgtggatgacagctaactcgtgtgcacaatagaccactatatgcgaaaccacgcagagatccggccgggagagtacgagcatttccttgaattagtgaccacctctgagagtacgccaccactgtggaagctagtagaacaaaacagaaccaagggataatatggagagataagtggatggttgatagggattggaggagaagacgtcgtaaacccacaaaagcagattagggtgattcgtggtaagccaaaagccgattacataaagagtacaagactgtgcatatgcgggtaggagcattgggttataacctattccgcactcgccccttttcacgtaaaacagtgggacgtatccagtcgcaccatggcgaaagcagtcgggactggcattccaaataagtaataaaacccatccacaaaactgcaacgcgaagtaacatgagaagaaacattgcgacatgtgtcactaggccggcttgcacttccgcaata

SEQ ID NO: 554346 - DNA, 200 bp, Homo sapiens
  misc_feature (190)..(190): n is a, c, g, or t
ggtcggaggctgcgtcctgcgttgggctccaggtggtgctctgaatgtcttcctctgctgctctgcaatccagttgctgccttgcttgcactagtcgacccggtctgggatgacctgatctaaaacacatagtctctccggtattatccggcttacataattgggctaggatttccctatattagcttanagaaagtagg

SEQ ID NO: 554347 - DNA, 522 bp, Homo sapiens
  misc_feature (139)..(139): n is a, c, g, or t
  misc_feature (314)..(314): n is a, c, g, or t
  misc_feature (350)..(350): n is a, c, g, or t
  misc_feature (404)..(404): n is a, c, g, or t
  misc_feature (406)..(406): n is a, c, g, or t
  misc_feature (486)..(486): n is a, c, g, or t
  misc_feature (494)..(494): n is a, c, g, or t
gcggtcaaggcagccatctcgccgtgagacagcaagtgtcggatccgcagcgcacgtggcgatgttgtcctctacagccatgtattcggctgctggcagagacttggggatggaaccgcacagagccgcggccctttgnagctgcgatttcgccctacgttttcaacggaggtactatactggcaatgctggagaagatttgcaatgttgcttctgatactcgattgagtgaaggttttcaatcatacgcggatagccccaaatgttacaattaacagacaaaacatcattggatgcagcgttttcatggagangtctacgctgacaaagattattgaagcagactaagngtatagcattccatataagccagactacggggcattgctgcatgcgtctacaancngtaatcagggcttctttccaactagtttacaacatcatcggggacttgatgggggggtgtatacactttgatccataggnctaccggnatccttcaggtggagcccacatgccagt

SEQ ID NO: 554348 - DNA, 187 bp, Homo sapiens
ccggttgacggagcttcggtcatgtgtccacaggagaaactaacattcagttagtcttaattttacgttcgttctaccctttaaggagtttgtttccatcagttgttgactttccaataatgttgcattaagttatacgttgtcactctgtttggtctcatggtgcaatatcaatacagactttcat

SEQ ID NO: 554349 - DNA, 349 bp, Homo sapiens
  misc_feature (349)..(349): n is a, c, g, or t
cgcgaccatgaccctgaccccgtccgtcgagctcattcttcttcctctctgctggccgtgtgtctcgtgtggtgcgacggatctttagcttatgtctggccttttcctgttgtctcatcccagcatactgagttatttattaattagttgatttatttttgcctttttaaattttaacttatatcagtcacttgccactcccccaccctcttgtccacaactcctttccactttaggccaatttttctctcttagatcttccagcagccccaggggtaggaagctcctcttagtactaagagacttcaagcttcttgctttaagtcctcaccctttacattatctaatn

SEQ ID NO: 554350 - DNA, 101 bp, Homo sapiens
tggtcgactactactggctgaccagcactttgggaggcgaggtgggtggattgcttgaggcagtagtgggtcagccagtagtgggtcggcagtagtgggtc

SEQ ID NO: 554351 - DNA, 123 bp, Homo sapiens
cttgcacctgcagtctcagagtagctgggactacaggcgggtacatcaggcccagacaggtaaagaaaaaaattcttggtaaatatgtggtctgctgtgttggccatactggtcttgaactcc

SEQ ID NO: 554352 - DNA, 547 bp, Homo sapiens
  misc_feature (265)..(265): n is a, c, g, or t
  misc_feature (284)..(284): n is a, c, g, or t
  misc_feature (320)..(321): n is a, c, g, or t
  misc_feature (325)..(326): n is a, c, g, or t
  misc_feature (343)..(343): n is a, c, g, or t
  misc_feature (347)..(348): n is a, c, g, or t
  misc_feature (352)..(352): n is a, c, g, or t
  misc_feature (357)..(357): n is a, c, g, or t
acaattacttaacatcccccctcccagaagaagtggatgaacccagtgctgaagatgagggtgtctctccgaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagancgagctcgcctatgagcangtggcaaaggccctcaaataagcccctcctgggacnncctnnaccccctccattttctncacnnaggncctgntggtttccacattgctacccaatgaacacactacaaaatggccagtgggcagggaatcctggagatattgaaccggcgaagggtgtggtggaagaggggatgagggaaagaaatgggaggcctgggtaagatttttattgtagggtgggatgagtaggacaacatatttcagtagataaaatacagaata

SEQ ID NO: 554353 - DNA, 417 bp, Homo sapiens
  misc_feature (334)..(334): n is a, c, g, or t
  misc_feature (404)..(404): n is a, c, g, or t
  misc_feature (412)..(412): n is a, c, g, or t
ggttaccctggagaactgggcttttgagtgctgagaaatgctcaaggcatcgtggtatagtggaaagcatatgggctttggagccagcctctaattgtgagctgtatgagtgacttcatttaagctttttaaaatttcactgaattaatttccatatccaaagtgctgggattataggcatgagccactgtgcctgcaacgccaggctaaatttttgtatttttagtagagatggggtttcaccgtgttggccaggctggtgtcgaactccgggcctcaggtggtctgcccgcctcagcctcccaaagtgctggggattatagggcgtgacacnccacacctgggcaaagaggaagtatttttaaattttagtttttcaacctcacacaatttaagtaactttngggttttngggtg

SEQ ID NO: 554354 - DNA, 475 bp, Homo sapiens
  misc_feature (265)..(265): n is a, c, g, or t
  misc_feature (284)..(284): n is a, c, g, or t
  misc_feature (320)..(321): n is a, c, g, or t
  misc_feature (325)..(326): n is a, c, g, or t
  misc_feature (343)..(343): n is a, c, g, or t
  misc_feature (347)..(348): n is a, c, g, or t
  misc_feature (352)..(352): n is a, c, g, or t
  misc_feature (357)..(357): n is a, c, g, or t
acaattacttaacatcccccctcccagaagaagtggatgaacccagtgctgaagatgagggtgtctctccgaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagancgagctcgcctatgagcangtggcaaaggccctcaaataagcccctcctgggacnncctnnaccccctccattttctncacnnaggncctgntggtttccacattgctacgctactggactctttactcgcacgcgcctgtgcgccgtggatcctggcgcacttgtctccgggatggtctcgtgtgatgacgcgactgccgatagaaatc

SEQ ID NO: 554355 - DNA, 226 bp, Homo sapiens
gcttcggcctcccaaagtgctgggattacaggcgtgagcccccgcgcctggcaatttttgtatttttaataaagacggggtttccccatgttggctaggatggtctccatctcctgaccttgggatttgcccgcctcggcctcccaaagtgttgggattacaggtgtgagcccccgcgctcggccgagcttattcttaaaatacagtaaaaacttttagctctcca

SEQ ID NO: 554356 - DNA, 139 bp, Homo sapiens
ttcctgcccaacacatgtttctcttttcctcaaggggtttggggcaggagcctgggcacttactccccgtttgggttgtttctccttctgaccaagctctggggtgtaatgcccccatttatttgtaaaaaaaacaaaa

SEQ ID NO: 554357 - DNA, 876 bp, Homo sapiens
  misc_feature (600)..(600): n is a, c, g, or t
agaggccttagcaatgatttggtttttttcttaagagacgggagtctggtgtgtgctcaggctggacttgaactcctgggctcaaatgttcttcctgccttagccttctaagtagctgggactacaggagtgcatccctgtacctgccttggttttttcttgtattgatacataataattgtacatattattgttatttttttttttggagaccagcgtctttactctatcgtctaggctgagtgcaggggcacaatcagtggttcatttcaagcctcaacctccggggctcaagcaaatccttctttgcctcagcctcctgagtagctgggaccataggcgcgtgccaccatgcccagtaaattttaattttttggtagagacgggatctgtatgtggcccacacttagtctcaaactccgtggtctcaagcgatcctcctgctttggcctcccaaagtgctgggattacaggcgtgagccaccacgtttaagcctgagtataatttaaatagccctatgtgacagtggctacttttatgacagtgtagatctagatatttcctcagtgttgtgcttcaaaggactacttcggatgggnaaccagcgggtggattccggcccgggtgattcaatcacgactgggtcaggaacaatctccagtaacaccaggggtctacaagctagtatgtaatctaatactgggcccttaagtacgacacacaaacaacagtgcacaacagaaaaaaaatgtggggccgcccgaatttaaactggggggccggaaagacgcgcccaacggcaaggggtccaaacggcggggaaatggttgtatcgtctcccccggacaacaaagagaatgccatcgccacgacga

SEQ ID NO: 554358 - DNA, 111 bp, Homo sapiens
gaggaattagaggaagagacagcaaaggtagaacctgctgactttcctgttgagcaacctgaagaaaattaaattataaggtattagcattttacaggagctttacaattc

SEQ ID NO: 554359 - DNA, 233 bp, Homo sapiens
cgggaggcagccagtccaggcgcccgctagcttcggcggcgcccagacggggaaagcggaaggaatgtcgcgtacaagcaggcagctggtttgaagaatgccggtgagacattcagtgaaggagacgaccatctcgtgagaacagactgagtcagtacgtacgtacagggacgtacagggacggggtaaccacgtgttggaacgtccgggagtgagagccgtgaccaaggacg

SEQ ID NO: 554360 - DNA, 163 bp, Homo sapiens
ttcagccgcaccgcaaagtagactatggcagcggaagcggttgacccctggaacatgccaggggagctaactggacgccgagctggaacaggccgccgcgaaggagaattaggcacagagagaagaagcgctgcgaggcagcctgacgggcactgaagagcca

SEQ ID NO: 554361 - DNA, 790 bp, Homo sapiens
  misc_feature (24)..(24): n is a, c, g, or t
  misc_feature (28)..(28): n is a, c, g, or t
  misc_feature (30)..(30): n is a, c, g, or t
  misc_feature (157)..(157): n is a, c, g, or t
  misc_feature (159)..(159): n is a, c, g, or t
  misc_feature (167)..(167): n is a, c, g, or t
  misc_feature (171)..(171): n is a, c, g, or t
  misc_feature (221)..(221): n is a, c, g, or t
  misc_feature (229)..(229): n is a, c, g, or t
  misc_feature (239)..(239): n is a, c, g, or t
  misc_feature (253)..(253): n is a, c, g, or t
  misc_feature (260)..(261): n is a, c, g, or t
  misc_feature (267)..(267): n is a, c, g, or t
  misc_feature (344)..(344): n is a, c, g, or t
  misc_feature (349)..(349): n is a, c, g, or t
  misc_feature (445)..(445): n is a, c, g, or t
  misc_feature (447)..(447): n is a, c, g, or t
  misc_feature (465)..(465): n is a, c, g, or t
  misc_feature (477)..(477): n is a, c, g, or t
  misc_feature (491)..(491): n is a, c, g, or t
  misc_feature (675)..(675): n is a, c, g, or t
  misc_feature (677)..(677): n is a, c, g, or t
  misc_feature (680)..(680): n is a, c, g, or t
  misc_feature (781)..(781): n is a, c, g, or t
ctcatgcaaaggaatgaaaggtgngagngnatacagcgcgctctcaagctggaatatccaggttcgtgcgctttgggactaattgggcaaacaatcttgacccacagtaagaacaaagaaaagcggggtggggtggcggtcccacctgggagcagcncngtgccaanggtncccccatcctccagccaatgggaagcgatgctggcctagtagatgctganatagaatncagcctagancctaacactatttnctgtatnntttttnctccaggatggagaggggattcttaccacaatgcaaccaccgtcaatggccccccagtgaatcgaccagcctttggngcgcntcaggttgtgggaagtcatcagccattgctagctgtgactgctgtggtaagcctgatcacctattgtgggcaatgtcttggtcatgttctccttcntngtcggcgagccagctcangacagttaacanctattacctgctcngctttgcgctgtgcagatctcatcattggaatcttctccatgaacctctacaccacctacatcctcatgggtcgctgggctctcgggagtctggcttgtgacctttggcttgcactggactatcgtgtgccagcgacgcttctgtcatgaaccttctggtgatcagttttgaccgttacttttncntcncaagacccttgacatatcgggccaagcgtactccgaaaagggctggcatcatgattggcttggcctggctgatctccttcatcctctgggccccagcaatnctctgctgg

SEQ ID NO: 554362 - DNA, 615 bp, Homo sapiens
  misc_feature (571)..(571): n is a, c, g, or t
tatgtcctcgatgcgttatctactcttagcctctctgtgaaaaaccactagaaagcatccaacccggaactttttaaacgaactactcaaccgtcttctttccctccaatcagttccattgggttcctcctcttacataacgttttcctcatggtttaatttttttttggagacagagtctggctctgtcacccaggcgggaatgccgtggcacaatctcagctcactacaagctccgcctcccgggttcacgccattctcctgcctcagcctcccaagtagtggggactacaggtgcccgaaaccaggcccagctaatttggtttggtttggttttggtattttcagtagagacggggtttcacggtgttagccagatgggtctcaatctccggacctcgtgatcggcctgcctcggcctcccaaagtgctgggattacaggcgtgagccaccaggccgggccttgggcttgtcattcttaccagtatctacggctaagttcctaaagggtcttcccaggccacctgcatcagaatcctatgggctgatcgttacccatgaagttcctgnacaccgcccaggctactgaatcaaatcccactaaatttatctat

SEQ ID NO: 554363 - DNA, 234 bp, Homo sapiens
tgatgagtcgatctaaggatccccgtctgtgataccaggctgagtgcagtggcaggatcttggctcactgcaacctcccaagctcaagccatcctcccacctcagtctcctgagtagttgggactactggcatgtgcccccattcctgattagtttttttgtatttttggtagagatggggtcttgctatattgcctaatttttgtgtttttagtagagatgggtagtcacaga

SEQ ID NO: 554364 - DNA, 126 bp, Homo sapiens
ggtgatcttttcttacaaagaacagctgtacattaaaggaagctcatatttttcaaagctgggcaccattaaaaataacaaagtccaggaaacaaccaagaggtcttaaggaaccatagggtttaa

SEQ ID NO: 554365 - DNA, 1311 bp, Homo sapiens
  misc_feature (239)..(239): n is a, c, g, or t
  misc_feature (492)..(492): n is a, c, g, or t
  misc_feature (1286)..(1286): n is a, c, g, or t
agcggattactggggctaagcagggaacctgcaaatctcatggtgaagccatcctcaagccagctgcctaccctttaatagatacatataaaatgtcgctagtgcaattcggcactgtggttcttgttcccaaagggacatgggtctccagggaatcgaacctaagggaacgactagctgataagcttctgttgacgtctctggacatgcatgacatcacatgctggtcacagctgggnacacggatgaaggtgacgaactggaggacgccatctcttcctgtggtattcatgacctatggctgcctaggacgctgaaagattacagcaccttggggcagccgatggcatggtgtcaacacgcgtccacagggcatacaagtcgtcattaccatgacgactgtctcctcaatatactgatccgtcctgaggcacacgcatactaacactacccctgtggagatgccacgcatagggaaccatgaaactcttncatattcgcttaccattccgcgctgtcgcgacgatggaggaacgcacatcactacttatcggcgtggcactacgcgttgcgctttgtacctgaacgaggcctccaggctttgaagaggaaatgaagccagttgaggaaagctttcatcataacaacatgtgggacctccaaataacactcttgccaccgtcccacaagaagagattctggctcatggcaccaaacaaggggcatacctgtgtttgaccgtccgtttgcaaatacatggaccatgggaactggccctccaagaaggcgaacggattactctcactctcacttgcgttcccgtgaagcccaagagggagacgcaatcgcgtggcaatggggcgcggcttcctgtggggccctactctgtgagctttcacaccgggacaagcccttccacccttagagaaagctcggaagcaaaaaactaatgagccaaagatttcgtcagagaccacacagcccaagggaactcccaccattccaatacggatcgtttgaaagaacctggaacctaagtgaaatagccgccacaaggaagcggagtttcttcccatgggttccctcccatggaaagttatacttcccctggtcgcgtttgtcaagaaattatcctaggccacgtaattgcccccaattcgttccccctaaggtctccttctggtttggaagcggcttccctacttagttatggcgcgcgttcccttggaaagattatacccacacatgtcgcctctatcctctgcccaaaaaaggcgtgagtcttntctcaagcaacacaatttcatatcg

SEQ ID NO: 554366 - DNA, 800 bp, Homo sapiens
  misc_feature (800)..(800): n is a, c, g, or t
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaccaaaggacacaaaaaaaattaggggtaatttccccttttcccccaggccttttttcctggtggggttagcgccaaaataaattcccctcttcgggacctcaaaacttaccccaaaggcaggggtacatggtaaatattattgtcacccttattccacgggaacccattgctttgggccggtataattactttggctaaggggtacaacttttatttaccccgccaatattattgccccttacatttttttcaacaaaagggggaacaacaacacacggaacgggggttcccaggtcttaaattccatttccccgggggcagcggtgaatcaccccggaggtcgtgggcggccgagctgtggtggcccgtggtacgggcggtacgggggtaccacgcggggcagcgacagggtagccacaaagaggggcgcgggatccccccattatacttttgccccccccctctgcggctgccccatattaatttcacaacaggaccttcgtggtgtcggggggaacaagcaagcgcgaatatccggccaaacaactatgctcaaccgtttttacacctatcgttaatctcgcaagattccgagcacatctctacccacgggggcacacaaccaaaagcgggcagagcacccatagaatgtggcccn

SEQ ID NO: 554367 - DNA, 295 bp, Homo sapiens
gtgatgctcctgactgagcctcccatgtagctgggactacaggcgccaccaccacacctggtaattctttttatttttggtagggatggggtttcaccatgttagccaagatggtcttgatctcctgacctcgtgacccaccggcctcggcctcccaaagtgctaggattgcaggcgcgagctactgtgcttggccctgtctttaactttaaaagtgccagctgaggggggattttctacgttacaaatctcttccctcatatagattcatcccacttctaggttgatgactcat

SEQ ID NO: 554368 - DNA, 179 bp, Homo sapiens
  misc_feature (49)..(49): n is a, c, g, or t
  misc_feature (72)..(72): n is a, c, g, or t
  misc_feature (109)..(109): n is a, c, g, or t
  misc_feature (137)..(137): n is a, c, g, or t
  misc_feature (164)..(164): n is a, c, g, or t
gctctcgtccagaagctttcgtagattggcgtcgtcagcgttgagctcnccgtcccacggccagaagtcagnctctgcatcctcagcctccgtggactccacgcccgcngcagcagccgctcctgccgcacaggccngggcaccacgtcttccttcactgcgtntcctgctggtgctgc

SEQ ID NO: 554369 - DNA, 1372 bp, Homo sapiens
  misc_feature (493)..(493): n is a, c, g, or t
  misc_feature (501)..(501): n is a, c, g, or t
  misc_feature (503)..(503): n is a, c, g, or t
  misc_feature (546)..(546): n is a, c, g, or t
atgaaaagttaaaggaagacttagaaagggaacaacggtggttggatgaacagcaacagatcaatggaatctcttcaatgtactacacagtgaattgcacacacataaggttgaaacattttctgacatccaagcaatctttcaatgaactgaaaactaacacatgcttcaatatacaaagaatatcaaggagaaactcttgagtaccttgggcgagtttctagaagaccattttcctctgcctgatagaagtgttcaacaagaacaaaacgacaccaacattcaagaatcatctgtaaacctgataacactgcatgaacatgttcagagattcttataaatagattatttgatgttccacatgatccatatgtcaaacattagtgattccttttggccaccttatgtagagctgctgctgcgtacatggacattgccttgagacatccagaagatccaacccgaataagattagaagctttccatcagtacnaggatgtntncttttttcacacagtaacaaattcttatcattcaaggcatatnggaaccacaggactatttgcctcacgaaacgattattggcaaattcaatgcgcataggccatctatacttttattggcgaaaatggcatgtgctgccatctatcgattcatttttaacatggtcatttcttattcagtgagtgcttcacgtcgttttacaactatatggcatacgcaatgcaggtagcatccatattctaggctataacaaccatttcaatgtagccttacctcatgcacatatcgcttgggattcttggtcgatttcatgatatagctaagtatccatattttcgttaaaatatatcagcaatcatctcttatgcatttcggagtccagctggtgcttcttgcatcatcccagcacacattcattccatgcggcaaggtcattcaatttgccagcatgcggctccacacatcgcaggtaataatctggaggtggcataattttaccacacatattcacgcacatcgggtcccactaatactacttgtcctactttctacgactacggttcacaccttcggcactactgcaccaccttacatcgactacaagctaacccctacaattggatacttcaacgccggcatattcaacatactccatgtgaccgtcactatagtcgagccacatgtggaagccggctaattcatttcccaccaagcgtgggtatacgtgacctttcattcacccccttgggacaatccttggacacgaaatagatgtcgacacacttcagacaaactgggtacacatacagagcacgtgtgtcgcccacccagcacaacattgaacacgtgaagtcgccgccatcgacac

SEQ ID NO: 554370 - DNA, 1132 bp, Homo sapiens
  misc_feature (688)..(688): n is a, c, g, or t
gttttgggggtccacaagaggaccacacttgggtgaaacaggaaattctctttgtagagcaacaaagtgggatgtttcccccccgtctgggggtaaacagaggggggaaacccgcggggcacgctgttgaataggttgttccgaatataatttcttttcccgcggcgtttccccctacacgattgtgatgccttgggagtttttcgcccgcctcgtaggggagcactcttcctagataattcttcgtagcgagagaacgtgttttcaggagaccgccctctctagtgacacgtttgcccaccctgggggggccccacagaggttgttgcgagagcaataatttgtagaggcgtcgcgctctttacacatcagagggagagattgggaacatatttttttggtagattgttttttggggggcgttttatagactcgcttggttaccgcacgcctgtgtctgcacatagggtttctcgccggaggcgctccaaacagtctcacattgtgggcgcgtcctctgatgagagatatgtgtgttttgttctcaagatattttgggtgttgttttgtcgccacagagcttgtgggagatgccacatatgggcgcgccccattttttgggcgtctaacatgcgccacatctccacactttctccgggggtctaaaaagcgatttttctcaagcgcnttaagcctttcgtgaggtatagctatggagctttcacaggtgtttctccaccacacgccccgggtataattttttgtaattgtttatagtatgaagaatgtgggtttctcgccacatagttgtgcacacaggctggggtttctcggaactttcttggcctctacaggtggtggtccccgccgcctctcgcgcttcccacagcggcttaggattatcacggtgtgaggcccccgtgcccacggcgcctcagtatggttttaaaggggtctcccagccctcctcccttttgggcgccgacccgcgttatttctgcgtccctttttccccggcgctcatgcccccccccagatttcacagggggcacccccacccaggggccctgttccgtgagaaaaagtggaatacgaatttgggcccaaagccataaaccttttgtttgtacga

SEQ ID NO: 554371 - DNA, 245 bp, Homo sapiens
cgcaagattctgtgggcacctggtatctgcaccgcaggaggagagctggccgtggcccggccaggaggggcagtaaacacccagcccagccccacctgccccctatctgtgcaatagcacgagggtctctatatggcaccctcgggtctaatcagttgtgtgcgtggccacacactgcagtcccgtactcatgcacctagcctggcgcctttttggggatcctcgcagaagaggtaagagccagg

SEQ ID NO: 554372 - DNA, 1101 bp, Homo sapiens
tccttcgtgcgtaataaatcttgatgagaaggcagtaactaccaccatactctatcgtaattactggtaagaatagtggttcggaacgacatatactccacttctatgcctattaagagagtatcactgatacgattccacactctgtaaggtcaattccataaacctctttcacatctcactctgaatcaatctagtgacactggatttacgtagtcttattgttggtgtgtcaacacgagctaggaactcagctctcctcacataagtcctccagtttcactgccagcgtcactagtgcacgggatatttatagatgcctataactctcattacactcaccctgcagagcatgtcacgtcatgtgcaggtacccagcaggttcatctcttgtaccactggaagatggatgttacgcaccaatcacattaaatatgctgggctctctaaggaaagcctcgtgtgagggttcctctttcttccatgcttcaatgcccatgggcaaagtgatcatgaattcctcatttacgtgttaccaatgacatatatcttaactgaagcatataacttctcagtttccatgttcttcaaaattttaggataagaagcccgctaaggaacaaaggaaatgccctcccgtgcttaattgatggcaagcaggggctggaggagccatctgagggactctttcatttctgcagttgtctggaaagccctgggtgggcgtcatgaggcttcacaggatccatggcttttcctggtcctggcgttccagagggtcatagggctggtctggtgaaaaggttcaccgtggtcccaatgctgaacttcattgcataaccttatggatgtgcttctgggccatacagaaatgactctggtacggtccgacccctcaggaaatttgtattttacacggcaaaatgctcccgtgtttgtaacgaacactgggttcatggtctccagatcattacgggttacctcaatcagcaccaccaaactgtagctgaatatttgacaccacaagccgcgtgttattacactacttctgaaaaaaaggggggatacacgacaccaactattcatggttatacggcccac

SEQ ID NO: 554373 - DNA, 309 bp, Homo sapiens
  misc_feature (92)..(92): n is a, c, g, or t
  misc_feature (299)..(299): n is a, c, g, or t
ggccctgaacatgggctttgagtaattttccttaaccatcacactgatcccataagctgctgcttacataccaggggaaatcaataaaaatncttgatattcccaaagggccctaaagtataaggttttttggtccatccaacagccacagggcaggatatgcatcccattaccattcctacttttaaaaaactaagggccaaataaggctcttcaaaaaaattttagctttggaaacccgaggcaagaggatcactcgagagcaggagttcaagaccagtttgggcaacacagcaagnctctttctca

SEQ ID NO: 554374 - DNA, 178 bp, Homo sapiens
atgcgttatgtaggctagttctttcaataggtctaacaagtatacttatttaagccccatgtagataacagaccttaataaaaaatggtgccactcttatttgaaatgaaagaaaagagataccagtctggccaatatggggaaaccctgtctctactaaaaatacagaaattagctg

SEQ ID NO: 554375 - DNA, 223 bp, Homo sapiens
aaaccaaatgaaagagacctctgcatggacatgtccatgcttatcaacattacagatctgtgttagacattgggagtcatcagctcgatttgtatgacttatatgcttcctgggctgactaattatcaaagtactactgcaccagtgcaattcacacctacctgaccaatgactgtaagaagtcgaaggacccagagaatcatttgattgtactttcacagtg

SEQ ID NO: 554376 - DNA, 417 bp, Homo sapiens
  misc_feature (13)..(13): n is a, c, g, or t
  misc_feature (19)..(19): n is a, c, g, or t
  misc_feature (26)..(26): n is a, c, g, or t
  misc_feature (33)..(33): n is a, c, g, or t
  misc_feature (39)..(39): n is a, c, g, or t
  misc_feature (43)..(43): n is a, c, g, or t
  misc_feature (54)..(54): n is a, c, g, or t
  misc_feature (57)..(57): n is a, c, g, or t
  misc_feature (73)..(75): n is a, c, g, or t
  misc_feature (95)..(95): n is a, c, g, or t
  misc_feature (101)..(101): n is a, c, g, or t
  misc_feature (105)..(105): n is a, c, g, or t
  misc_feature (110)..(110): n is a, c, g, or t
  misc_feature (133)..(133): n is a, c, g, or t
  misc_feature (139)..(140): n is a, c, g, or t
  misc_feature (166)..(166): n is a, c, g, or t
  misc_feature (181)..(181): n is a, c, g, or t
  misc_feature (193)..(193): n is a, c, g, or t
  misc_feature (195)..(195): n is a, c, g, or t
  misc_feature (216)..(216): n is a, c, g, or t
  misc_feature (221)..(221): n is a, c, g, or t
  misc_feature (230)..(231): n is a, c, g, or t
  misc_feature (256)..(256): n is a, c, g, or t
  misc_feature (268)..(268): n is a, c, g, or t
  misc_feature (334)..(334): n is a, c, g, or t
  misc_feature (344)..(344): n is a, c, g, or t
  misc_feature (389)..(389): n is a, c, g, or t
aaagttgctattncccgtnaaaggcnctagagntagtgntttnccctcaataanttnaatttttaaaaaatgnnncttccctctccccttttttntttttnaaanaatanatttggtcataaagtgaaacccntattannaagtacgtggcaatgttcattccaancagatgcagctttcncccccgtctggncncctgtttgcaattgcttcccncatcncagtagggnnaaaattgagtgggagtactgagatntgtgggtttttnccattggacaaagaatgaggttagaagactgcagcttggagtctctctaggttttcaactatttcntcacaatttnaaccacttgacggttgtcccttttaatttatttgaagtgctaatnttttaaataaaggttcatctgtccatgc

SEQ ID NO: 554377 - DNA, 1137 bp, Homo sapiens
ggaacgtgttccctgttcctgctgactgcccggtgccgcaccggacccagtgctggaggcctggccctggtggcacactgggccactgccggtacctgctgtgtgcttggacaactgggtctgttccaatgtcctgcgctgtgctgggctgtgtccctggtgcatggacccaggtccctgagcctgctgcctgcatgttcctgctgctggtgtgctgccctgctggtctgtggctggggcactggtggctgctgtctgggccctgcaggtggggaacgctctgggcagcctggagccactgcgctggatgctgcgctcgcccttcgacctgcaacgtgcctggtcaacctggagcttcaggagttgctgctggactacagcttccagcacctgggtgtctcctcacagggctgtgttgatcatcccatagtttttgacagaagctgtgtgcaacccactgtattcacggcaaatgatgtctgagcttctttttgagtgctacgggattcccaaggttgcctatggaatagacagcctcttcagcttctagcacaataagccaaagaactcgatgtgcagtgggctaatcatttcatctggataccagtgtacgcatgtttacccatcttagaagggagattagatgctaaaaactgaaagcgcatcaatctttggaggaagccaacgcagctggttacctccagggtctcctccagcctgaagtactctgggcacctggaggccattaacctaagcgcatgtagagattctgcttgaaccaagctacatcgataaggatatgtgggaagattccacaatgggggtccagatatacgaggagtatgtccggttggtacccatttcacagcacgagacctgagaagaatctgagccttgatagacaacaaaagggggcggaacaacgagggggagagaagcaaaagccgagaggaagagaaatcatcataaaccttcctcaggagggaaaggagtctgggagacacgagtgggacgaagagcaagcctgcagagtagccaacaagcacgcagcagaggagtgagaagaccaccagcagagtagcaacacgtgtgagaactatggtcgtagtctagtacatccgacacacagagcgaagg

SEQ ID NO: 554378 - DNA, 192 bp, Homo sapiens
ccatgatacgaatgcgagcgcggtgaccgattagccagtactaccaatcaatactcatcattaatgacatcataatggctgatagcaataaaaactgaggaatagccccctttcagcttctgagtcccagaggttaacccaaggcacccctgctgacatccggcctgcttctgctcacatgacgagtacgcg

SEQ ID NO: 554379 - DNA, 1432 bp, Homo sapiens
  misc_feature (438)..(438): n is a, c, g, or t
  misc_feature (624)..(624): n is a, c, g, or t
  misc_feature (882)..(882): n is a, c, g, or t
ctggattggctgagtacgacgctggtcaggccaggagtccatgattctccacaggtcggtgtcagacggacttaccgaggatggcaatgtcgcatggtaccagaggcttcaccaaagacagctctgtgccaattgtctatcaccgtggtagaatactggagataataagtagccagactgactggtgggagaggattgcataggagcagcgtgctttggcctcgccgacatcgctacgcatgagaagtacattcaaacatgcaaacgcgcctcctcgtgaacgccattgacgtcgcacacgaagcatgggcgtgaattctcgagggaaccacacgccatgggggcttgagctaatctggcactcaaaagggatggcgatacgacttcagggaccaatggtggagcagtttaaggcgcgaacgtacccagtacgttgtntctgtctaagggtttccttgcgtgaataagctcaatcgaacactcgcgtactctgttacatacgcttactgggcacgaattttgaactcctctcagctcaggtggttaactcattcactaacgggcatcgcacttgcaagaatggaggccttgcactcggcttgttcaatcagaatgccacacttngtcacatcgagaagggcacactagaaacccatatggtgagatagatcgtgacttcgggcgacagattccgccgtgttcagacacccggagggagatacgatacctttgcgccatgaattggttgtgaggggcaccaagacaaaggtctcaatcaagagagccaccggctgacagagataacattcgagaaggaggttagattgcgcggttgcggccattgacagtcgtgccgacaggaggcgggaaggcatatacccncctagatacggatgtgcataccggaagagaaggcgtgggaggggcacaatgatagacaaaggtccaaggtcggcgaattgggttcgtacacgttggggtctgagaatagttcgaaaggccaaaagggactattgggaggatcccctggcccgcaggtcgcgaagggggcgttccggaataacacgttggcccagatgagctaagaggccaaggggtggcccccggaagggggccttaatacccagacgggtttggggtgcgagccgaggtgcccaaatggcgtggggggtgcctttcggaatccccctgtggcaacggggagaggggcaaggccttcttggggtagccgactaaaggccggtaagggcaaggtagagggtcctaagagagagcgttggtggtcaaggtggggcagaggagcggggagaggccccgtggtggggcgaccaacgtactctctgggatcgcacctcggggggtgaggcccccattttttgttaaccgaattcgttggaagaacgccttaggggggcggacggatcacaagacc

SEQ ID NO: 554380 - DNA, 298 bp, Homo sapiens
tgtttggcttgctcttcgcgctgtggtgtcgggcgtgcgcggggtcctggtgttgcggtgtttggtgcctctgggcccgtggttggtcgcgcgcgaggcgctggtggcgggctccggcgcaccaaccccattgttggcccgggcctccgtcggcccttgctggccccgcggtggccccggccgcacttcctggttgggctctcccgggggctcacggcgtcccgtgtgtcacacctgctcccggctgatcctattgccctttttgcacgttctcgactatcttgcttgatctgggcct

SEQ ID NO: 554381 - DNA, 185 bp, Homo sapiens
taagaggcagtatagctgtttcttgagttgtaaaaggagggcagtatagctgtttcctgattgtaaaacggagggcgagtatagctgtttcctgattgtaaaaggagggcgagtaatagcggttgccttgattgtaaacaggagggcgagttaaagatgttgcctgattgtaaaaggcgggcgag

SEQ ID NO: 554382 - DNA, 113 bp, Homo sapiens
  misc_feature (106)..(106): n is a, c, g, or t
cacttcatcgtggatctgcttgctggcaatggcatacgaatcttccacaaattccctgccctctatcagtggcaaagcattgccccttgtggtagtggattccatnttgggtg

SEQ ID NO: 554383 - DNA, 174 bp, Homo sapiens
ggtcgtcctgttttgtatagttatccagcgcactaattcctatctcccacatacagacccggatgcatataatttcaaactctcggaggctgcctaatgagtaatcctcaatcactacttaaacttggccagttcgctgcccacctggcgcgactttcccagttctgtgaaacc

SEQ ID NO: 554384 - DNA, 114 bp, Homo sapiens
taagaaagcctagggaaactttagtgctaaatacaaaattcacacagagaaaaggcacggactctgggtgagactgggaaggtcctcagaccatatcagcaccatgcggacgag

SEQ ID NO: 554385 - DNA, 197 bp, Homo sapiens
attggactaaatagtgattcgtgataaagtagttatcaacaatttaagacccactattggtcgtaataaagttaggatcttaatcttctttatctaacgtgaacggcgtgtggttcgtcacagtgaggtatttcgcataacatggttgctgtaactgttccaaataaggaatcgactcttggaacaacagtttatct

SEQ ID NO: 554386 - DNA, 188 bp, Homo sapiens
ccatctgtgtatatagcagcaggatagtacagtgcctaacactgcagtcagattcccctcgacaagactggatctgagcaccaccacttacttaaacttatttgtttgcagaaggagtctcatagctgtcacccgaggctgggtgacataagtacctagcaagaggagatgacactacttgactggaa

SEQ ID NO: 554387 - DNA, 256 bp, Homo sapiens
ctagaacagaggaattaggcaggtattcccgatctgccatgtaattccagaaaggacatatacaagaggaagtactcagccgctaaaaccaaggatgaaaagaaaaagaaggagaaggttctcgcaaatgtaacaaaaccagttggtggtgacacgaacggcggtccccgggtggtaaaaatacgcaaaatgcctagctataatcctactgcaagatatgcctcgaacgctgttgtaactggagctgtgtaactgg

SEQ ID NO: 554388 - DNA, 1244 bp, Homo sapiens
tcgcacaggtgtcgatgaaaactacccctaaaagccaaaagtgggaaaggaaacagactcatatcaacatagtcgtcattggacacgtcagattcgggcaagtccaccactactggccatctgatctcatacaatgcggtggcatcgacaaaagaaccattgaaacatttgagaaggcaggctgctgcagcatgggcaacagggctccttcacagtatgcctgggctcttggatcaaactgcaaagctgcagcgtgaacgtggtatcaccattgcatatctccttgtggcaacatttgcagaccagacaagtactactgtgaactatcattgactgccccaggacaaccgagacactttatcaaacaacatgatatacagggaacatctcaaggctgaactggatgctgtcctgaattgttgcatgctggtgattaggtagaattagaagctggtatctccaaagaatgggcagacccgagagcatgcccttctggatttacaaactgggtgtgcaaacaactaaattggtcggtagttaaacaaaaatggattgccacatgaagccaacccgtacagaccagaaagcagaatatgaggacacatcgtcacacgcaagctcagccactctacactccaacgcaaaattggggcatacaaaccccggacaaccagaagcagtaggagcccaaaaccagggtatgaactcggagcacacacatggcatgcgacgcccaaggctgcgcaaacaaatgccatagcggcacacagggaactgacaacggtcaaccccgaaaaggaaatggacaacgccacggggacccacacgcctgacaagacacgaaccatggacaggacccacacgaaaacagcgccacacgaacacgcccatgggcgcacaccccacacgacagacaccacacatggacgcaacaggaccacgaaccgtatgcacccacaaaggaaaacgcagaaccaaaagaaggaaaagaagggacaaaacaaccaaaacacagagacaccacgccgataacaacggagcaacaaccaagaaaacacaaaacaccaaccccgaagacaggacagaacagcgaaaaacccaaacaaacagagcgcacgacaacagacacaagaaccgaagaagacaacacacaaaacgacgcacacaaaaaacaacgtacgaacaacaagaagaacaagcaaacacacaacggccacaaacgctaccaacaaaacacagaagaa

SEQ ID NO: 554389 - DNA, 228 bp, Homo sapiens
  misc_feature (226)..(226): n is a, c, g, or t
cacattgactataacctatcaggaaaacaggtagatcaagctgatcttttacagttttatgggattagaaagaccctgaacaaaaatacttaaatctgtttggatactaggaaaaatgacacaaataaccctgggtccaattcgggttagtagaaggattactttacatacagattttaaagaagttgacatgtattctcaagtggtagagacagcatatcagggnta

SEQ ID NO: 554390 - DNA, 101 bp, Homo sapiens
tcgttttcagtaagtcattttggaaaacggtaattgtcagaaggagtaatcaataagttacaagatcttactgcaagaacggggtgaatggaacaggggaa

SEQ ID NO: 554391 - DNA, 518 bp, Homo sapiens
  misc_feature (13)..(13): n is a, c, g, or t
  misc_feature (109)..(111): n is a, c, g, or t
gaaaaaaaaaagnaaatcggtcgtgggtgccgttgggggccaatattaggggttttcccctgggtgttgttaaaaaaggggggaagggaatttcctggcttgctttttnnnccgggcccccccccctggggccccaaaaaggtaagagaaacccccaaccttttcattttttttaaaaaaaatatggccccccggtttgtggtaaaaagccccttaaataaaaaggggaaaaaccctggggccaagccccccaaattttggggtttggtttcccccggggtcccccgccccaacggggggggttttttttttaaaaaccgggggccccaaaaaaaaaaaaaaggggggcccgattttttttaccttttggcccaaaaaataaggggggttaaggggagggccccgggccaaattgggaaaaaacccggcctttccctttgggggggttttctttttaggttggaacccggcccaaaaaaaatttttttgggggccaaaaaaaaagggccggcctttga

SEQ ID NO: 554392 - DNA, 711 bp, Homo sapiens
aaccaacacactaaccatataccaagtgatggcgcgatgtagcacgagaaagcacataccaaggccaccacacaccacctgtcctaaaaaaggccttcgatatgggataatcctagtttattacctctagaagtttttttcttcgcaggatttttctgagccttttaccactccagccgtagcccctatcccccaactaggagggacactggcacccacaaggaggacatcatgctccgctaaatccctctagaagtcccactacctagagtactagtccgtgattactcgcatcaggagtatcaatcacctgagtctcaccatgagctcgtaatagaaaacagaccgaaaaccaaagtaattcatagcacgtgcttagtgtactaagttttacttgggctctcgtagtattacccttccgtacaagtcctcagagttacttctgagtctcctcttcaccattttccgacggcatctacggctcaacagtcttaagtaggccacaggcttccagctggacttcacgtcatgattggctcaactttcctcgactatctgcgttcattccgccaactaatattgcactttagatccaaacatcacttcggcttcgaacccgccgcctgatgactggcatttcgtgagatagtggtctcgactcatttctgtatgtctccatctatcgatgagggtctttagaagaactaaaga

SEQ ID NO: 554393 - DNA, 1268 bp, Homo sapiens
atgcttcgcggtccgctggacgtccagtctttggctctttctcctagctgctagtctcccgggtgcgcgcctgagccccgtggcagcctccaggccgtgaggagaggaaccggaacgatgccggagctcggcctgtggcctaggccagggctatccaagcgcctagtcacggagtcatgctcagaggcgagcgaggatgcccgtctaccaaggtcgggccacgtggcacagcgtctatcagccatgccgagagactgtggccctgacgtacgtgatgacgacggactgacggagtgctcagccacgggtgccccttgaggcctaggtcagccagttccgtcctgattggtgccaggcggcataccatgagaccctccatgaccaccgctggctacttgcacagcatctcacaaagaccatgcatgcccatagcaaggcgcgacttagcacagaaatctgccaatcacaccatgtcaagcagcggctttcaggaacgattggcgacctctgaaactgagtcgtcgcgcctgccagatgggcccagggccagttcacggatccaccccaggctgcgctacctcacaggaaccatgacgtacgcggagcctaccctccacggaacggaaacggaccgccccacgcgccaagcaaaaaaacgcggaccccccttggcatccatggactccgcaacccgcaacgtgcgactgcggctcacaggcccaccaacgcaggcaaaggaaaagccaacccgcatggcgacgagagcaaaggccactgggtgcgcaggaaaacaccctggtgaataccgggagaaccacgggcctacgcatccgagacacgaaccaaggggctccagcgacaagcaaacacatcggcccccaggatacccacgcaaaaccaacaacccccacaacaatgcggcaaccccggcaccaaagggagcccagcctaggacacacaaaacccacaaacacggcgaggaaacccccacgacaatgtgcctggccggccaccaaaccccggacgacatacttaccaccgacacccgcggacaacaacgatgacccccaacggggatgctttgaaaaactctagcagagccacacctaccaaacgcccggcccccaacgaggggccacaaggggcacagtgttcccagcggagcaataaaacagaacccaaccacccacgcggacaacagaccaaacagcgcacatccaatgacacgacacacacatccgcacgacaagacaaacaaacgaacggcg

SEQ ID NO: 554394 - DNA, 1736 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacggtggctcacacctgtattcccagctactcaggaggccagggtgggaggatcacttgaactcccgtcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgttttttta

SEQ ID NO: 554395 - DNA, 168 bp, Homo sapiens
tgagagctgattcatgaaattcctgctgtgactcagagtgcaaaagaaaacaaggccctctgataacagaatcctccatttatagactaccatgtatcaaaaacctagcttcacagctcttcaaacctcattaccatacagcctgagccctcatggtaagttcgtcag

SEQ ID NO: 554396 - DNA, 1951 bp, Homo sapiens
  misc_feature (1349)..(1349): n is a, c, g, or t
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttcttaanttgcttgaaaaccctgcgttgtgccgcgttaaatgaatatttgtcaattaaagattttctggctgggcacggtggctcacacctgtattcccagctactcaggaggccagggtgggaggatcacttgaactcccgtcagcctcccaagtagctgggattataggcgcccaccaccatgcctggctaattttttatttttagtagagatggggtttcaccgtgttggccaggctggtctcgaactcctgacctcgtgatctacccacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgtttttttaaaaaaaaataagaatagattagaaaaaaaaacggcggcagcagcgtattccattaggtagggttagtttaggctgacactgcgttcgtttagcacgtcgta

SEQ ID NO: 554397 - DNA, 266 bp, Homo sapiens
gtcagtgcaccggctcacatgcctgctgggtcccaacccccagcacagacgtggtcacagccggcgatgatagctactgtttctcagccaggcacggtggctcatgcctgttatcctaacactttgggaggccaaggtgggtcgatcatgaggtcaggagttcgagaccagcctgacccacatggagaaaccctgtctctactaaaaatacaaaattagccgggcgtggtggcgcatgcctgtaatcccagctactcaggagcggg

SEQ ID NO: 554398 - DNA, 1394 bp, Homo sapiens
ccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagcatcccgccgctgttgtccgctggggattttgtggttctggggtcctgacctctttcacttgctgatctgtgggcgctcccacccgtgtgccagcgtgacggctcggggtgtccgctcccctctgggtcgaggccacagctgagtcacgttgctgctcgggctgctccctcggggggcccttgtccctcaacctgctctggtgccccactctcagcaccacagaatgatccgggttcaggttgcgttttccctgccaccaccctgcaatcagccacttctttaaggagctccagggctgcagccacgttagagggccccttggggggcagggccagctctacggttacatgcctgaaacagtcagaagggttggccaaatctcactaaatgcaaatttgaaacaaatttgcctcttctctggatccattaggaaatgtgtgtgtgggctccgcagctgagggggccctcttgagtgtgacgagtcctgtggtgggaggacaggacggcactggtcagtgatgccgtgtgaggctgggccctggtctctgcccgtctgtcacctgggcctgtcaccagggctggggctgctgggagcaccatggtcaagagcagcagctcccagaaag

SEQ ID NO: 554399 - DNA, 407 bp, Homo sapiens
  misc_feature (81)..(81): n is a, c, g, or t
  misc_feature (155)..(155): n is a, c, g, or t
  misc_feature (160)..(160): n is a, c, g, or t
gataatatacaagttgctgttgtgaagcatgcctgcaaataaatgtgcaaagtataccgtatcattttccatataaataancctatttttcctttggggtagataccccaatgatgagatttcctgaatcaaatgatagttctggcccaggcgtnggtcncacgcctgtaatccccaacactttgggaggtagaggcgggcaggtcatgaggtcagaagtttgagaccagcctgagcgatatggtgaaaccccgtctctactgaaaatacaaaagttagccaggcgtggtggcacttgcctgcagccccagctcctcaggaggctgacacagaagaattgcttggacctgggagtcagtggttgcagtgagctgagatcgtaccactgcactccagcctggacaact

SEQ ID NO: 554400 - DNA, 398 bp, Homo sapiens
  misc_feature (32)..(32): n is a, c, g, or t
  misc_feature (329)..(329): n is a, c, g, or t
cagtccagatccggggtcaagtaataggtatntattaatcgataatcagttaaaacaaggctggggccacgcagctcggggtgaggatttggcttggaactcttaggaaaatactagttctggtaaattcatggggtggttttcaaaacatgcaataaagcacttttcctttattttctctgaaagaggagcagcgattccagggtaaggctattccaaacagatgtggaagagcaagcacctttaggcgggcggtacatcaggcaccttggccaggtcggcttatgtctaaggctaagaatgaaactctggccagctctgggtacggntactcaccagcacccagccagttacttcaggcttttcggggccacccaggaggtgggccgggggtaccg

SEQ ID NO: 554401 - DNA, 344 bp, Homo sapiens
  misc_feature (315)..(315): n is a, c, g, or t
gagaacaacctgaaaacgctcaccaggtggagtcaccacttgcattcagctgtttcagaaacattgttgaccacctcctcaatgtgaagatcaggaagatgaaagcctttatgatgatctacttccacttaataaatgtacttatccatgtgcctgcaatatattagttgatcagtaaatgttcgcagtaaatcaaggaggaatgcaaaggcccaaagcaacaaaaaaatgaatggcacgctatctggagggtacaaggaagatttcagccaaaagcataaccctgccccaaatatcaccacgtctagacttccnccattaaagatttaattattcacattaaa

SEQ ID NO: 554402 - DNA, 342 bp, Homo sapiens
gataccctttctctgatcgctcaacagagcgaggctccatctcaaaaaaaaaaaaatgtaatgaaaggaaattttcccctttacttttggggcccgtggggaaaagaaagaaaatttgctctgttgttctgcccctaaaatttattttcgtgtttttgtgggaccagacaaaggtgaaattgaagcattggattcctgtaagtaagaagttttgggatacttaagtagcctgccctgcatccaaaaaatttagattctaaattttctgggtccgtttttctgcctgaggaatactgctgggccaaggggctcctaaaggcgatagattgggtggcttctttg

SEQ ID NO: 554403 - DNA, 1082 bp, Homo sapiens
  misc_feature (252)..(252): n is a, c, g, or t
  misc_feature (261)..(261): n is a, c, g, or t
ggttctggttctggttgtcgtcggtttgttcgccccgtcccgcttcgtctctcctctcttggttgcgtggtccttccatcctggcttttgtttaggtatgctctgttgttctgttacgttgtattgggtatggtgtaggctccggatctctctccgttccgctgacttcggctagtcggatggcttcgattgttttgtcgctcgcacttcggtctagcttcgatagtcgcatgcatcgctccgcgcgtcggnggggagggntgtattaataaaagtaaagagacacgacaggagcttctgtctccttttttatgtgtggtgacccgccctctctcgctggttttctcctcgcgtggaagacacgccctcatcccacacgcctggtttgtgtgacccccccccctctagtagaagaagacccacccgcggggccgcctgatttcccgagcctctctcgcgggagattttttttaccctcttcgcgtgcccccccgcggggagcgcggatgtatacaccatgtcgtattatcacacgcagcaggaacacacagcttgtattgagacacgatcttatagggcccctctatttagaggtggacacacactattatagagagacacaacatatgtgtgttacaacacaaataagagacagcgagcgctcgggtgtgatccgcgctctccgcgggaatattctccccgcggatagacgcgggtggtggagagggcccgccgagatgtaccaccccgtcggagagatataaccaggccgcccatagacttgtggaggagtaagatcccacagggttccctgtgcgcccctgctggggaaaatagtagaaggagctcagaaatccctacaaggggcgccaccaccacaggaggaagaaaagaaaaagaaagaaccacagatccggggtaaaacacgcggggatggccaggaccaaacaccgcggcctttgttgcaacagtggggcccccctttgcacaaaaaaagagggcccccaacccaattttaagattttttgtgataatttgtgggtttttttaaaaaaaaacccccttggtgtttcggctcccca

SEQ ID NO: 554404 - DNA, 189 bp, Homo sapiens
cacactgtacacttccactgaacagtgcatccacactgctgaaggtagcagcatgccacacctcaactcctggtgaaagaagcactccattaacaaatatacttgtcgagcaccacgctgattggccacattctgaggctagcaccctttcaacaactcctgttgacaccagcagacctgtcaccacta

SEQ ID NO: 554405 - DNA, 168 bp, Homo sapiens
agtgatctaccgatgcttatgctactccacaaacaggggccagaagataaggtacagattttataggggagaaaactaagtttcagacatattgcgtcaggtactggaaacgacgatccatgtgttactatgaggagggaactatgcctatcctcccctcttacacac

SEQ ID NO: 554406 - DNA, 280 bp, Homo sapiens
cattctttggtcaggaaataaatacaacatatctcattcaagaaatctctggaaagacttgtagcacacatagtttcccatccgtactcagcctctctgccccgatccccgtcttttctactcaaggccaggaaggcctccaaggtgatgggcggcaggtaacgagtcattgcctctcacgccacctggaaggctggactacttcctcctcccaactgcggggtcccagaaatcctcgggtcccagtggctgacttacaatattcaattcactctgacca

SEQ ID NO: 554407 - DNA, 1337 bp, Homo sapiens
tttgtcctcctcgctggctggcgcatagttagtgtgcggcgtccgcagcacgcacgcctgttgttgctctccctccctgcggtgggcaccgctcgtttgtggccccccgcgctgtgctagtgttgtctccgcgcccacccgtcgctcagtttgttgggtgttatctcccccacgggcgctcggtgggataattcgcgcacccatttggtgatcggtgtgttttgttctgctcgccgacatatagaaccgcccgtttgtggatcacactagtgggtgcttgtttctctgcgctcatttgtagttctcatttgggccgttcccttaggggtgtttttccttgggtgggccgcccggccaggagtattttgaccgcgtagggttatgtgccccgttttgcgctccccggtcctattatttttctccgcctccgcggctccccaattattgccgttcgccttttttcccccccccccgggcggttcacacaggtaattttatgccgttgacttctgcccacccgcttctcctcgggtgagcgcacatatttgggaaatggagtctcgccgtccgcggtggctcttggagcccccttagggaattccatccgtgtccttgttgccacccgctaaggtgggccccggacctgcgccccttgtgatttcggcgccaactgcggatccccttaggaccattccggttgcgtaacccggacccccgtatctcacctgttgtaggcttcccaattgccccacttatggtcgcccatccaattaggaacttgttatattcgccccttcatataagaggctttccattccactcgatattcccctctaatctcccagagcttaccacacctttagaccccaactcttacccccccaaatcgccattttccactcatccataattccatccggcggtaaatactaacatttctttccccagccaacacactcttttcccggccttatacccggaatatgcccccgacagttacatccggacttacccccgatgccataccacccaccatggaaccatcctatccatctgtaggcgtccattccatttcttcttcaccacgccacgtaatatatgtaataaattttccatgatttgagaagccttctcgcttcttcgaaagcgaaaagtctctaatagtagaagaacccctcccattaacctggagtgactatatggatgcccccccaccctacccaccaccattctgaagaaccccgtataccattaaatttagcacccaaaaaggaaggaatcgaacccccccaagactggtttcacaacccaccccctggcctccctgactttttcca

SEQ ID NO: 554408 - DNA, 252 bp, Homo sapiens
ctggctcatctcgccaaatactggggggtctcttcagcctctgtctccttgactgcccatgtgctccctttgctcccctgacgccttctagatgggccgcctggtggtggacttgtcctgtgggatggagaccctccatacatggtgttcaaatggtcctgtggtattcctggatcttcaggacatctgactaccctcaggtttcccaggctttttggtggggaggcatcagatccctggccaaacatgcta

SEQ ID NO: 554409 - DNA, 336 bp, Homo sapiens
gcgttgctgctctgctctcgggagatgctgcgctgtagtccctcgtaaagttgctgctggcttgtgccgtttggccgcctgccccctgggtcgtattctctggagtgcgatctgtctctcttgccggtcttagccatggccgtggtattgaagagatcctgagtgacctccccctgcgggccaaccctggacttcccccagagctcatctgggtggcaggtgctggccacgtggagtctgccctccacgtgccgtgggtgaagcttcacctggcgcagggaaggccatcagacttccagctcgtcacccatgtcctcaaccccttaacccgagcgc

SEQ ID NO: 554410 - DNA, 162 bp, Homo sapiens
ccggaccagtgtgctatagctggctctctcttataggtgagaggtagtatttgattttctgtttaaaagttaattcacttagcacagggcctccaactatgtccacgctgctgcaaaatttcattctttatatggctgtgtagtattctacggtgtatatgt

SEQ ID NO: 554411 - DNA, 1333 bp, Homo sapiens
gctttttcttgttgtttttgtgtttgcttgttcagtgttctttttgttgtttttttctctttttattcgttcttttgtttttgtttttcttttttctttgtcttcacttattgctactttctgttgttttgatctgtggttgattcttttgtgatttctttttctgcgattactctttgtttctcctattctgttttttcgttttccttttttgatgtgttgctttgctttttagtttgtgttcctatgtggtgttttttgtttgtgtgactgtgtttttgtttgttgttggtgtgttgttttgtgttgtgttttgtttagttgttggttgtgttgttgtgtgttgttgttgtgtttatttttgttgtgttgttgttgtgtgtggtgagtgtgtctgtttgttgttgttttttgtgtgttgtgtatgtctcccccgccgcagggggtggggggggggaggggtttttaatataattattattgccccgaagggctctctcgttttttatattttgtgcacaccccgctctcatcgaagttctcgccccctgtagagagaccccgctcccttttctcgcaccgcccttggttttttgcacccctctctcccagctattgagaaggcgcaccccccggggagcccggagtccccacgcgctctcaccgagacctctctttacgctctctaagggccccgccgggggcacccgcggatattacacccacatattgcccacacccccacgagagatcactcacgcgtctatattgcacccccatttttagcgccctctcatatttttatggtggccacacacatctatatagggacacccacagtgtttggtgcacccacaaatatacaccacgggcgtgtgagtgtaccccgcgtgccccgcgagatatctcccccgcgcgagtatatctctgtctcgagcaccccacacgcgcgtctccgcagtataagagatctcccaccccctttctcacataagcgtcgtcacagagatcccgcgccgcctgggcccgctctaaatttgaggcccaccgctgtggctgcgagtggtgcgcctctcacgcgagatatgtcttctttgccacgcgctggtgtccctctgtggggaggagcccccttccctctcccccgccacggctgtgctgccctctgcaccacactgagagcacttctcacgagctgtgccaagccacatcgtagtcactccacgacccgtgtaattccccgggcttggttaaagtgctgtgtgagtaaacttgtttggagtgaggagacttaaactttaaaccccttaccataaacttggggaactaccca

SEQ ID NO: 554412 - DNA, 884 bp, Homo sapiens
gctcgtgcctccgtaacccccgcctagccgggccatggctggaacgcggagggggcgggcggtggtccctggaggcgcccgggggcggcagcggcagcggggatccggggtcgcccagtcccctcagcagcctggccgccgcagcagcagcagcagcagccgcgcagcagccgacgccccccaatgtctggcccaggccacctcgtcgtcctccgtccacctctggctgtgcgggctgcctcctcctcgtcctcgtctacctccacctccatggccgtgtgcgggtggcctcggtgctcctgatgcctcccggtgcgcctggtggccagtgccgcacccccgccccggtgcagatgaacctgtactgccacctgggaggtggaccggagctcgtccagttgcgtgcctagtgctattcagcttgatcctgaaagaaactcgtcatgctaaaagaaatggacacaagatcttaactcagtggtcatcgctgtgaagctgccagggttcaaaaagaattcttcgcgtccaacgagatcgtccttccagctagtggactggtggacacagagctccaattaacctttctcccttcagtaccctcatttccttaacgcgagatgccaacgaggctgagatcattgctgaccaaggagaaacacgttacgaagaatcgggaccatcttgggtataagaccttgcgccgtgggactcatcaacattggcagaggtgatgcgagatctaatgagcgattgtgatggctaaaagaacggaggatgtctgggctgggataataagatatactgtacaacaaacatgacgagaaggacaacagaaagagcggcgaaagaaacaggcatgcagccgtcgcaaggggagaaaaagg

SEQ ID NO: 554413 - DNA, 829 bp, Homo sapiens
  misc_feature (233)..(233): n is a, c, g, or t
  misc_feature (245)..(245): n is a, c, g, or t
  misc_feature (249)..(249): n is a, c, g, or t
  misc_feature (312)..(312): n is a, c, g, or t
  misc_feature (315)..(315): n is a, c, g, or t
  misc_feature (318)..(319): n is a, c, g, or t
  misc_feature (323)..(323): n is a, c, g, or t
  misc_feature (335)..(335): n is a, c, g, or t
  misc_feature (341)..(341): n is a, c, g, or t
  misc_feature (401)..(401): n is a, c, g, or t
  misc_feature (409)..(409): n is a, c, g, or t
  misc_feature (417)..(417): n is a, c, g, or t
  misc_feature (419)..(419): n is a, c, g, or t
  misc_feature (433)..(433): n is a, c, g, or t
  misc_feature (436)..(437): n is a, c, g, or t
  misc_feature (440)..(440): n is a, c, g, or t
  misc_feature (454)..(454): n is a, c, g, or t
  misc_feature (489)..(490): n is a, c, g, or t
  misc_feature (498)..(498): n is a, c, g, or t
  misc_feature (503)..(503): n is a, c, g, or t
  misc_feature (506)..(506): n is a, c, g, or t
  misc_feature (600)..(600): n is a, c, g, or t
ggaggctcaatgcgtatcttcgatagtgaagaaatactggcaggttataaaagggaacggattgaccccactccctattactggtatacggatcagagaaaatacggtacatgtccccattggaggatatggcttgggctggaacgattcttaacgtggattctgaataggtatcacatccgagacgtgtgcttataccctcgattgtccagcgttgcacgccataaccattntctccagaagcntggnggaagattatgaaaggaacaggctctttacaaaagaaaacaaaaagccagaatcttccttctntangtnncatnggggtttctctntctgtntatctttctactaccataaaaactatctcagatcacctgaacatcaagtgatataaggtngtcatctnaagaaacnantatccattttttcnttnngtncgggaaacaaagtncggggaaaatacctggcatgaaactgtagttaggnnatacattncagcnatnttactcacttatccaagtattcattggacttcacgttatatgtatgtagtcattcacgaattttagattatcggtgtaagataactccagaaanttatctttacctgatcgcttttctacgctgtcccctcgaatttccttggaatctattcattatcggcatcaactgccgttcacaaacaaaaatcatcggagggaaggaccttggccacaatccgtataaacttctggctcatcttacgaacccgtataattcagccgacaccctaggaatccctgattagcttttggatcaggcgtaatcttctaactcgcttagtgca

SEQ ID NO: 554414 - DNA, 341 bp, Homo sapiens
ccgcgggcatctcttatgttgtgtggtcctaaatataagccctacctccacccaaataagtacttctagtgtccttgggactagcctcatctacccccagttaccctataacaaatcctgctgtacaataaaggataaggtgctcatatagagcacacacctagaaactagacacatattgctcctatactaataacctctagcttagagtagtcctttccctatccgctatattatattagatatgtcctaggtattgatacatgtttactaaattaagatacctaaactccaatgaaggctatgcttgtcctagaacgggaggatcctctagcagtcga

SEQ ID NO: 554415 - DNA, 330 bp, Homo sapiens
gctcgtaccgttggtttgaccgtggtctttgccaccagaaggagttgggcctgtttgccattagcagctgtctgaggaggccactgtgtaccacatatgcggctcctgaggtctgaggtggaaggtccctactgcatcaccaccccgcggggcatagaaggagcccagagaaggaggggcgttccacctcgtggaacgccaggaatcaggaagaccagtgtccctgtttacgatggagctgtgcctgtggaggctgttgtgaggcagtagcctcatctgcggaggctgccgtgacgtatggtatgggcctcaataggccattgtcagtca

SEQ ID NO: 554416 - DNA, 322 bp, Homo sapiens
  misc_feature (35)..(35): n is a, c, g, or t
ccgcctcgaccacccactctcagtcagtgcctggntagggtttctcacctcctcacccagatatgtgtgtcagttccctggctcctttggcaggattgctcctggatagctcctggctagactcttacctccttaccagtctcagggaatgggccaaaacaggacagagagagagaccagatttaaatggatcacttgctgacagtgactcatagctactgtaagtgacggtctgttcaagggaatccctgtctctctttgtctgtctgtctgtctgtctgtctgtctgtctgtctgtctgtctgtctgtctgcgtcgacgc

SEQ ID NO: 554417 - DNA, 348 bp, Homo sapiens
tccctggtaggaagaaagaggttgcgctgagcacggatcactccagtctactcaagcctgggaaaggaggcgagactccgttccaaaacaataaatgaacgataaaaatagataaatataatttcgggggaaaaggttaccagttttctttaatgtggaactttcaaagcttttcacattacaattcattttgaatgtttatggggggggtaatactgataatatccaactgataattaccagtaaatctttagaaaacctattttgacaacacaggttggacaattctgtaatgagataatttttaaaatacgatcctataagacaaatgtatacttttaaaatact

SEQ ID NO: 554418 - DNA, 389 bp, Homo sapiens
ctgctgcaaatgtcaatattttggatgttgcatagatactatttgccccagttatattcaacttttgtactgcctgtattgtggactggctggctctgttataactctgtccaaaaagtgtatggaatataacttgtaaagcttcccacaattgacaatttatatgcatgtgtttaaaccaaataccagaatagctttaacaatagagctagcataatagtatttattaaagaatcacatctgtaaccctgagaattacttaaggatgctagtagagtaaaatagtatattgcaaattatatcattgctgctagatatattagaataattttcagatgtcatcttgaaacagaaatatgtatttcaagcactcacgcaaaggtgaataa

SEQ ID NO: 554419 - DNA, 237 bp, Homo sapiens
tgcatgatagtacgcacggctgggcgcgggcgacccgtatcagtgcgcaggatcgcttggacgggcgtcgcgctgggtctgatcgtggccgccgtcgtcgtcgggccggtcgtgctgctgcgccacgagatcacgggtgtctacagcaacgacccagcggtgcgtgccctggccgcttcgctcctgctgtgggcggccctgtggcagttcttcgacgcgacgcaggtctgcgccatc

SEQ ID NO: 554420 - DNA, 966 bp, Homo sapiens
gggaggagaactaggctaggtacgaggcctggtttgaattcggccgaggcaccaatggtggatgacgccggtgcagcctgggggtgccgggggcctggtggccttggattgggaaccgcggtggcttcgcggaggttcggcagtggcatccggggccggggtcgcggcgtggacggggccggggccgaggccgcggagctcgccggaggcaaggccgaggataagtgagtggatgcccgtcaccaagtatgggccgcttgtggtcaatgacatgaagatcaagtccctggaggagatctatctcttctccctgtccattaaggagatcagagatcattgatttcttcctggggggctctctcaaggatgaggtttttgaagattattgccaagttgcagaaagcatgaccctgtgcctgggtcagcgcaaccagtgttcaagtgcaattttgttggctatctgggggactacaactgtgccacgtctggtctgggtgttaagtgctccaaggagtgtggcacctgccatccgttgggggcatcatcctgggcaagctctccatccgtcccccgtgcgccaggaggctaccttgggggtgaacacagatctgtggagcccacacttggtccttttcatggttgacaagggccgctgcgggtcttgttgcttggtacggcctcattcccttgaccccagcggggcactggcatcgtcttcggacctgagttgcctaaggaaggcttgtcacataatggtggggagtcggttgaattggtgaacttcagtcccggggggtgtctggccacccttggcaatttcccatggccacgttgtgttctatctaaacctagtttcttgtacgcgactttgaggggatgtgttcacagtcctacggggccaggcccctgtaccccagatcgtgtggtcgccgtggtacctgttttcacaacgttcggtgtctacac

SEQ ID NO: 554421 - DNA, 743 bp, Homo sapiens
agggcataaatgagaaaagtgcacatgtagtcatgagcaagtattaaagtgtctccccaaaatactagcaaatagtgagctaataaatggaggtggagaaaaataaaaggcaagggacaatataagatcaaagacagcttctgtttcttggcagcatttggtgcccccactctggcaggttttctacagatgctctgatcaggaaccagctggccccagggctggctctcagtctctcctggcagtccccacgccccaagcaagatcattaaatcatcctttgttaagggacgatgggaggagcctaatctgacgaaaaacgaaaacgtacaggaagaacagggttacacctgccagtgataaacaggaacgactgtggcaactaaacaaaacacaacaaacaacaaaaccaaaaaaaaactttggggggcggcctgggccacgggaaaaaggttttcaaagacccatcccgtgtggggggcgggggggccccaagagggtaacggtaaacctggggcacaaaacgcgtggccaaagagagaactcgcgggccatgaacaagggtggggggggtttcctccaccaaaaaaaaaaaaccgccgcgggggggcaacccggggggggttttgggacacacaatcccaaaagaggggagtccgggggggcacaaacggggctgtcaccaacagcagggggcccaaggagaagtcagaaaaaaatacgagcgccggcgggggaggggc

SEQ ID NO: 554422 - DNA, 220 bp, Homo sapiens
ccgacgatgtaagcaatttttgattaaaaattttttatttaaaaagtcaaagcttggctgggcaaggtggctcatgcctgtaatcccagcactttgggaggccgaggcaggtggatcacttgaggtcaggagttcaagactagcctggtaaacatggtgaaactccacctctactaaaaaatacaaaaaattagccgggtatggatcctcggcgtgtgca

SEQ ID NO: 554423 - DNA, 450 bp, Homo sapiens
tctacaaggttgttactagtgtccaaagagctgtcctctttggactaacagttaaatttacaaggggatctagagggtactgtgggcaatttaaagttgaactaagatctatcttggacaccagctatcaccaggctcggtaggtatgtcgcctctacctataaaatcttcccactattttgctacatagacgggtgtgctcttttagctgttcttaggtatctcgtctggtttagggggtcttagctttggctctccttgcaaagttatttctagttaattcattatgcagaaggtataggggttagtccttgctatattatgcttggctataatttttcatctttcccttgcggtactataatctatttgcgccaggtttcaatttctatcgcctatactttatttggggtacatggtttggctaagggttgtctggtaagtaaggtg

SEQ ID NO: 554424 - DNA, 619 bp, Homo sapiens
tttggaagaagtcaaagtaagcagagagatggacacggaaacactctatagatgtggccagacagcatctcttcgtactaaagttcatgctgaacttgcagatgtcttaacagaggctgtagtggactccattttggccagttaaaaagcacagatgaacctattgactctcttcactgacttgagcatcatggagatgaaacataaatctgagaactgatacaagcttaatcagagggcttgttttggaccacggagcacggcatcctgactatgaagaaaagggtggaggatgcatacatcctcacttgtaacgtggtcattagagtagtgagaaaacagacagctgaagttctggctttcttgttacaagagctgcacgaagagagagcaaaaactcgtgaaagctgaaagaacattcattgaagatagggttaaaaaaataatagaactgatacacacggaaagctctgtggcgacttcagcataaacggattcgtcgcttattaactcaacaacgggaattgaccccttttccttagcatgctctttcaaacagaaggcatagtcgctctgcgcagagctcaaaggacaaactatggagaggctgactctgctg

SEQ ID NO: 554425 - DNA, 242 bp, Homo sapiens
gtctactccaggcgtgccctacggtctcgctgcacttcatccacaacctagcgaagactggctggcccgggcaccctcctgtgcttcgcccagagcatcagcttctccggcctgccctctagccgccggacctcaccagcatcaacaggcctgcctgcgccttccctgtcctccagctccttctcgccctccagttccccagcatcacctggggaccttcccactgtcaccctcttgccttc

SEQ ID NO: 554426 - DNA, 372 bp, Homo sapiens
accctgccaactctgacggttctgactggaaaaccccttccggatgaacatatatcagaccaggcgcggtggctcacgcctgtaatcccagcactttgggaggccaaggcgggcagatcacttgaggtcaggagtacaagatcagcctggccaacatggtgaaacctcatctctactaaaaatacaaaaattagctaggcatgttggtgtgtacctgtaatcccagctactagggaggctaagacaggagaatcgcttgaacccggcaggcgaaggttgcagtgagggtcgcctgaggtcagaagttcgagaccagcctggcgaacatggcgaaaccccgtctctactaaaaatacaaaaatagccgggaag

SEQ ID NO: 554427 - DNA, 564 bp, Homo sapiens
tggggccccggtgggccccggtgttgcctttaacccgccttttctgggggaggggtcctcgcgtgctttaccattttgtgcccgggtgagccccatgccaaccaattggtttttgttttcccaaaggggagtggtgttgccctccccctttcccccccctttcatgaggaccaccggagagtccttgtttccaatccaaactgggttataactgggggaggggagaaaaaccgcggtgttttccctttttaaggggggaacccttccaaaaacaagggctgggttgacccggccccctccagggtgccgtggatttttgtcccctgtttccgggccatcctcggggttaaaaaacccatttaatcccccaactgggggtttttgggggccttggccccccccggggtttttataccccgatattattttgaaggggggggtttaaaaaaaaaaaagaattttaccccttcctggggtaagggtttttttttcctggggggggaaattttttcctttttccatttccccttttttgggttttttctttattaatttttccgggga

SEQ ID NO: 554428 - DNA, 130 bp, Homo sapiens
ctgctgagatccagctcttgttttttcttgcatgagaccggtctgtgtcctcagcatttgctgtgcccaggtctgagtcactggacatgggctcctcgcaatggtctggactcttggagcccatgtcctg

SEQ ID NO: 554429 - DNA, 979 bp, Homo sapiens
  misc_feature (528)..(528): n is a, c, g, or t
  misc_feature (573)..(573): n is a, c, g, or t
ttcatatggagtgcttactctgcattactcgcgtgctcatcgcagatagcgcctgttcactactaactttccaaggaagacacgtgcgccctcacaagtgcgccattccactatatgtgtgacccggtcttgaatgtgatgcgaaactacttgatactaaaaacgtccaatggcttgagaacgacgggacatgaagtgaatcattgtagcgcgtggaacgcccattatgccaaaacgtgactgggaaactacaaggacaccagaccatatggcaaggaacgattacccaggcctacacatgtgaagcatcccggcgcagacgcgtctcccaggatagatattaattcctggttagcgcttggtgccttgagagctaccgatgcactcatctgtgccctgttgtcatgtagcttccgcccagtgaccacaggacaagacgtgactaaggaagatgtcagctggcgcatcgcgaagcgctcacagcgtaccaccttgacaagcggcgagttagtccctagtacctctacnttcatgtgagacgatgtcgtggtggtacactctgcccccccgagncagccgccacacttgttaccgctggcgtagacaagtcgagggagaccatagcgtgcgcgattgcgcctttggcgggagcacttttgccgttgagatcacctaaagaggggaacgggaggccacaagggagctggagcgagcgcagaaagcatcgcaagctttcatagcgcttcggttcgacatacctatcgggagcaggggacgcgtcatcccattcggggtccatgcatatacgcaatgccctcggcttgggcacgattggcttaccccccattggcaatgtcccttggcgcccaggggattttcacctcgattgccgattttcggtgtggggcccggctttgttggcataggttcgaggggggccgatggttcgccccttttcccccggagaaagggcggcctc

SEQ ID NO: 554430 - DNA, 124 bp, Homo sapiens
tgagtcgtccgatagccaaactaaaaaccaaaaacctgtcatatttccccatcacttcctttaatcttagtccttacatgtggtaaaaagagttttaaaaaatattattaagtatgttcccgat

SEQ ID NO: 554431 - DNA, 1213 bp, Homo sapiens
  misc_feature (320)..(320): n is a, c, g, or t
  misc_feature (323)..(323): n is a, c, g, or t
  misc_feature (341)..(341): n is a, c, g, or t
  misc_feature (496)..(496): n is a, c, g, or t
ggctccacgagggttcagcttgtctcttactttgataccagtgaacttgacctgcccgtgaacgagtgcgggcactagacacaggcacagacgagatacgtaccctatggagactcttaatttattaagtgcaatcatgtgaccctagacgaaaccctaccaggtcctaacatcgtatgcgaagacctgtctattgaatatacaattgtcggtgtgggggggcgaaccgtcgggaggctaggaacctccacagccgttcccggaggctagtacgatggctaggagacttgctagccagctcaaatagcgtagacttactnatnactgcaattgtatccaantaaccttgaccaaccgtgatatcaacgttacctcataggtgggataacaggctgccaatccatagttacgtatgcaagtccactattcataccatatagggtgtttaccggagcactcgtagtgtttggtgatctaggagaccatttcctcaganttggttgacatgcccagactaatgtatatagggtgtgcgctcttggttgcacaccgagtctacagacgtaccttagcagatagtactcttagacgtatcaaggacccgagtacgttagatccaaggatcggctttctgattcttatcttcacaagtttccttccctgttcacggaaaagcgaacagaagtatgtaacatgaatggtcctataccttcagctagatagccgtcgcttcccgccggtgaagagttgcatcagttcagtccttcagaacttttaagttgaatttaataacgccaacgatcccattcctcaagaagcaaggggggtttagagacacataattataacaccatgaaaaatacactaggctagaggaattccgctcgagggtggcgcatacctaaatcgcgaacggagtgcgagcgcgcgaacaaattcacgtgccgagtcaccatggacaaagttgtgacgacgaaaagtggtgcctgtacaatgaggggtgagggatcttgtcaatgaagacgattcccaccgaagagtctttgtttcctttgatgttttccccaaaaacgggcgggcggtcagggagaaacgtggtcccccggggggttcgtcccccccgaattgattattgcgagggtgtatgccccaagataataaatttctttacccacgtaataacaccgcggtagataacagcgggcgtcaataa

SEQ ID NO: 554432 - DNA, 380 bp, Homo sapiens
  misc_feature (276)..(276): n is a, c, g, or t
  misc_feature (317)..(317): n is a, c, g, or t
  misc_feature (320)..(320): n is a, c, g, or t
tcttcgctctagtccaaaactcacggcaccgcggctctgctcccaggcaggccgtccctcggcgtcggttgaggtatgtcgtgtagtctctccgcccgccggcgttacgcagtctctgtccgcggcgcagaaggcgggctggcactgcttaagactccggagccggcaggtccgcgtactgctccacgcgctggtcacttctgttctcaccgcagtccaccaacttctgctgcatctcctggtgcccgcttggccttgtccggctcttgcgcacgnagatgttgttgcgctcgcgccgctgccggtactcggggctnccncggtacgggcccctcttgccggcgctcttctcccgggcggggccgggcgcgggggtctgc

SEQ ID NO: 554433 - DNA, 94 bp, Homo sapiens
acctgacctgaattgcgaccccaacctgaactgctcccctgaccgcaacccctacccccgcccaccagcatggcccggcacgtgttcctaacgg

SEQ ID NO: 554434 - DNA, 753 bp, Homo sapiens
  misc_feature (731)..(731): n is a, c, g, or t
ttatggacgcaggctccgtttacagctcgatattgcataagagccgctatgagtaacattaaagggtgctacggggtatccgcgtagccctcaaacagataaccgcgtacacgtactgcacgcctatgagacgccaaacaagactcgccagatgcactaccagaactgaataatcgcacgacaagaggcatattgcgtatctgtcgccaccgtgagtagcatctcaacaccagtgttacattctaacagctttctgtcctgcaccagacagtccctgagagagttgcatcacgcggtacacgcttgatcgccccaacaaatcacaatcatgattacagttacttacagcggtatataacaagacctactattctgcatagtattatcccaactactgagattattctcaccatctgcttcgtccctgactgtcttaattggatcttattgagcctatatgcaaactcgatcttcggcttattacgccgtaccagcggctaccgacgtctatccactccactactcagatctctattgctcgacactcgcactatcggacttcaacctatactacccgataccgctcacggtcttcacttcatctgcgctcgtaacattccatgcctcgctcattcttcatgctcagcccgtagctgcaactatacggtcctctacatacagcctcacttggacgttctatactgcatacttatcacgtttatctcatcgtncggtacactgatcttttggccg

SEQ ID NO: 554435 - DNA, 353 bp, Homo sapiens
ccatcccaacactagctgcacgtaataccctgccagattagctgtgccacacagctaccagggaagcttgtttcacaagccgtcttaccttagcacgaaggccaagcaacgtactaaaggtgactaaagatatgtacaggataaacaaaccaagggaacagtacttcaatacaaggcaaaacagcacagtctacaatcaggctgaatagatacaagcttaaggacaattctttcgaagctatccagttcggagctagcatgaggggcgcattccaggcaaatttctattctaataccatgcagaaatgctcgcattgtgagccgttagaacattgcggggcgatgagggcccg

SEQ ID NO: 554436 - DNA, 1274 bp, Homo sapiens
agcggccccgaccctggcccccagatgcccacccggatcggcccggacacagcccatgatctaaggtcgtatccttaatcttcgagacgaaccacggcgaagcctccgcgcatctccaacgcttctaccattccctacagctgacagattacaacgaatagacaaactcagtacagggtagtgaacgtgtgtccacctttggatactctaccgagtagactgaaccattgctttgtaccattgttccgtatgaacgcgatggacttacttcaaagttgtgcatggactctgaccagacaaaaagcttgagtgtgtactaaggaccatattaattgcgaacagtttaatattgtgttgtctatgcatgtgtaggatttcgttcaagaaaggtcgaaacgttaggcaattcttgaggatcctaattcagaagtaatttgtcgtggaaaagcgtttatggaccacaatctgtttgtatggatacaagttgtccttgttgacaggcttggtagttagtgaagtcttttcccaattggcttagacaaaatgggattctaaccataattaatttcgttggggcacacgtataacactcggttgcatgcgcgcggcagcaaatcggctactttcgcgcaagaccacaccattatgatggcacctttgactgcagttcgctttcacacaatcccataccatatgtggcattcgccttaatccacatattattcacaagcccttcggcgtataaaacaccactacttttgtatgaaaactccttttttgaatttccttttttcaagctttcttacctcgccaagagtaaccgaagcgggagccagggggtttaaggaaaaccaaaaaggggctctggcgcccgttaaaaagtcccagcagggaaagggcccttcccccaagtccctccccgattggtccttaggttaactttcaagcccgtgggttcataacaccggaacacctccattgtgaccaatttctttctcacccatgagggaacgaacaattcctccccaaagaattgcaaaacacaacttaaattttttacacaccaattgttgggggtcttccaaaccgccactttccaacgggtcggcatttcactcacacacatggcttggggcgtcccaaccaagacaccgtgggtatcccccttcccttttctttaaaaaccttaacaacccacacttggcttttcaacttacaacagcgggtccccacccgtccccccccaagtggcttacacaccccatttcccccag

SEQ ID NO: 554437 - DNA, 156 bp, Homo sapiens
  misc_feature (156)..(156): n is a, c, g, or t
gttataggtaagaatctgtgtgagggtgagactgtctactgagtaggctcctcagattcattgaactaggtctgtcccaatgtatgggatggctggatagtaagtttgtaattactgtgtggccctcagaactgagtatttggggcttatcgaggn

SEQ ID NO: 554438 - DNA, 996 bp, Homo sapiens
gataaatataacgtatacacgggatgtaaggctcacacacggtggctattccctcccttcgggggaaatatgccatcgtctgaacggtttaggatgatcatgaggagagcggcttagtcacacagccagccttgctcatcacaaaagattgtgcagactcacgtgtaacagaatgacaaggcagatagctaatccttttttctgtgcctcaaagcccgacgtgcaagtacacacaaaccctaccggtacctctaccacgtgcgaggctaatagagtagatcagaaccaggaatgtgagctgggttccaccttaggaggggacaatgaggacagagcaagagggctccatgtttaattactaccaggctctgacttctgaccacaattacagagcatgaaagcagaattggcctttagtaaagtgaaaaggaagtaggctcctagcagcatataatagttataactacgaataacatggaaagagaaaaggacttcagtcacactacaagacgttaagcactagtacctcactaccacatggagacccacataacctatgtaaaagggcacagatggctgggaccgacgaggaaaagaggcaaagagacggcatagccagacagtgtgacatactcaccccatacaggggataataccagcgggacgtaaccatgaagaaaacgataccccaataataaacacacagaaaaaagggataggaagagaagacaaagtccaagtaaaacacaggcagaataagcaaaaacagccgagaaaaagaagcaagaaagaacaacacgaagagagacccaataacaacaaggagtgatatctgggcaaagacgaatgggcaggagacaggataacacaaacaaagcaggagcacgaaataagcaacaaagccagcaacaaaaacaaaaaagagaacagagaaaaggataaagagaaaaccgacaaataaaaaaacaagagacaacaaagctaaagacacagaaa

SEQ ID NO: 554439 - DNA, 116 bp, Homo sapiens
catgggtcccggcccacagaattacggcagcggcatgagaccaccacccaacttcctcggccccgccatgcccgggattaacatgggccccggagcttgcagaacccttggccaat

SEQ ID NO: 554440 - DNA, 1394 bp, Homo sapiens
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaata

SEQ ID NO: 554441 - DNA, 135 bp, Homo sapiens
gtactgaaacagcttataccctagaagaagaagctgtttcagtacaacgggaagaagaatatgaggtatatgaagaatatgattataaagaattcgaggagtatgaaccaacagaagaatatgaccaatatgaag

SEQ ID NO: 554442 - DNA, 1483 bp, Homo sapiens
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaatacttttggatgttaaattcattggaaaaacaaaccatttgtaacctcagttaactttaacaacaagcattctgagcaaatgaaaaaaaaa

SEQ ID NO: 554443 - DNA, 925 bp, Homo sapiens
  misc_feature (802)..(802): n is a, c, g, or t
  misc_feature (804)..(805): n is a, c, g, or t
  misc_feature (811)..(811): n is a, c, g, or t
  misc_feature (815)..(816): n is a, c, g, or t
  misc_feature (830)..(830): n is a, c, g, or t
  misc_feature (838)..(838): n is a, c, g, or t
  misc_feature (842)..(842): n is a, c, g, or t
  misc_feature (846)..(846): n is a, c, g, or t
  misc_feature (849)..(849): n is a, c, g, or t
  misc_feature (853)..(853): n is a, c, g, or t
  misc_feature (861)..(861): n is a, c, g, or t
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataagataaaattttaaattccttaacaggaattactggtgggaggaangnntaaagnaggnngaaattttgtaganggtaattncgangggnggngcanattaaatntggcaccttggaacatcattggagagaaaggttcagatgtgaataggcacaattgttttgaagg

SEQ ID NO: 554444 - DNA, 224 bp, Homo sapiens
ctctttttgtagtatctggaagtggacatttggagcgctttcaggcctatgttgaaaaaggaaatatcttcccataaaaactagacggaagcattctcagaaacttatttgtgatgtgtttgctcaactaacaggattgaaccatcgttttgaaggagcagttttgaaacactgttttcgtggaatctgcaagtggatatttggctagctttgagggtcgacgc

SEQ ID NO: 554445 - DNA, 636 bp, Homo sapiens
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagaaatatttgtgctgaagacatgaagattcttggatgtattcttgtagaagcttgattgttttagccttcacattatgttactgatgcattttgaattaatatttgtgtatggagtggaggtcaagttcacaattttctacattaatatctagttgaccatttattgaaatgaccatccttgccccacaatattgctgtgctgcctttattgtaaatcaagtggcactatatttgtgcctctgtatctcaactcttcaatgtattccattagtctacttttgtatatttgccaatgctatactgctttaattactgtagaattaaagctaaattaaattatgtctcc

SEQ ID NO: 554446 - DNA, 199 bp, Homo sapiens
tgtggtagtatgtatgtgaatatcataataaatggtgcaagaaattgcataattctgattgatggcaatcatacttgtgcacgatagagccagtataatgccaaattttgtatacattattaaccacgtaaccatgggagcacaatgtacgctgttaaaactatgctcaccatccgaggcaccaagcaaacatatgtag

SEQ ID NO: 554447 - DNA, 1615 bp, Homo sapiens
  misc_feature (1445)..(1445): n is a, c, g, or t
  misc_feature (1451)..(1451): n is a, c, g, or t
  misc_feature (1455)..(1455): n is a, c, g, or t
  misc_feature (1462)..(1462): n is a, c, g, or t
  misc_feature (1466)..(1466): n is a, c, g, or t
  misc_feature (1468)..(1469): n is a, c, g, or t
  misc_feature (1476)..(1476): n is a, c, g, or t
  misc_feature (1559)..(1559): n is a, c, g, or t
  misc_feature (1599)..(1599): n is a, c, g, or t
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaataaaaaaaaaaaaaaaaaaaaaaaaaaaaaaaaaaaaaaaaaaaaaaaaaaanggaganaaanaaaaaanaaanannaggaaanaaaaaaaaaaaaaaaaaaaaaagagggaagaaaaagagggaaaaagaaaggaaaaaaaaaaagggggggggggggaaaggagnaagattgggaaaaaggaagagaggagaaaaaaaatggaanagaggagaaaagggga

SEQ ID NO: 554448 - DNA, 365 bp, Homo sapiens
ttgagttttttgatccagacccagatcagtactagctctagcagactaatctggtagtactatcactgaacatacagaggtggatcctgcccctatgggagtccactgtgactgcagtccagtggggacaatgtacacactgatgccggaaagaagtcctgggagatgcggagggcatcctgtatttggcaggcagtctgggtggtccacgggtgtagagcttcagcaggtcctgcctgcgtattccccaagtcgcctcgcagatcctgggccttgggacgcgcttcctcccaccctggagtcttccggcatttaccccttggccagggctgggatggccgtagctgtttctccagactcacgta

SEQ ID NO: 554449 - DNA, 1001 bp, Homo sapiens
cggtgcggacggacccacatggggccgggacccacgcacacgctgaacccgcccctgacaaggccaggccccggcgactcggtgcttccttgaccccgggacttctccacggccatcgagggtcacgaagcccgccgcgcggctatgaggccggatgccccatgtggaacggttccagggcaacttaacgtggagctcatctgagctgacggcgagggccacatctcgccctgccccctcggcagacatgccagccttcagttgcctggaagaccgaggcctgcgagtggacatcagcactgtttccaggaaacgaggacccccagatgaggagaggcgtcagggctgccctccgggcttggcagacttcagcgggttcaccaccaaatggcagcaatggcacatggtgattcgccacacagtccggccggcatccccggacccgtcccagacagcctggctgtagccaccgacaggatactgagccaagcccggcctgagtgccaagaccctgagtggccacctgccaagactgccgaggaagggtcctgagcaggggcatcctgggaggctccggctgccttctgcatttacttgccgcctgtgtattttgtctcttagcttctgaagggctagaatggccaccactggtttagaatgacccttgggaaacagcgaatccctagagaatagttttctagcagagtttgtgactctaagtcagatgtggatcatggtggtttggcagcagggaatttttcttgttggagcttgctctgtgctcctcactccatttctctgtccctctgcctgggatatgggaagtggggatacagatgcctcaagctcccaaccctgggtattcaaaaacggcagacacaacatgttcctccacgcggctctactcagatgcatgcaggctcccagtgtgtagcctcaactgatatcggacttcaggaaaagtaacacagagtggcccttgaactgtagtgtgcccctat

SEQ ID NO: 554450 - DNA, 357 bp, Homo sapiens
  misc_feature (18)..(18): n is a, c, g, or t
  misc_feature (285)..(285): n is a, c, g, or t
  misc_feature (333)..(333): n is a, c, g, or t
  misc_feature (352)..(352): n is a, c, g, or t
cattgtagccctaaaccngtcaaccctagtcacccatccggggtattggctcaacatatactgcagacccaatgtgtgtcaggcactggatatggcccctggggacaatgtctgtcagctgtcctctctctgggcatatatttgtcaagagagatgctatggattcatttccttcagtcacgtcaaaacatggacttcatagtttcctactgaatcaacagtatgttctagaaaccctcaacggtcagtcacaccaccccacccccaacaaagtgacagagacanctttgccaagtaaacccagggctttcaatgttagtcctctcagaggantggagtagtttcaaatcangaagg

SEQ ID NO: 554451 - DNA, 1600 bp, Homo sapiens
  misc_feature (1445)..(1445): n is a, c, g, or t
  misc_feature (1451)..(1451): n is a, c, g, or t
  misc_feature (1455)..(1455): n is a, c, g, or t
  misc_feature (1462)..(1462): n is a, c, g, or t
  misc_feature (1466)..(1466): n is a, c, g, or t
  misc_feature (1468)..(1469): n is a, c, g, or t
  misc_feature (1476)..(1476): n is a, c, g, or t
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaataaaaaaaaaaaaaaaaaaaaaaaaaaaaaaaaaaaaaaaaaaaaaaaaaaanggaganaaanaaaaaanaaanannaggaaanaaaaaaaaaaaaaatgataaaatgtgaagtttaaagttggaaaattattttaaaaataattttgaagggggggaataacaatagtataacttttattaaggtatgattcatattataagatttt

SEQ ID NO: 554452 - DNA, 1454 bp, Homo sapiens
taaaaaaaaaatgtaaaatctcagttaaatttccaagtttgtggtattagaaaagtgtatgtgccacaggttgggtatttaatataaacacaaccatatcttatttataaattacaaaaataaaaaaaaggtgatccgtaagcgttttagtgaaggggtgaaaacattatataacactctacaaagagggcgtggtttcgtgcatctgtggattctatagtgttaatttccagtggagtctcttcataccaaatttcacattaaacagaaaatataatcctcttaatagctcaaatatatgtggtcacacttcacagtggccccaaaatatgtggaacagtgtgggcataggggtgaaaatattcttggagagggaattcacacattaattgtgctcgtggtctcctctcacactctcaaaaacgttacgccgcgtggtgtgctcgtgttcacaaggtcataccctatcgagaaacatgtggctctcacaccagtgaaaaaaacgagcccgacgaattacaataagcgagcgaggagagctctctctaagacaaatctctctcttgtgttttctccccccaacaaggtctaaaaaacaaaagggttttatcacctaaaagaataatccgtgaaaaatcacagctcttgccgtgtaaaccaggaggcgataaggggaaaaaccacaacttgaccagctgaggagcttgtgcaccccacacacccaaagattatgtgtccggacaggttaaacgggagcacagacgcacagaaacacacagaaaggaaaccccctgtctctaagaagattacccggggggggaataccccccaaacaatctcagaggatacaatagaccaaaaaatcgcagtgggcacaacccaacgacagcgccaaaacacgcgtgtgcacaccaaagcgtgggacgcacgtaggagcaccaatcacacagcttaaaacacaacctgaaaatcagcccgcgagtcacaaagagctgcgcactacaaccaaagtcgcacacacacacaccacaacaatcaccagaacatgccgcaaaaatgcttggcgctccccccagagagccacgcgacaaaaacaacaacggacacgacttctgctaccacacgacaaaggtggaggaaacaggccccccaagtagtggccaaaaagaggggcacatacggacagccctgtgtaagtgcccaacaagttaccgacacaggacaactgacggagacaaaatggaggcacacccgaaacaccactaacacgggaggacggagcacaaactataggacataatagggccacgacaaaagcgcacagacgagagagagacaacaccagagcacacacgacacgtatgaacaaccaaacagatcacacgaacatatcaggaccagaacgtgcagtaggctctccctctcgctgctcctctcccgcgctgctgctggag

SEQ ID NO: 554453 - DNA, 1444 bp, Homo sapiens
  misc_feature (1261)..(1261): n is a, c, g, or t
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttcctgagatatttgattaaacgctagttacagacaaagtatttatcctcattttgttatgtttagagatatccctgtccttttcccttatatcactaggcatatatagtttgtcgttaatatatatcttcaagaaacatattttttatcatagatgataagactagctcctagttcttataaattatttattgatccctgcttgacagatattgtgaggtgctatgaacatgcnaccttccactatcccgtctattcctcgatagtaactctttacactttctaacgctctctatctcttgacgaaaaccttctttttccgttattatatttgacggcctgttgtgcaatttagttttttttttactcttttaatgatacgtcttatgtcataccgccttgattgaaacaaaaaaat

SEQ ID NO: 554454 - DNA, 176 bp, Homo sapiens
cgcactatagaaccaagctggcacagacagctctgtacagggacattaagcttggatgggcacaaaaggagcagcaggtgtatactgcgccaggcaccaagctgcagatcttcgagccggagctggcatagagcactgcgacacgctcaatgtcagcctagcattgagccaggggg

SEQ ID NO: 554455 - DNA, 1405 bp, Homo sapiens
  misc_feature (760)..(760): n is a, c, g, or t
  misc_feature (762)..(762): n is a, c, g, or t
  misc_feature (805)..(805): n is a, c, g, or t
  misc_feature (809)..(809): n is a, c, g, or t
  misc_feature (815)..(815): n is a, c, g, or t
  misc_feature (841)..(842): n is a, c, g, or t
  misc_feature (844)..(844): n is a, c, g, or t
  misc_feature (850)..(850): n is a, c, g, or t
  misc_feature (853)..(853): n is a, c, g, or t
  misc_feature (856)..(857): n is a, c, g, or t
  misc_feature (871)..(871): n is a, c, g, or t
  misc_feature (885)..(885): n is a, c, g, or t
  misc_feature (889)..(889): n is a, c, g, or t
  misc_feature (901)..(901): n is a, c, g, or t
  misc_feature (905)..(905): n is a, c, g, or t
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataacgntnccccacccccccccccccctccccaccccctcccccccccccncccngcccanccccaacccccccccccccccccccnnancccacngtngcnncctacactcccacnacccctcccccccncccnccaaacatcccncaanccctcgcagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaata

SEQ ID NO: 554456 - DNA, 272 bp, Homo sapiens
gggacagggggaggctgtctggtcagcactgtgtatatcgaaagaacaaggactagcctaaactacaagcctatgaaggaccacaggaaaagagaacaaaccagactctaaccaggccatgcgctagaaatgattgagtatacaacagaaaataggtttctgatgtctgacgggtgcatggaaccaggctgtagaagaaaagattgaatggctggaaagccaccacgatgctgacatcgaagacttcaaagctaagaagaaggaggaggagg

SEQ ID NO: 554457 - DNA, 191 bp, Homo sapiens
  misc_feature (35)..(35): n is a, c, g, or t
  misc_feature (75)..(75): n is a, c, g, or t
gcaggccacgcaggcggggggggggggggggagcnggggtccgccccgggggggccagggggccccgaccctgcnccaggaaacgaacaacggccagcagggggcggcagagccagcaggagcacgggacatgcgggcagaaagccggtttctttgtcagtgtaaggccggggtaggacaggcggagggcc

SEQ ID NO: 554458 - DNA, 883 bp, Homo sapiens
ggaggagaactagtttcgagtttttttgtggtttcttttttttaaaaaccctcatcactaaatggaaacatacaaaaatagtcaacccacttctacaaaatgccagtataaggcgggggctctcaaacccaaagtgatgttgggattgttaagggtgaaatttttagttgggcgggattgaagcgccaaatattgagcgacaagtttgcagccactctaatctgcctgtgcaacgctccggtgaacaccacgtgatggactacaacagatactttctgacccgctacgactgccgctcgaacaattgcttaaagcgcagactccaaattatcacctcctggacaggcttctgcacaaccgacagcgcgtcctacacatcttacaacactacatcgcttgattcattcgtcgtctcacatacactcacagtgagctcgtatgaacacacaatattgtgactattctcacaggtatgtattactactatatataaacacactactcgtggcataaacacccactaacgcaatacactcacacataactatacgtctatatatatcgacctcgcatacgtatattcatacgaggaaataaaatgagtgtatgctcatacggacacataccctagcgaataaaccttcataagacggagagctatatcacaactcacgcgacgagttgatgaataacaactccccaatcgcaattcgagtcacgttaccaacaatagccccacctgtactcgacacaacttcgctcgcggcacctataaactgagtactcactaactggcaaccctgaccgcaccacgatccaaccacacacgatcctcaacgcaaccaaacatctaccagctcgacgagaaacaacccaccaacac

SEQ ID NO: 554459 - DNA, 160 bp, Homo sapiens
gagctatatctgagtaacatctcagacgcgcaggaaatataaaccgtctgaactatcctgcccgccatcatcctaatcctcatcgccctcccatccctacgcatcctttacatctcagaggaggtcaatgactccctcccttaccatcaacatcaaattt

SEQ ID NO: 554460 - DNA, 370 bp, Homo sapiens
ggacgagggtacaggcaggagctacccagtacaggaagggaaggagcagggagcctggactgggaagcgatgttggtcagtgcctggaaacaatgcttttggcagaatacatgaaaaggttgttacatctctgggtgcccgtctaccgtgatgcagtgtcacttggctgggcgggatggagaggagacagtggcatcacagtggcctctggtgcgacgtatttacaacagatgctcgatgttagaggaggggtggacagcaggtcactaacagccaggaaacacacactggaatccaccgatgggttctgcaaacctgtgccggatcaggaaagtggcaacagctacagttaccttgtcaggggctcccg

SEQ ID NO: 554461 - DNA, 145 bp, Homo sapiens
acgtgcttctcacaacactctgctcatttcccaaacaggaccctgacagtgacagctataatttctatgcaattaaaagtaacaccagccagacacagttagctcatgcctgtaatcccaacacttgaggaggctgaggtggatg

SEQ ID NO: 554462 - DNA, 102 bp, Homo sapiens
ctggctctgccctgtcctttttagctggcaagtgggcaaataacctttctaagaaataattaatcagcagcacagagccataaggttttactcatatattct

SEQ ID NO: 554463 - DNA, 221 bp, Homo sapiens
ggtaactcccgatcccagggcctagccctgacacaggtggcttcccgtatcccggtgggaaaaacggccccattgcccaatcgcagggccgggtgggcttttgaacgggcctttggtggccgttgggattgggttcacacgtttccccaatccgttggagccccattgagccaatccccaatccaccaccaaagcccattccccaaaggaaggttgggcaa

SEQ ID NO: 554464 - DNA, 439 bp, Homo sapiens
ccccgaagcacactgcaacacatatatttttaatgcaacactgtgattgctttctcttagttatgtagtcacagtgacaaatttgcaagatgacaaattttatgcaagagtttggctgtttctccaatattctgagaaattctgggagtatgcaatgcacttgctgaatggagacaaacctagagcttttcagacttctttagctatttcttgggtcagaacatgcagtgtttctgaacactggaattactctgtagcattattggccatataaaaacattgaggtcaaacagatccatcctgaaactcagccaattggacttctagtttaatacctaaactagcaaagaattttagacagcaatattatctaaaaaatgactttccggaatgtattctaagggggaaaagataagagagtgcttccgatagtctcaca

SEQ ID NO: 554465 - DNA, 512 bp, Homo sapiens
taggctcggacctgaaattggcacagaaattaatattaatcaaagatctgattcttcgaggcattatatataaagatccctgcttgtttttggatcttaacacagcagagggctggtttcactggcacgatccagctatttctagatactttaatagatcttgcaagcggtaatcatattttataactaaactggaaagttagaaatgagcttttacaatatcctcatacttcaaggcagaggttccaaagttacctattccaaaaatattccttgctttctgtagccagaagtatcctttctggctcctgtgtttagtccctgcctttttttttttttttttttttgatacctatagccttctgccttgtaatatggttacttacaaataactcttctttggaatggtaaactgccttcctaagggatgagactgtatttggaattacttctcttcaccatgtctccctcttggctaacgcacagaaaacgttcaacaaaacatgtgctga

SEQ ID NO: 554466 - DNA, 554 bp, Homo sapiens
caaggtgaaggagcaagagctcacatagaagctgcagcaagttatccagagatctagctaagatcactggtaaaggcggctgcactcaacaagagattttcaatgtagatgaaaaagctttgtattggaagaagatgccatgtaggactttcatagctagagaggagaagtcaatgcctggcttcaaaacttcaaagaacaggctgactctcttgttaggggctaatgcagctggtgaccacaagttgaagccatttgtcattctgaaagtcctaggacccttaagatttatgctaaatctactctgcccgtgctctacaaatggaacaacagagcctggatgacagcacatctgtttacagtacgattgactgcatattttgaacccacagttgagacttgctactcagaaaaaaagattcacttcaaattatcactgttctttgacaatctacccaagagctcttgtggagatgtacaaggagaggaatattgttttatgcctgttaacaaacacccaatcttgctgccataaaaaagaaatgctcttatga

SEQ ID NO: 554467 - DNA, 89 bp, Homo sapiens
tcgacccacgcgtccggtcttaagctgttcttgcataggctcttaagcagcatggaaaaatggttgatggaaaataaacatcagtttct

SEQ ID NO: 554468 - DNA, 1058 bp, Homo sapiens
  misc_feature (168)..(168): n is a, c, g, or t
  misc_feature (239)..(239): n is a, c, g, or t
  misc_feature (369)..(369): n is a, c, g, or t
  misc_feature (482)..(482): n is a, c, g, or t
gcgccattggtgttgggtaccccgggtgaattctggcccatttatgggcccgggcgacggctaacggtcgtctctcctaccctaggttgaagatagggcttcctaagagcacaatgtgaggatgtacatacaacgaggggaggggactagacccaacagtgcactggnccactgcgttcattcgttataaagaatccacataatgactcatcacagtgccgaaatccgctgtgccgtgnatctccagatctttgctcctccctacgggcgaggccgccccggcatgggccctgcatgtgcgttacctttttccatttagtcacacgtccccctcctcctgcctccacacacagcctaaggaggggtcgnccgccgccggccgcgtcgcgacgggctcagcctcagcgcggccctctgcccacatacctcacaacattaatctgcctcttcttggcttactcttcgtaactcccctaacgagnatatatccgatatattatatatggtggttaccttataatatatatctgctggtctccgtttgctctatggttgttctgtgtgcgcgcattcccgacgtaattccttatatgcgagctctccgacggccgcttacggcgcctccgtctatcgtaagtccttcccttatcgtctatctctcccctcatcttctccactgctgacccagtcaattctattgccgcacccagcatctttaccgctgactcccagattccctcctccctcctcaccaccgcgccgtgcccaccgtgacgtactgcacacccaccccccgcggcgggtgatgctgtgctctcgttcaacaccttacccacaggccaatcgtcacacgagcatcgttacgaaggcttattcgttcctccacacacctcttctctttccacttctcacatacgatatctaccactccccatcgcgtgctccccctcatccctgccgccatattccttgttcgtcactctctccttcttctaccttcctccgcatctctagcccatcctatctcgaccgactcatctatcaatccattccctcat

SEQ ID NO: 554469 - DNA, 889 bp, Homo sapiens
taagagaccagacttggaagagtcagagtggccagtttcttttggggaatggtggtggtagaggtgagatccagggtaactgtgaagaagccggtcctgagctctggaaatgcgagagtaggaggggtgtcctcacatggggtgcacagtgagggacacgcagtaagacgcagagggagccagccatggttccggggaagttgaaagtgctgtcctagctggctggcccagtcctgcgtgctcctgtgtgtgtgcaggtccagcggaagggggcagcagtgctctttaacatcccccttcaggcctgcctgcatgcagaccctttgctggggcttagactggtcaaagttaaggcacactttcgttgggagcccttctagtgcccaggctggccactgagccatgggtaagggtacaggctggattaagggcggatagatggataccagcaatgttagcatagttctcctacatagacaagcagcactgtgacttctgtaagccgagggacagaggcgggagtgagcgagtcgcagcctgggttcacgtggtgggcttgttctgaggtcactttctccatagaaacccaggtttcctaggtcaacccatctttcctagggttaaccatctttccccggagaaaggggacccaggttggtgaagggggttgaaggcctgtacaactttctagcttaaaggccggacaagggaaagtgggccgtcctttctcagtaccacagctggtcggggtcccaactataattatcttcgtttttaggggcgacagatttatccctaaagaagtgccacacaaagtagatcctggagaggaaagagggtcagaagatacacacagcggggacgtgtaatagcgagaggcacggaaacg

SEQ ID NO: 554470 - DNA, 1323 bp, Homo sapiens
acagggtattttcctcagcgagccaccagaaggcacattcaccgggtggcgcgtccgtggttgggccttccgggttgccgtcaccaggcagcagccgcccctccctcccgccacagtaggtctgtgcggcctgtccggccccgctgcgttggcgcaggcaattctcccaaacgggttccactggggctgcctgggtggtggtggggcgggacgccatggttgaccacggggaggggcggggaccttcgcccgggggccccagggaccccttgatacaacaatgtcctccggaggctgggagggcatactccaggaaccacgggttgccggcccaatcggcgcatccagggggccgccttgtgatcgttcttccggccttcagagcttgggcagacattttgggctttggagttcccctggggcgcagggggggcctttcaacgcgagtctatcttttgggcctgtggacagacgcgtttgactgccatgtgggactggtacgttcgtgtggaatctccccttgtgattcaacgggttccacttttggccccacggggggcttagccgcccctaccgagccacagtgcgctcgagcacgcggttagacactctgtgtgtgtccccaggctcgtttagccggcgtaatggggggagcattactcctttgtcttctcgcaaccgggcactccctggggaggttttgcttcggcacgccatggggcaaaacatgcccccacgatgaaccattttctaaagcagccagagcccaaaattctgtggccaacaaggtgcccgctggacatttccgtggggggagttcttatcaaaaacacgggtttaacccttcacaagggggaagcctctctgtatgaaggggcctttagagaacatttttccccaaagcaagagacgttgaacgcagacttgggcgcgagatctgttcccgtgtggcaccccaacgcgtgggcgaggaacaatccatggcagaggggaggagtaaaccaccacgatgagggggaggacacataatactcacaagccggctctgcccccacagccgcgagaggcaccctacaaacacccgcttgtgtaatgggcccgcagagaaacaccatagaatatatgtttggccactggggcacaaaaacaccctttgtgcagccttgatcatgaccctgtggcaacagggcgtgaaaaacgcagagcgggccccgctgaagaccccatgatcagtggcccccccccaaatagtgggacgtaaaccaggccagccattaaaaaggattcccctcccgcagggggaccccaacgatcacactcaat

SEQ ID NO: 554471 - DNA, 454 bp, Homo sapiens
ccatgaagctatgcgtgactgtcctgtctctcctcatgctagtagctgccttctggtctccagcgctctcagcaccaatgggctaaaaccctcccaccgcctgctgctttttttacaccgggaggaagcttcctcgcaactttgtggtagattactatgaaaccagcaacctgtggtcccacccggctggggtattccaaaccagacgaagcacgcaggtctgggctgatccaaaaggaagctccatccacaagcacttgattaaccgggaactgaactgacatccgcataaacccgaaatcttcacggaaggtcccctgagcccgagcccacgccactgagacacatctgctccgtactctggactccagtccccagagcctgtcccttatctaggtgagagcctgtggctcagccatgtcagccagggaagtgtgagcccgatggtggaggg

SEQ ID NO: 554472 - DNA, 439 bp, Homo sapiens
tcctcgttctcgtcccacactgttgatggtgcctctattccctggtcaggtagtgttctttcggtctctccactggacacttagtctttctcctctactttcgcacagtgctgcctctggcggcgtgtgctgtgcctcgctcacgcttgtggagtgtggcttcaatgtactcactctttcgcgggtagcgtatctgcataaactacttggcattctgcatggcatatttgtgtcttatctctacattttacactttatttgtataaaaactcacaacattattttgcgtccactgtatttctttttacaattacctttatagccagtgatcagttttgcctacaatttaagcaaatcatcaacagtacaaaaacactagagttgtaaacacgaaggcctgattctaacaaaacattactctaaggtgatggcataatct

SEQ ID NO: 554473 - DNA, 153 bp, Homo sapiens
gcaagtaggcaaggcttagacatctgctacttttcgcacgactgacatgctgatgacctgcacgtgtttgtggcgccacactctcacaatgacccatgctggatcaagacctttgacaagtgctacacacagcagaccaaacacatcctcaat

SEQ ID NO: 554474 - DNA, 294 bp, Homo sapiens
  misc_feature (90)..(90): n is a, c, g, or t
gtgacccaaaactttttccttcttaaagggtgtgtgggggggacccaaaaaggggggtttccccccccccagtcctttttggggccaaanaaacgggggggtttggaaaagatttccctttagtttttttacccccccccccagtttgggcctgggcgctttccgcccctgggggggaaaaaagccttttttgggccccttaaaaaaagcccgatttccaagggaaaagggggttttttcccgggaccaatttttccggtggggggggttccattaaagttttttttcccttta

SEQ ID NO: 554475 - DNA, 230 bp, Homo sapiens
gtcgtctaggatcccgcgctagcggatagtgaacgggagcgacggaggatgagacaggcaggtacacagtgtgctacagagagcgacaacttgagtgaatacgtaatcacatctggaccacagcgatttcggtgcaaccatttaggaaacctctgggcccaactcgaaaacacaggaggaggaatggacaggcctctttgtgagcatgcgttcacttaatgccgctagcg

SEQ ID NO: 554476 - DNA, 1114 bp, Homo sapiens
  misc_feature (1114)..(1114): n is a, c, g, or t
agcgggggtgaatgggaacctacggatccgcggacgtgcggtgtggggcaccgcgcggggccgggggaaccgacacccgacggacgtgctgctgtgcagaacacccccgaggacccgcagtgagtcgacgtggcgccgagcgtctggcagcggcgccggagacgagcgtaccggtctccccggcacactggcgcgagtgagacagaattgcggcactcggccggcatgcagcagcggaggatcgcgagcgcgtcccagcgcggcatccacgcgcagcggcaccgaaatcgacgggtcgcgcaggcgcaactagagcatggaggacggcgatacgggtcgcgcactgggtgacctggagttcgtcacgaccatagcaccgccaacctggcgaagcaaggccatggatccccctgtgagtcacttctacagccgacaattgctctgatcatattgctgtccctcccaagcgtttggtggaccccttggacgcgtggtggacacaccatggtaccaaactatggaagactaaaccgccaccttcctctgccacctggtaataccagatttccagtcaattgccaccctgatgcgattatctacactgcggagcatagtagcacaaacaagcacacctgtcacatacggtgagctgaggatccaatggtgcgcccccggttggtacaaccttcccgttggttagacaaagttcccaccttatgctctcaagccacccttcgcaactttgaccacggccccaccactgggtgccgcatttactcggcacaccacaccttggggcacggaaactgggggcccttgcacttaggtcgcgccacatggccccctcgtgtgaattcttcgtaagcccctatagccatgttgcaaacaaacttagcaaacacgatgggagcgcacaaaacaggccccacgtatggagccgccataattgataaactagccacgggcccaactttgcctcccagagtggcacatacccattgcgacatctatcctgagccggacacagttcgcaaacacgccgcctaacgggccatcacattcttcacacctacgcatgtgtgtacgatgtaaccacgcccagtttttccactcn

SEQ ID NO: 554477 - DNA, 407 bp, Homo sapiens
ggcacgagcgcccaagtcactattattacaaatgtttgaaaacagtgatagaaagtatgtctgtatgaggggtatacttagtctgcagcatcctgtgtaaggatccccgacggaaacagcatttcctctgagctctggaaagtgtagtaggtttaaatcaggcaccaggggagaggaagagctttcctagcagcatgtgcaaaggctccatggcaggaatggagcctggacacatatgtgagtcactaataaggaataagatgcaactaaacagaggaagtgagaggtggtgttttatgaaatggtctcagggaggttggcaggaagtggaccatgaagaggctagaggccattgcagggagctggctctgtatactttaaaaaacatgggtccaggcttggtggct

SEQ ID NO: 554478 - DNA, 435 bp, Homo sapiens
aatccaatcagacaaaggaattcgtcagattttaatgcatgagattctagccagtgtctgtatgagactgtctttaaaggttgttggtatggaaaatgtttgaaagaacgtaggatttatttcagaaatacaattcaaaagagcatcttgtaaagctggagtttaacaatcctccatggctggacggcctttagagctgggctttctgtatgtgggttataccactagtttatttgaaaaagaaacgcacacatgttttttccttggaaccaagactgcagaaaattgccaatgttctagtcccttgaaaaagcggatggctctcaagcgttttttaaggtattaaactgccctttaaagtgaaaatccataagaggtcctagttgagctcttgcacactctgggaattaatgacttcattatttgggcttttaa

SEQ ID NO: 554479 - DNA, 100 bp, Homo sapiens
tcggcacctttatgtacgggtcttgcatgtactggggaggggataaggggttggctagggtataattgtctgggtcgcctaagaggtctggtgagaatag

SEQ ID NO: 554480 - DNA, 171 bp, Homo sapiens
gggcacttcagagccctctgacacatcatcttcctcatcttcatcttcatcatcatcttcttcctcttctttctcaagtactcgctcttctccacctctcttgctgcgagacgggcgggcgctggcgccggcgcgcggtccgggcctgtcccgcgggtgcacaagcgctcc

SEQ ID NO: 554481 - DNA, 445 bp, Homo sapiens
cgggtcctcctactagctccacctccgcctggcccactcccgcgtccgtcctagcgaccatggcgggccctgcgcgcccgtgctcctgtggcatcctgcgtggcctggcgtgagcccgcgccggctccagtcccggcaagccgccgcgcctggtgggaggcccatggacgccagcgtggaggaggagggtgtgcggcgtgcactggactttgccgtcggcgagtacaacaaagccagcaacgacatgtaccacagccgcgcgctgcagggtggtgcgcgcccgcaaagcagatcgtagcttggggtgaactacttctctggacgtggagctgggccgaaccacgtgtaccaagacccagcccaacttggacaactgccccttccatgaccagccacatctgaaaaggaaagcattctgctctttccagatctacgctgtgccttg

SEQ ID NO: 554482 - DNA, 765 bp, Homo sapiens
ggccgcgcggtgaggttgtctagtccacgctcggagccatgccgtccaagggtccgctgcagtcggtgcaggtcttcggacgcagaagacagcgacagctgttggcgcatcgtgcaaacagcggaatggtctcatctaaggtgaacgggcggcccctggagatgattgatccgtgcatgctacagtacaagctgcgtggatccagtgtctgcttctcggcaaggagcgactttgctggtgtacacatccgctgcttccgtgtaatgggtggtgtgtcacgtgggccagatttatgctatccgtcaggtccatctccaagagcccgtgggtggccatattaccagaaaatatgtggatagaggcgttccacacgaaggagatcaaagacatcctcgtccagtatgaccggaccctggtggtacgctgaccctcgtcgctgcgagtccaaccaagtttggaggccctggtgcccgcgctcgttagcagaaatcctaccgatagcccatcgtgactcaaaactcacttgtatatagcccagtttcgagggatggacagtcgtcacaaacacattaggcctgagacgctgagtcgctgaacaaacgacggggtggcgggaaacaaagcgggtacaccgaatgggccctttggtccataaggtggtccctatgacccggtttttctttgtgcccaacgggggaaaaaacctggccgggtcccccatatatggaggccgcaaaaatgcagaaaacccggttccctgatatc

SEQ ID NO: 554483 - DNA, 299 bp, Homo sapiens
actgagaggcataattatctgaatgcattagcctcattggtcaggctgttgtgacggaaaaattcatgcaagatgcatcagatgtgatgcagctttatgttaaagacccagacagactatcaatgatatggaagatgatgatcctcagatctcttacatgatctcagcatgggccagaatgtgcaaactccttggaaaagaatatcagcaataccttccagtggttatggggccttaaatgaagacggcttcaattaagcccgaagtagcccttttagatacccaagacatggagaata

SEQ ID NO: 554484 - DNA, 147 bp, Homo sapiens
ttagaggatcccgcgtggttcttgcagaggcataaaaactggcacacagtctgttttcaggaaatcttacagaatggattgaactttccatcaggcacacactttcttcagctcttgtccttggcgtctctctcaggagacagcggg

SEQ ID NO: 554485 - DNA, 420 bp, Homo sapiens
  misc_feature (420)..(420): n is a, c, g, or t
ctctatcagcgtctgaagccctgtcagatcttggcctgtaataaaaaagatggcgctgatgttccatatacacgtcatcgcccatgaatgtacatgtgttaaccatctatcaccatagaaagtcgctagtccagatgatcctcgtatggtaaggcagcagcttatatggggaacaacgtgctttcctaagctatcatggctcatgaacacacccatgatcatactggatggaatctcttgatcaggctcgacttactacgatcctggatactcagaatcgaccaatcaatgataatcagtatcaccagcggatagtgactatctggtgctaccgggatgcctcgtaagagggttcggaattaatacactggaaccatagtagagctcaacgaggcggtctatagctctgtggagactgcn

SEQ ID NO: 554486 - DNA, 965 bp, Homo sapiens
  misc_feature (328)..(328): n is a, c, g, or t
gggatgggtcagtcttgtgatcccgaggcaatgaggaagagcatgagggtggagatgagcattcaatatggaaagcatggctacgtgtaggttactgcacggggtaccaagttccttggacacatgtgagtacgtcggtagaaaattggctggtcctcgtagcataaaaaagaattggcgttataaacttgaagatcccattggcactgtgttgaggttgacgagcgtgcatggttaaattagcaccagacgttctcgtcccagtgcaggggccttgcaccaggcagcctgaagagtaactcaacgtgtaggatagcgcaccacgcgnaagggacgaggtaggcttggtcacggtgtaggacctggtagggaatgcggatgtgcttgaggctaagtaagaactcgcaggaatgttagatatcttacattaaaagtaggaagtcgtgagggtgcggagtattggtagggggaatatagaatgaagtggagtgacattatattcaacaggatcgttaatatctcggggaggacaaagttatgctaacagtgcgaggttaaaattgttcgaattgttgatcttaagggcgacttgggaggtgtgcgagtgggatgtcttccatttaatttctgaaaacctataaaatgtgtgcggtatctaaagaagttgtcttctacagatgaattaaagcgttagactacgttgggggggataggcggttcaaacacgggggggaggaatggaaatcgtggatacgggggaattggcattattcaccattggaagtgaatcttggggtttgttgcataggtggtcacacattgttgggagcgcaaagataactaactcctcaattgttgtcctagaacatggtcttctggggctttcacgatagggggtagagagacacattttgggcaactgggggtcaagagtaaaagaattggctctcaagaaggtataagaa

SEQ ID NO: 554487 - DNA, 253 bp, Homo sapiens
tctacaggatttacgtccgtcgaccgctcgtccgtcgaccgctcgtgaccgctcagataaactggtagccccccgtcaacactcaggaaagaagcataagtgcttcagatgcacgggagataaatcaaaatggactgagggtcttgaacctagtaccataaataaagtgcaccatgaatggaggctataaaaagccgcttgcccaaaggctgaggtttggggagaaactaccatcaccacccagcggtcgacg

SEQ ID NO: 554488 - DNA, 846 bp, Homo sapiens
gctgcgttcttcacagaggctggttcgatccattagcaccaatgtccggagaaacctggccttccacacactcagccacggaagtcctgctcaaggagttctccactatctcctgaggccagcgcctacctgagcagcgctctgactgcccttaccccatgacggatcatggagctggacgggtggacgcgacggcagacgacgggggctgcccccgacggttcggacgacgacacagcagatagccaaagttctactctgggtgaccgacccgcagctatcaactgagacgctatggggcacgcgacgcggagccggagacgcggtcaacggctcaagtgggaactacacttgccttatacatctatcgtgagagaacggaggacacttgagggaattgaggggcagcaaatggattggtgcgctgcacgcaacgcgttcgcctttcacaacgaggaaacaacattgatttcgagaagcgacacccattaatccccacgaacgatcaggttagcatatccccccttaacaaagcaaggaaccccacttagcaacacaacgttaccttctccacacagatccccttttcgaaccaccgctttaacctcaaaaccagcctatgagttaacgatgctaccccttagtacccctactatctttgggtaccgagtcgaacggcctttgtgctgaccgaagccaaccgccacgtccacgaggtgcggtacactgagccaaatgtgaccaccacttgacaccagcgttagccgtggtgcctacattcgttgaccgtaggcagtcacttggacaccaaccactgactagcagcgtcactccaagactactacg

SEQ ID NO: 554489 - DNA, 205 bp, Homo sapiens
tctgtgacttctgctctggtgacttcgtctgctgtctgcctggcctggtcttctatatgcattgctagacctgtccctgtgagagaactgacatgggatgatgggtgtcagggctgcttcaggacgtgcttcaaaaggcaacggccctgagtccctgcggtgatgaggaaggtaaggaatgcggagaagggggacacgccaccct

SEQ ID NO: 554490 - DNA, 970 bp, Homo sapiens
gcagaaattacccagtgatcttctcattgcatcttacctgtgaccctacagttgtgatttgccctgttgaactggtaagtgttatgcattgatcacgtagaacagctgggtatctgctgaatttctcctctgtaatgtcatatcttcaccttgtggttaatcctggagtattcttacatgcgcaaggtaatatatgcagactatgtacatatctctactccccatcgagaccctcgaaattgtatttcatttctgcttgtactcaacataaaccatggattccatggctttattctcattcagtgagttcataatcttcattaattattcgttcagttcacacaaacctttgttctaatccttttaacgcaaatgttatattttgacaaacttcagaactctcagcgagacacacgaaatttactaatgatgagctacgttaacaacattcagaattgttctcgggaatactgtattgtcccaccgaaaaatttggtgtgacaacattttctctaagccttgacactttgttcaacctaattaatctcttttatgctgccccccattacctccttcctggatcccttggttctaaggatctttcacaataattgcaaaattactcaagcggtaaccttctaaaattaaccaatgcacctttttttaatttcaagtcttaacacaacttggtctaccagataagtgattaaggtctatcgaaccattcgagtgcccgtcttcctgtaattattacttaaccactaaagaattgttcggttactttctacccattgatagattataaacaattcgcaacagtatcacccctctcaaacattatatcttgggtatatcttaataaaattgtggttcatacacactcgaagggacttattaacacccacctgggttttcaacctccccttttcatataatcctttcatctctttataaataaccctataaagcg

SEQ ID NO: 554491 - DNA, 859 bp, Homo sapiens
gggcccgtcccagtgacgtccgggagttatttgtgtgagtcccctggccttgggtgacgctttcttgggcacagtgggttcaaagtcaggagtggttttcaaggatgttttctggcgacgttccttggtgacccgcagagctgccccccgccatgggaagcagctggcttctactgctcagggtgtttattcctgggccttcagtgcctattttgtcgccggcctatgtcccccgtattggagttgccacccggctccaccattgcacgcacagtttgctgagctgtaaggaaaagattgatcgccgtttctggtaaaaaagctggaagatggccctcaattcttgaagtctggtgatctgcccatgttgatatggttcctggcagcccactgtgtgttgagagcttttcagactatccacccttgggtcgctttgctgttcgtgatatgagacagacacgttgcggtgggtgtcactccaagcacgtggacaagaaggctgctggagctggcaaggtcacccaagtctgccccggaagctcagaaggcttaatgaatattatcccttatacctgccacccccaacttcttaatcaagtggtggaagaagcggttctcagaactgtttgtttccattggcccattaagtgttagtagtaaaagactggtttatgataaccatgcatcgtgaaaacctttacgaaggataggagcaatgttttgtggacccctttggttttcttttttgcgtgtggcagttttaagattattagtttttaaatcagtacttttttatggaaacaacttgacccaaaatttgtcacaggattttgagacccccctcaaaagtttaatgaga

SEQ ID NO: 554492 - DNA, 411 bp, Homo sapiens
aggaccgcggttaagtcacgaggtacaagtagtcagagtagatagacgtcaagacctatcatcagaatgtaatcgcgggtagaaaaaatggaaggaagggaactcgacgatgtaaggtcatgcagccttgtaatcagatacagactctgacttatctagctgtatttcagttgctatcgtcctgttactttgtctactacactacatccagccagttgtctcagtaaacaaggcgttcatcagtgtcaacatgctcctctgcgttggtgcttctgtaatgtctatactgccaaaaatccaagaatcacaacccagatctggtttgttacagtcttcagtaattacagtctacacaatgtatttgacatggtcagctatgaccaatgaaccagaaacaaaatgaaccaagtg

SEQ ID NO: 554493 - DNA, 81 bp, Homo sapiens
cagcctgttcccccccccccccccctcaggaaagcccagggaaactgtagttttagtggcaaataaaaacctttgcctcca

SEQ ID NO: 554494 - DNA, 360 bp, Homo sapiens
ctaccaaaattgatagcagggtctgaatagatacttatacacccatacccatggtcagaacagcattattcacaataagcaaaaggtaaaaaccaattctggtgtccatcaatggttgaatgaataagcaaaatgtggtctaaaaatacactggaatgttattcagcctcgacaaggaattctgacatatgctacaacatggatgaaccttgatgacattgtgctaagtgaaataagccaggcataaatggacaaataccatatgattccacttaagaggtacctagggtagtcaaattcatagagaaagaaagtagaatggcgattgccagggcctgggggtaggtatgatgaaggacg

SEQ ID NO: 554495 - DNA, 461 bp, Homo sapiens
ttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctag

SEQ ID NO: 554496 - DNA, 655 bp, Homo sapiens
  misc_feature (313)..(313): n is a, c, g, or t
ttgtctgggtaaagccacttttttcaactttgccttttctctatttttccggcttatcaatctgggtgcccaggtggcatgcccgcagaacctaaggcagaaagatggaaagcacaaaggctaacgaggggatttttatgggtagttaaaagctttgagccaacccaaccaaacaaaaagtgaaagaaaatagaaaaaaaattagaaaaatatcaagaaagtatattcaagtgagggcttcctttgcggggaaaccaaaatgccacgtttaggccacatttgagggcgaagtttaaataaccaggacccattnttataatggggaaacccccaagggccagaggaagagaaattgcttgtcacaaattttgggaagctttaagtgcaaattggcagccctaaaagtaagagaaagtcaaacagtgactcccaaaaagcttggagaaaaacacacgtggcgatttcctcagagatttttgaacccagaaatgcccattgagtcagcaaatcgcattactggggtatatatttcaaaaggagtataaaatcattctatttataaagaatacatgccacacatattgttcaattgcaggccctatttaacaataaccaaaagacatgggaatcaaccccatatggccattcaggtgac

SEQ ID NO: 554497 - DNA, 312 bp, Homo sapiens
tcgagtctcgtcgtagtgtgatctgtcctttcccaccactagccctctttctctctgtgtggcaaacatttaaaaaaaaaaaaaaaagaggaaagatcccaagtcaaaagtgtggcttaaacatttttggtttctgggtgttgttatggcaagttttggctaagtgatgattcactcatttggggaaattctggcacggtatccaagttattggatcgtgggcgtgtggcccgtgggggagtccactttcctctctctctctctctctgttccaagtgtgtgtgcaagggttccgttcatctgaggagagtc

SEQ ID NO: 554498 - DNA, 203 bp, Homo sapiens
tctataaatatagaattaaagtcatctgcaaagagacgtatttagatatccctcttcctatttgaataccctttatttctctctcttaccttactgccctggacaggacttccagtactatgttgaataggagtggtgggagacagcattcttgtcttgtgtcagttttcaaagggaatgtttccagcttttggttatttcag

SEQ ID NO: 554499 - DNA, 1190 bp, Homo sapiens
cttcggaaagactgtccacacacagatggataatttagtggccttagctacaggagagaaaggatttggctacaaaacacagcaaattccatcgtgtaatccaaggcacttcatgcatccagggcggcagacttcacccaggggcagatggcacaggcaggcaaagcagcatctacggtgagcgcttccccgatgagaacttcaaactgaagcacatacgggaccatggctgggatgagcaatggaacaacgacaggtcacaagacaccaacgtgactcccagattctatcatcaacagacaagtcaagacaagccatggacatagaatggcaaagacactgatggatgtaaggcaaaagattctagcaggagcatggagggatagggtgcagagacagatggaaagacacacaagcacagacagaccgggataaaccacctgacaggatgtgatacatcgcagactgcgaacaagatcgaggatggaagaagcaccattatgacatacgacaaaggatcgtaagagcacaggaacatctatacttagaagtgaccgtaatgtagcaagcactgatagtcacgacaaagggaatctgaaactgcacatggacccggtgacatggaaatcatgagtgaagacggaacaaagataacaataaaaatacacaaagagacccatgagacataacttaaagataaaaaatatacttaaaaaattgaacaataaataaaaaaatgtgagagataaaaaatgaaaaaagaagaagagaacacacagaggagacaagacgaacgcaggcagaagaagaaaaaagagaaaaaaaggaggagacaaaagaaagaaataaaagtgaaacacaaagagaagaccacagatagatagaaaagagagccccaaaggagagaaaatagaagacacaaaactaaataaaactacataaaaaaaaaaacgtaagaacacatcctagaccacaacaaaaaaataaaaaaaatcaccatcaaatacatcataacaacaatatatgagaagatcataataggaacacaagagatatattaagttcgaaaataagaaaaggaagaagaagaagacgagacacacatcaccgatgatgaaagatagtaaggacagaaagataatgaaaagaaaagttagcagagtgtagaagtataataaaagtatgtataa

SEQ ID NO: 554500 - DNA, 173 bp, Homo sapiens
tcgagatatagaacaaatacatgaagagctcagctttaaagatgaggaactgattgggcccattatagaataaactagaaaaggtggctgtgagaggacgagataaaaaactaaaacctgaatatgatctaatgtgcaaagtaaaatcctgggttatagatccaagcgtgcca

SEQ ID NO: 554501 - DNA, 236 bp, Homo sapiens
tcgtttgtgcagtcacatcgtctgggctctcacgttgtccgggcgttgtgcatcttagttgtctgttcattgcagtctgtccctatgcattctttataactggttggccttacagccacaccgaggatccacccactccaggctccagttagaggccccacgctttccctgcgccacgcacatcgcgccatatggctcccgagctcgatcttcctaatcttggtcttcgctctttc

SEQ ID NO: 554502 - DNA, 1044 bp, Homo sapiens
ttggaacacagagtgtgtagggaagcactttgtaaactgtgtagcattatataaatgggagtattatttttatggcccattctcttcctccagtactgttaaggagtaaacaaaaaatgtatggattgcagtaatgttgcatttgggagaaattaaaatatgctcaccattagcaagctcttagaaaatgtggaggaaatttgcatggatcattttgggagctcagaactgtagggggtgcccaaggtatctggatgcaccaaatcacagtcccatccatgctgccaactagctgtcaggaagacatggatagttcctgccctttggtagtgatggaagtataggcgattacagatttttttttccatctcctatgggatccacagatatccggctttaaaatccataaacttgagccctaaaacaaacaaacaaacaaacaaaacacagcaacaaaaaaacaaaacacaacaaaacaaacaacccccccccccaacaaacacaaaagccggaaggggggatcctgagaacggcggaactcgactacagtaaccccccaccggtcaacacgcacacagtgctcacatcacagggctctcggcgctcacctgttggaaatcgccttgctacattcttccccccggtctcacccacctctcctctcaacggcatcggtcggaaaccactcccccacctggcccctctccacctccctttctacacactccccggagcagcactcactctactcgaaactcggtcagagcgccctacaacggtgtgacgacaccctgtccagcgccgctgccctcctagcaaacccctcgatcctgccaccttggaccctctgctcctacgacctcgccagcactacccctcgcaacaccccccaccccaactcccctaccacgaccctcagcaccgccatacctacactactactgacacgactccaccacaacccgcctcctcgcacccgaaagcgagccctcccaacacccaacaccgctggcgtgacacgacccgacccccaactcgccaacc

SEQ ID NO: 554503 - DNA, 283 bp, Homo sapiens
ttgcgttcatagagcccggggatctccaaggagcagcccagttttccctgtaagaacccaaaggtcttgtacagagttggaattcggcgaaaaacttgctccaacacgccaaatctgccgcatcctcaataccccaccctcttccctctgcgcttactgcccacacccctactcccaacttgaggactccccgcccccaccacgctgacagtctcaattccaaccccttggatgtgaggaagtgtctttgcgcctgaacgcgcccagcacggcgaggccaaca

SEQ ID NO: 554504 - DNA, 764 bp, Homo sapiens
aagacccagcccaggacccctaacaggggccctctcagccctcctaatgacctccggccgaggccatgtgatttcacttcgcactccatagaacgctccgtcgatactagcgcctactaagccaacagcactaagccatatcaccaatctgatggcgcgagggtagacacggagacaagcacgataccaagggccaccaacacaccacactgcgccaaagaaggcctatcgcatacgggataatcgctatttgattacgctcgagaagatttgttttcttctgcaggattgtattctgagcctgtttactcactcgcagcctagctcgcctaccctctccaatgtatggcagggctatcgtggtgccctcaagcaggccatcgagcctcgcgcctgaactcgcccgtacgaaggtcccaactccgtaaacagcatccgatgatgactcgcttcaggagttattcatgtcacctgagctcaccatagtctaattagaaagcgacctgaagcgcaaagtagatgtcgggcacttgcttatgacaacttcttactgggtctctaatttaagcctcgtagaagcctcagagtactctcgagtctcccgttctagccatggccgacggcgattctacggctcagcatttgttgtagccgcaggctccgacggactgcacgtcattatgggtcagtttactcattacttgttgcatccggccagtaatatttcaccttcttccaaacatcaatgggtttcaaagcgcgcg

SEQ ID NO: 554505 - DNA, 762 bp, Homo sapiens
  misc_feature (89)..(89): n is a, c, g, or t
  misc_feature (441)..(441): n is a, c, g, or t
gcttgttctaggccccgcggggtattcttgagggcggccccccttgttgcaccttgtgcgccccgcctctcggtcagatcccgcgcggnggcccccagggttggcttctgtctgttgctagaactcgcacgcaggccatgtttgtggcgcgccgcatgcgcccccgcgtgtggagagcggctcgcgattctgtctgttctgtattgtatgtcgcctctgtgtgcccctttcaccatagcgcgctgtggtgtagctatttgcgcgctcatagtcgctctcgatctatctcgctgcgggtaactagatcacccgcggctcttggatacgcggagacacaacgcctgtcacgcccctgggctccgcgcgctctatcgtcacgcatcacggcgctcgctcgcccacgcacaaatgcggcgtgcacacacaccgaacgctacactntggtgcgggaccacccgcgcgccgttgtggataacacactcacaccccgctggagaacacacccactgtctcaatatcttcgagcgctcgcacgcacgcacacgcacacacaggcgcacaatacgagaggtggggacacaagcgaccaagataatgttgttcgacgagcgttgttcgtgtcacaccactactatgctactattttctctgctacccctctccctggtaggcgctggcgaacaaccagcggggagatgggccacccatcacgccaaaataggtatttctatacacggaaccagtccgacaatagcagacaca

SEQ ID NO: 554506 - DNA, 244 bp, Homo sapiens
  misc_feature (112)..(112): n is a, c, g, or t
  misc_feature (161)..(161): n is a, c, g, or t
  misc_feature (178)..(178): n is a, c, g, or t
  misc_feature (202)..(202): n is a, c, g, or t
  misc_feature (210)..(210): n is a, c, g, or t
  misc_feature (228)..(228): n is a, c, g, or t
aatttaaaagatattattattactatcaattatatattgaatttattatattttggatatattaggttaaataaattattaaaattattttcaccttttttcctttttttanatgttactacttagaaacacaaacataatatatatgtgatttgtggtancaattctactggacaantccaccttaagagttaggtagggnagggtacnttaaaggctccagtgtcnggtgaccactaccagg

SEQ ID NO: 554507 - DNA, 975 bp, Homo sapiens
gtcaggggatgtggaggatgtatgatatggatagccggccactaggtcctatccttcatggtcctgcttactcatggcatgctagagtctgagaactgtagatgtttgatcggcctggaccttgggctcacatgggtgtcgagggatcgacgcgagacatccattgtttggagtaaatatcatccgtttctttatgtaaccagtcgtgttgcgagggtatgttacatgagggcgttctagaaagatcgtggcaagatatacatcacttggaataggtattgcatatatcaagtgtacgtagggtaaataaagttagcagtattggtatgtaggaactgggataggtggaataggaaatgtatacctctgggacaggtggttcggcagggaggctcccgatatgactccctttctaactaccctagattcatgaagactagccagaaatctcacgtataacatctcgctcgcaggatgtgcttgggacccactgctggaaattctcatccatgatcatacttgacatgagcatagggtgtgcctgatgtagctgatcatgtctcgactggggaagcaaggccattagcaattgatccgcggcgctgtggagatggtttatctccctaaaactttttccaagcctggcgggaccggggaacctgttcgtgtgtacagggatgcgttttgcaggcttgctacgggcatgtggaggtttagcacacaggctgagaatggttcggtagaacaggtcagatgggaagtagtatgctaacagatgccaggtgtatgtgcgttgtcacttcacttctatgggagggtcgttaaataggatcctagggatgggttgggagtttcattgtgaacggacgactagatattccttgccaataagattaaagaaggtggcaatagcgatagggggtacataaggggggcggttaatgaacaaaggggcttcgggtggaacaaagagta

SEQ ID NO: 554508 - DNA, 1140 bp, Homo sapiens
tggcagtactaccacggtttaaggtagcgaggcatgggtggcgtggaataaattgaatgacatgccaggtggatggtgcagctgtgaagctcgggctgattccccctctgtacccagaaggttggtccagagggtgtgacccagttaccctttaacccccatccttccagtcgggtgtcgagggcctgaacgggacccagggcaagcagctgtcgcaagccctattgtattcagtcttcagctataactcttagagttgagacgctaatgttcatgatctcctggccttgggatgtccaatgggattatctggcgtcaggctgtaaaagtagctcgagccatcctgcccattcctggagtgtcctacatggtgaatagctgcaggagctcagcataggacccagcatctctgggaggatggtcacgcgtggatgattgtcaatgatggcatccaggcaattagctgagccaacagagccatgtggacagcttctggccaggagctccccgtgtggcatctgggagccacagtgatgccagaccagctgggtcaggcgtagttccaaattccaaagaggatgggcttgtaaaccttcgtctccctctactgttagccagagagagcacatacgtgtgcagcacgcactgaagacacacattcagtattccacgcagacatgtatctctggtgccatctccatccataccattctctgaattcttggaggcgggcacactaacgggactcaaggccacggaagcatgtatagcttaagctttaagcctggcaaagctggacgaatccgagcataacctcggtagtcatttgaactcccagggaaaaagcgcaggagagtcgcagaccagaaccctgctcgtcacgggaggcattggcttcacagcgacgagttaattagtaaagaaggtgcgtgggcgaaagtgcaacatgagggccgcgagtagatgggtatatcaaggtggaaacattgacagggtattcggaggttggtgagacatagttggcggaagttaagggaattcctgtgggcattaactatattgtagaggagatgaagaagaaacatggagcggacataataaaagtgtgggcgaaatagggcagcatgtatagggatattg

SEQ ID NO: 554509 - DNA, 117 bp, Homo sapiens
tattcactcttcagatgtggagtatgaaacgtaaacactggaactccatcttagctcctagaagccagtaagtcacatcattaatacatatagtagtactgagctcttcccacgagg

SEQ ID NO: 554510 - DNA, 740 bp, Homo sapiens
gcagtgcctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagccgcgcaggcaggagccaggacaagtgggagccctgcctcttccaagttggcggggtgggagctcccaggtgcagctgtggctgcccccccaggcacaggacgagggcatctctgcagcctgcaccatcggccatcccaggaaggacagccccttcaccctccatccctgcaggctcaggggtgtctgcttccactgcctggcctctctccactccagcaactgctctgatcttggaggggagtcggagccaagacctgcagccatgaatggcagcaggaggaagggggtggggtccccagtaaggcccaccctcaggccaggagggcctgaattctgggggctggctgccagtccctctgaccagagtggaaactcgtggagcttttctgggctgcaatggcccaatcagcacacacttcttcccgtgaggtcataaaaccctgggctcagcagagcaggcagagatagcagagatgagag

SEQ ID NO: 554511 - DNA, 341 bp, Homo sapiens
catcgccgatttgtacggctttggccacggatagtccggcgcgggatcccgcggtgttggctggggtgagcggaatgctctggagcgctttactgtccagcattgatggtcgccttctctattgcgttgtcggtgagtttccacttggcaagcagggtcttgtaagtgccatccgcgatcagcgcatcgagtgcgtcggccacagcctgttgcaacgccttttccttgaccggcagcgcgatacccgtgaactgcgtcgcgaaagggtcaccgaccggcgcgtaggtgccgggctcgaggtccatcacataaggcagcgtctcgttaccctgcacggcggc

SEQ ID NO: 554512 - DNA, 967 bp, Homo sapiens
  misc_feature (99)..(99): n is a, c, g, or t
  misc_feature (346)..(346): n is a, c, g, or t
  misc_feature (349)..(349): n is a, c, g, or t
  misc_feature (679)..(681): n is a, c, g, or t
  misc_feature (873)..(873): n is a, c, g, or t
cacattcccgacttattttataaatgtaaatttttagtagagacgggttttgcatgttggccattgctggtctcaaactctggacctcaggtgatccgnccgccttagccttccagtgtgctgggattacaggcatgagccacggcacccggcccataatgactttatatactagaggtgttagtgatttgaatgtccccaatttgttttattttcttggtttctgaggaggaagccagtgtagttgagctccttccttttcttttaaattctgtcttctagtctgaccctcttcaggcaggcagtagaacatgccaaggtcctttttgtagtttggtattcgtantanagtctgtgtattttagtcatcacttttacttttttcttgttggttgagctattactatcacaacatactaacatctcatttaacataactcagttttaaagataaatgaagggtcatgcttaggcatacaagatttttattttagccttttttttttttgaggcagaatctcattctgttgcccacactggagtgcagtggcaacagcgtgcagtgagcaatcccggcttactgcagccttgacctcccggctcaggtgattttcccaccttggcttcccaactggctgggactacaggtccatgccactgtgactggctgatttttttnnntttttttttttttccagtacagatggggtttctccaggttgcccaggctggtcttgaacttctgtgctcaggagatcctcctgcctcagccttccaaagtgctgggattacaggtgtgagccaccatgcctggcctatttgagccttttttggtgagagtcttaaagacgtaatatgtcctcctcttttcanatagaccatacttagtagaacttaatgttttattcatgactcagtataattattaatgccctcgcccctagcaatacttgcccatcttttaagg

SEQ ID NO: 554513 - DNA, 271 bp, Homo sapiens
taactcaccacccctgtacactagactagatacttgcttccatgatatttcatgtcacttcaagatgtttagtctagagtttgtaggcctccatcctaccccaacagcaggggtggctggagagcggcggtctccacccagcctacctttaggcaacttggtggtccccggctctccacccaaccccatcaaagacgtctccttcgcatatcccactcgccctgaaaggcctgtgctcaaggggctgacgttacccatacgtcctggtgat

SEQ ID NO: 554514 - DNA, 238 bp, Homo sapiens
atgctgggactacagttcctgcagcgcatcatgcacccggctctcgaactcacgctgcttcccactgccaatcgcctccagtcgggtctcatgacggcgcttggtctcactcagctcctcccggtagatgttcatctggaagtccagctcctctgtcatgatccgcagtatgttctcagcatacgcccatcgcagcatctcatcccaatgttgcataggcgcctcacctagacatgcg

SEQ ID NO: 554515 - DNA, 268 bp, Homo sapiens
cgtcgactagaaccattataccgttagaaaatcatggttttggtgatcgacctttcctgccttttgaagtaggacgtgcacgcgcaaatgccatgacaactttaacctgcttgaaattaaccacatgattaggatgcgggtcagccgttaacgaaccgatatttgctgttctcaatcagctcgctaatcttaacgggctaaaaggccagttgattaacttagcttcaatcctacgacgaacgtaccccagcactataggctgtcgacg

SEQ ID NO: 554516 - DNA, 119 bp, Homo sapiens
ccttgttagtgtcctgggttcccatggactcagggattgttggctaaggtttctctgtgtatatatatatatatatttaaatacacatatatattgtacagaataaaaatgttttattg

SEQ ID NO: 554517 - DNA, 206 bp, Homo sapiens
agccggaagacgaaaatgacagaccccagacgacattaattggggagtaggatgtggctgagtgcttttttttagggccagactagcgaattcagtcctggaagagagtatcatatactgagacccacaggcactgaaagcctatggtagggcaatacgaaggtgacatgaaatgagagaaaaccaagattcccagcatggggcat

SEQ ID NO: 554518 - DNA, 360 bp, Homo sapiens
tagctatgcctgaacatccagtttggtttttatttgcctccttccttaaaaaaaaaaaaatttaaaggccgggcatggtggctcatgcttttaattcccagcactttgggaggctaaggcagaaggatcgcttgagccccaggagttcaagaccagccccaggcaacacagggagacccttgtctaaacagtaacaacaaaaattaaccagacatggcagcatgcacctgtggtcccagctactcaggaggctgaggcaagagcatctcttgagcccagaaggctaaggctgcagtgagctgtgatcacaccattgcactccagccttggtgacaaagaaagaacctgcttcagaaagaa

SEQ ID NO: 554519 - DNA, 1225 bp, Homo sapiens
  misc_feature (186)..(186): n is a, c, g, or t
  misc_feature (200)..(200): n is a, c, g, or t
  misc_feature (483)..(483): n is a, c, g, or t
taccgctgggtgccgcgcccctcccctgcgctgtgtgttgtgggtgtataatatacagcgcggccttatcaacaaccaccatggtgtagtagaagtgatcaccaccttcttgagcgccccctccttaataattgggtgaatatgttcacattgaatcccacccccaacatttatcgccgcagcatntttttatatagggngtgggaacaaccaccccctcatttattattggaggaacattcttccttcggagaaaaagggggaagttttttcccccccccccacacaagtgtttgtgggtgcacaaccaccagcaaaatatgagataaggccctccagaggccctttctttggttgtgtaagaaatcagccggtgtctccgcggccccccccgcgtgttaaatccgtttaatattacaaccgcgggtgttctcttctaaaaggagttttaagttcgccgagagctctcttcgtcgggtttgngcgccgcgaaaattatttcgcgcgccacccgcaagagggtttctcccaagaagattatttcccagcgctttttcaacgcccctcggcgtttttatcctctcccctctcgcccccacctagtgcccccgcgaggagggataagaggcccacactattggcccttgtctctctggagagagtgtgttttaaacccgcgcgaccgcttttatatatactggcgctcttgaccaccagagagagttttttctgtgaagagactcgcgcccctctctatatcccccgcgatgggccctctcaggccacacgctggggatatattctccgcgaagatcttttccccaagacccctcttagagaaccaggccgccacaagcccacatctctttggtgtgtgcctgtgcacatctccacacctgttgaatgaggccctatatggtatatgctcacacagttgggggagaggcccctttgtgtgctggagacacccccacaatcacaccctataattataaggttgaatgacccacccacgaaaactataggagagaaatgggtaaggccctttgtaaaaattgacacacagaagagagggggaaaccccctataaagtgggttggttccacacttgtgtatagtatagttataaggactatggccacaggagatctccaggccacaggatagtccttgtaagagtatttccaaagccagaaatgaagaaattaatctttggctccaccca

SEQ ID NO: 554520 - DNA, 1018 bp, Homo sapiens
  misc_feature (379)..(379): n is a, c, g, or t
gcctgtccgcggtgggatgttgagctgaggcctggaggagaagtagcatgtcgctggtagagcacataggctgctctgggggatgagctggtgcgttaaggaataggccagcactggcatacgtgaagtccatggtgtgggaagggggagagatgccgaggtggtcagtaatcctgactttcagaggccttgtatggtaagtcctgactctatgtgcgtagagtctgatacttcaaaaaagcttcagtggtgtgaggaaacgtcacacggagatgttttagaaatgactcatataatgtccaccacactggatcagggaagctagaaagcaccacctaatgttttttgaaacgtatgtcatcgtatcgtcattcgctgntattctctattgatttgtgcccacaatgttagatccatatttggcgtcgagggaacgctctcttgggggaatagttcaaggattcttggtgaaagctcttgaaatgaggttgatcaagggtaaagtagcgtgtgctgtccagcattgtccttaaggaggtgggtaaaaaattgaactagtcaagattagtcgaaagtacagaatcactggaaagttttgatattttcatttcaccattattgtgaattaattttttctcgtgtttgactagggaagggggtatatgagtaatgaattgaaaaacctcagcgcatagtggaagatttacaaggagcgcattgagtattagtgtggctgtggcgcactgaaaatctcgagatgggaatccggcggggtgaattttgtcaaatactctgggagttacaatgccacgacaagctcctgcttaaaccaaggccttggctaaggtaactttcagatacttttcctcctttgttgacaacagagaagggctggcttagtttattttgcccaaaagtccccttccagggctggaattgcaccacgttacgcatttacctcgtctggcctttattccccccttccatggtcaatacgtggagcattaagcaaagccca

SEQ ID NO: 554521 - DNA, 94 bp, Homo sapiens
catggatttgctggtgcagtacaactaggcttaatagggactcgaattcgaggcattcaggcctgggtaacagagtgagaccctgtcccaaaaa

SEQ ID NO: 554522 - DNA, 146 bp, Homo sapiens
ttagaggatccgtgagatgcgagaaggagcagcagaaccaggagtacaatgatcgtgctgagcgtgaagacgcggctggagcaggagatcgccacctacctgccgcctggtggagggcgaggacgccaacctctccttctcgcagt

SEQ ID NO: 554523 - DNA, 688 bp, Homo sapiens
  misc_feature (600)..(600): n is a, c, g, or t
gccagggtcagggcagatgcaggaaaccaggccaggaagctgtggctgtcatctaagcaagagacagacaatggtgacacagggaggcaagtatacccccaggcctggccacctctccagctctgctcctgacatgaggctcacccagaaggtccttggccatagggtacattggtgccagctgcgtcttcagacaggagaaaaccccagtatgtgtctcaagacagtgagatgtcaagagtcctgctctcttagccctgaattatacaaactggagatttcagccaagaaacaggcagggtctgccccacttacagctcatgtgtctgttttgccgaactaagaaagtgagggcttctctcaatttggatattcatatttctggtttatctgctagctttcctcccagaacttctgaaagcatactctgcttttgggaaacctaagatcacaataaaagtggcagacctctttatccctgtctcacaaataaatggaggcacagaatggggaagtggaggccgagggaacaaagccaactaagactgcagcccggttccctggccacagcactgagggttgaggggtgcctccagtganggctccccatccccgacttggaacacagctcatagtttctgcatgcctatttcatacgcactcttcaattttcctgaattaaaacaac

SEQ ID NO: 554524 - DNA, 387 bp, Homo sapiens
ttttttttaaaaaaaaaagggttttttttctaaaatattgggccacggggcccttttcgggggttgtttttttcgggggttttttgggaaccctttttacccttttcccttccaaaaaaaactcctgggttttaaaaagcccccccttttggggggggatcccccgggttttttttttttcccccccccctttttaaaagggggtttttttggttccccccccttttccggtttttaaaaaaaaaaaaaattctttttgaaagatttttttttaatttttcccccaaggggttggggtttttttgggccccttaaaggggggttttttaaaaaagggggggttttttgggtcccccaaaaaggtccaaaaataaaattttaggaaca

SEQ ID NO: 554525 - DNA, 350 bp, Homo sapiens
ctaacttatggaatctcttctcccttattggcttcagaggaagcatggtgtgcaggtcaagaggaaaggctgcaggctttaaaggcggactttgattctacattatatgaacaagtcatcctggaaaaagaaatgggaacttatttgggcacctttgatgattacttttagttattcctgcagtttggttcatgtgagccttttctcctgtgtttaccctttaccatctgcctttgctgtgttatattacttcatctgaagtatattcagatgccttaaaaatgtgcagggtcttcaatacgtccattctcagaaccttcatccaatcttggtgtgtggcaggtatttct

SEQ ID NO: 554526 - DNA, 916 bp, Homo sapiens
  misc_feature (438)..(438): n is a, c, g, or t
atcacaattaaaataactagagaagcaagagcaaacaaactcaaaagctagcagaaggcaagaaataactaagatcagagcagaactgaaggagatagagacataaaaaccccttcaaaaatcattgaatccagaagctgtttttttgaaaagatcaacaaaatagaccactagccagactaataaagagaaaagagagaagaatcaaatagatgcaataaaaatgataaaggggatatcaccaccgatcccatagaaatacaaactaccatcagaaaataccataaataactctatgcaaataaactagaaaatctagaagacatggataaattcctggacacatacaccctcccaagactaaaccagggagaagttgaatctctgaatagaccaatgacaggttctgaaattgaggcaataattaatagcctaccnaacaaaaataggccaagaccagatggattcacagctgaattctaccagaggtacaaagaggagctggtaccattccttccaaaactatttcaatctgtagaacaaagagggaatcctccctaactcattttatgaggctagcgtcatcctgataccaaagcctggaagagaacacaaaaaaaaagagaatctaaggccaatatccttgatgaccttcgatgcaaaatcctcaataaaatactgggcaaactgaatccagcagcacatcagaaaagttatctggtcatgatcaaagtcgggtttcatccctggggaatgcaagggtggaattccaccattattgcaaattccagtaaacattattccaaccacattaaacagaactaacaggcaaaaaccagttgaatgtctctcagtagatgcggaaaagggctccgagaaattcaaaaggtcttcaaggtaaaaatcctcaataata

SEQ ID NO: 554527 - DNA, 437 bp, Homo sapiens
gtgatctagaggatctccaaacacgcatctggatgtactccaacctcttatcgctggctgaactcacgggaatcaaatggcgtagtaccattttggagggcatggggactgtggacccataatttccgccccagcccaagatgatccaattcatgttaacgtttcaataccggtgatctgcaagctaacctgctttgtgtatggcgtcgtgtatgtcccaccagattgggaagagttatggatattctggtggggagatgaaccctagctagtgggtgtaatacatcatggactgcaggttgtggaagaaggactctgaggaaaatggcctttcctattaatgttggacgctggtcttcaaagcgatccacaatctgttagaaaggtgcctaatgggtaagaacttcgtttggattgggaaatggtttgtccgaccc

SEQ ID NO: 554528 - DNA, 504 bp, Homo sapiens
ccccccccccttaaggaagggccgggggccggacccttccctttttaatttggggccctttccccgccccccccccattgggtttgttttccccttgtttgaggggtggcttgggttgattctttttttttccccgggggggggtttggggggggggggcccaaaattgtttggttccccggggcccccgggccccccccttggggttcccttgccacttttttcttttttttttcccgggcccccaatttcccttttttcctttttaccccccttttaaaaaggggatttcccgggggcccccctttttttaaaaattgggggtttttttgggggggaaattttcccggggtccattttttgggcccgggggttttttttttccacttgggaattccaagcccttttttgggggcctttttttttgggggccccaagggttaagggcccaatttttttgcccctttcctttctttttaccttggggttaaagggtttttccca

SEQ ID NO: 554529 - DNA, 308 bp, Homo sapiens
  misc_feature (252)..(252): n is a, c, g, or t
  misc_feature (272)..(272): n is a, c, g, or t
  misc_feature (287)..(287): n is a, c, g, or t
  misc_feature (299)..(299): n is a, c, g, or t
ctttatcaaccaaattgttttgcctatccaccccatggtgccaaacccatatactctcctatcctcaatacctccctctactacccattactctgttctggatctcaaacatgctttctttactgttcccttgcccccttaatcccagcctctcttcgctttcacttgggactgaccctgacatccatcaagctcagcaaattacctagggctgtactgccggcaaaggtttcccaggacaggcccccattnatttcaggtcaaggcccaantttctttccttcatntgtttacctatnttggggata

SEQ ID NO: 554530 - DNA, 200 bp, Homo sapiens
gtcgctccctgcttcgccgccggctccggacccgagccaagccggagtcaagtgttcctaggaggaccctgttaacaaccaacaaaggcgggacggaggggagtccatgttgggggaaccttgggcagcgggagtgacttgggaccttggggaacctacttgtggggcccgcggccgggaccggagcgccttcgaccctc

SEQ ID NO: 554531 - DNA, 824 bp, Homo sapiens
caagcatgtttgaaagttcaagaagcatacagtgtaacatgtcacttgtgcttttaaaattagtctgtatcaccatttattacagttactaattttggagttcatttttcaaaatcatgttctgtgtcccagagttctttagggttaacacctagggactgcgtccagtgtacctaaggtataacagctgagggtttgtaaagaaaattttgggcaaccatttgtgacttatacatgacaaaccttcattttcacattgtttaactacaggtttccccttaaataggactgggttgcctcctattgttgtttgaaacccctggtagtttggactttttcttcagtttcttttcaaaaccataatatatttggaattccgttaataaccatagaaaacacaggttcataacttggtgggggacatttgtgaggggaacacatgtgacagcaacggggagataaactttcggataactcttgctagcaaaggttttgcgccaccagggggtacacccattttgtggggagccaatggttcccaacctctttatttcttattaggcgaacgggggacaacaaaatcaccttgtcgcccaaacaaataaatatccacattaagctcttccataaggaccccacgtggaaggttccataagatttttatattccgccacaatgtacaaaacagaatgttcttctttaaaaccagatttgtctgcaggggtaaatttcctcaaaattcccctttttcaacaggaaccaaattggcatcttgtggacgggaagaaatccgggggtgcggaactaagagattgacccagtac

SEQ ID NO: 554532 - DNA, 330 bp, Homo sapiens
gcgtcgacatgatactgaacaaggaaaagctgaaagtactttctctaagatctggaacaagaccaggatgcccactttcaccacttttattcaacatagtactggaagtcctagctagagcaattaagcaagagaaagaaagaaagggcattcgagttagaaaggagtcagttacattgtccctgtttgcaaaagacataatcctatatatagaaaactctaaaagctctaccaaaaaactcttagaactaatcaatgaattcagtaaagttgcagaatacaaaatcaatatacaaaaatcagtagtatttctatatatcatcagtcgac

SEQ ID NO: 554533 - DNA, 493 bp, Homo sapiens
ccaaggtcccttaagccgaggagttgagtctgcagtgagctatgatcgcaccactgcattccagaccccatctcgaaaaaaaaaaaaaaaaaaaaaaacaaaaaaaacagaaaaaagcgggttatccatcatttttaagttaaaatcaggtgtaaaaataattaaataattaattaaataaatcccaggttatgagtgtcaggagcgggggagcccttccaggcagccagggagccagtctgggggaaggggtacttgggatagaaaattctctgggctccaacgcctctgttcgggtgtcttcccatttccccggggtctatgtgtggccttctcttcattttccagcaaattccctttggagatatgtgggcctccactgggttgaccaagggggtgaaggagggtggcctcggggggccactatggcgggggaaacagttaacccctgcgggccagggggaccttgggggtgccaagaaaccctagaggg

SEQ ID NO: 554534 - DNA, 566 bp, Homo sapiens
ggtcgcagatcagccattcttgtcttatggggtcccagctggcgcaccaaaaaaaaaaaaaaaaaaaaaaaaaaaatttttggccggcccggccccaaaaaagtttttaaaaccattcctgggggccggggccccaggtagggtacggtggacatgggacaaaagcgaggtcccagacagaaaacgccggggcacagaaactagtggggatggagattctctccaaccaattataaaaaagacgcgcccgggggacaccagagacgtttctggacgaactcccagagaatgagagctcagagagggagcataacaaggggggcaccttataaacaacagaggaggcacaaggaggaggtccggaatattcaaatataccgcccccgagccgggagaaaaaaaagaagaaagcaacacgaaagaaggcaaaacagataggagaacgagagaaatagagaacgaagagacacagcagcagaaagaaaaaacacgaaacaaaccaaacaaacagcaaagagaggaagaagacacaacaatgagaatagaaaagagacacgaaaaaacac

SEQ ID NO: 554535 - DNA, 205 bp, Homo sapiens
gcctggcttccccagatagtgtcctgggacatggtatgctttggggctggggtagcatggaatccctctgagggacctgggtactggtactacggggttgggaagaggaaccttaaacttggctttcccagccttcaagcctaggcttggcatgttctaggtcccagtcctttaggccttagggctgcaaaggttagagttgact

SEQ ID NO: 554536 - DNA, 435 bp, Homo sapiens
gggagatacagggggggcagaaggcaaggggggagcgggtgtatcacagggggagagcaggaacaagagaggggagaaggggccacacttttaaacagccagatctcactacaactcatttactattacaaagacagaaccaagctattcatgagtgatctcgccggtgatccaaacacctcccaccaggcctcacctccaacacggggggactacatttcaattggagaattggaagacaaatatccaaaccacatcaggtaagttaaataaacattttggtcatattctctataagagtctgaaccaagggtatatagaacatcaaaaagtgggcggggggcaggggctcacaccggtaatcccagcaattggggaggcggaggcaggcagaccacgaggtcaggagatcaagaccatccgggctaacatggg

SEQ ID NO: 554537 - DNA, 127 bp, Homo sapiens
gaagtgcccatgatagcccggcaccaagggcaggccaggcagcgatgggcccaagggggagaagggggaccctggccttgaggggccccgcggcctggctggagaggttggcgaagaaaggagccaa

SEQ ID NO: 554538 - DNA, 849 bp, Homo sapiens
gggacccggtgtctgcttcctgttgccttcgcctcctaattcctacaccactatgcgtgagtgcatctccatccacgctggccagggcgttggttgtctcagagtggctggatgcctgctggcgagctctactgtcctggtaacactgggcatccagtccgcgatgcgccagaatgcctaagtgagcaacgaccattgggtggaggagcatgatctcccttcatactatctttcttcatggagacggcgcgcgtggccacagccacgtgccccaggagctgtgtttgtgagacttggaggcccaactagctcattggatgcaaagttcgcactggcatctcatcgccagtttcttccaccctgagctaggtccatcacaggctcaggaagatgctgtcaataatttatgcccgagggcaacataacgactccgattggcaaggagatcgattgacccttgtgttgggccccgaacttctggaacgcttggttgagcatgtgcaccggtcttccagtggcttccgttgagtctttccacaagctttgggtgggggcgaactggattcttgggtttcacctctccctgctcataggaacggctctcagttgatgatggccgaagaagtccagagctggagtgtctccattgacccaggcacccgaggtttgccacaggtgtagttgagccctaaaaatacagtcgctcagcacccaacgcaaaactggaagcactctggattgtgccgttcactggggtagacaatgaggccttctatgacagtctgttgtaaaaacgtggatatgagcgccatactagataggcttaacgggcgtattagcagcgtgtgc

SEQ ID NO: 554539 - DNA, 404 bp, Homo sapiens
tcacaatgactaacttattaactccttaaatgcttgtggatgaaacaaattttcctaaccttttagaagtaagccaagtcagtagctaactggttactactgactgactgactagagttacaagaagttttatttatttatttatttttgagacacagtctcactctgtcccctaggctggagtgcaatggtgcgatttcggctcactgcaacctctgcctcccaggttcaagcaattctccagcctcagcttctcgagtagctgggattacgggcacctgccaccaagcccagctaatttttgtatttttagtacagacagggatccacctgccttggcctcctaaagtgctgggattacaggggtcagccaccacaccccgcttgatgttctgttgtgagca

SEQ ID NO: 554540 - DNA, 393 bp, Homo sapiens
ctaaaagggctgtccggggctggaaccgcctggcgggccccacgtatcggggtgtttacggcaccaacctcctgcgccacgccaaggttgtttgggaaatgctcaagttttaaatggcgctcaggctggaaaccttggccatgcggctgaccgccctcctgggttgtgttttggtcccccttaaccttgtgcccccaacggaggagctttaccagtacctggaaacctagggtgcaaccccccagggccggcggggcccttttccccttgggcttacggaggtggcggggctaaaggtgtaaacccccccagccccgtgggccctccccctggggggcttttacaacaactgggccaggaggccgtgtaatgacccccccctcctttcaaaca

SEQ ID NO: 554541 - DNA, 1425 bp, Homo sapiens
  misc_feature (432)..(434): n is a, c, g, or t
  misc_feature (446)..(446): n is a, c, g, or t
  misc_feature (456)..(456): n is a, c, g, or t
  misc_feature (472)..(472): n is a, c, g, or t
  misc_feature (475)..(475): n is a, c, g, or t
  misc_feature (480)..(480): n is a, c, g, or t
  misc_feature (680)..(680): n is a, c, g, or t
cgggtcgacgtgcgctcctctctggtctcgagtcaccaggaccagatcgaggatgcggccgacccctgcccgatgtggaaagcgaagtctccacctcgtgattgggtctctgctgtcagagagcttcacgagcttgaggggaaacagacagagaggtctgggcattgggcagtttcccgcctcccagccccgcgcactgaacagactgtgaccagaactgcgaacaaagcgcggagggaagctcttaaaggaggccaaagcggccgggcgctgtggctcacacctgtaaccccagcctgtaagcctagctactcgggaggccgaggcagaaggagcgcttgaagccaggagttggaagctgcagtaatccgtgatcggaccgttgcactctagcctgggcaacataacgtcctttgaaaaaaaaaaaaaaannnagaggccaaaangggtagcagnggtgcccgggcaccanggntgganggcctctctgaggaggtgatgccgagctgaagctgggaagcggatgtgagggaagagttccaggcagagggaaggcaaatgcagagatcctcaggcaggaacactgaactgttctccgtatttgaggagcagagggcgtgtcagtggtggccgcagcagctgagcaaaggtcttagaatcccagctaatgtcgtgggacntagcacccaatcccaaaagaaagaagaatagataggaacccactgttgacaagaaggtgcactgagaagtgtttttatctgacccgatctgcatccagtttagaagccgatacatcagggatttaacaatctgtcttaatgtctagcaaggggggttgctggagggaaaacacagagtcagagttctatcttcagccctgccagcaggtccctgggagatgctagacgagtgacttttctctgggcgtggttggtgtaagggatgcacacgcaggaggaaggtcggagtgtaaatgtgtgacctgggcctgttactgggtataaatgggcctgtagtgaccgggagctcatgttctaccaaaggggttgccaattttctgatttcgagtgtggcggtgtaaaagagaaaagcaactgctgccagctggggagctggtttgcaccctccactccagaagccttgatgttgctaagagctgacctggcacaacagcacgcatggtggtgtctggtgagcaacataattcccaaacacctccgaaaaggtcgttctctgacggttctaaaaaagaccatttcttataaaacgtcatacggaacacagacattgtgccaccccatatttcaccatttctcccccagggggggggggatggcgcttgcttcccactccctccgtgagggtctcgcacttcagatggttagggccctcgcccctctttttaacggacacccgccgtcctgg

SEQ ID NO: 554542 - DNA, 831 bp, Homo sapiens
agaaggaggtggaggcggcggctgtgcgttgcagcggctggcgtgcgatagctggctgggagccctgagtgcggcatgctgctcgctggcccatcgtggggcccgatgctgtgcgcctcggctcggagcccggaccgggctgtgggtgcgccgacgtgcctcagcctgcctttcgcgatggcgaggcgggagtgagcatgaaatggcttagggcccagggtggcggtgaagtgggggcctggtgccctggatccgtgcgggggagggcggagcctggatgtgcctggaccgtggcttcgcgcttgtcccctgggacgcggatcgaacgttggctggcgcggatcgtacgtcggcggccggtggaacgcgggagctgggcggcgcgcggactgtgggcccatggcgtctgtgcaggcgtcccgccgccagtggtgctacctgttgcgacctgcccaagatgccgtgggccatggtgtgggacttcagcgaggccgtgtgtcgcggctgcgtgaacttcgagggcgcggaccgcatcgaacttgctcatcgaattgccgccgccagctcaagcgcagccacgttgctcccctgatgtggcctgttctgccctgggcccccggccctttaatgcaacccgggcaccaagggaccttggcgtgcggcaagccggacatggggcccccaagcttgcctggcccgcggaagtggccagcccccaggcctgtcagggaacctggctggcgggcggttgtcgaggccaagggaaccggctattgacgagtggccacattcagtcatggcctggctcccccttgcacttcgccggccctg

SEQ ID NO: 554543 - DNA, 318 bp, Homo sapiens
caccatcgctgcctccgttcactatcgtcatgcatcgcttacacaatgggaatatgttctgacaaacctgtcattaggtaatttcattgttgtgcaacaccatacagtgtacttagaaaaaccttgatgatatatcctactacacaactaggctatgtggtatggcctatcactgctaggctacaaaccagcacgttactgtcactgaacttctgttggccactgtgaaacagaggtattagggtatctaaacaatagacaatggtacagtaaacatacagtagaataatcttataggaccacctatcgaataagagg

SEQ ID NO: 554544 - DNA, 1310 bp, Homo sapiens
gcgagagatccaggggcaccgagctactgagttgttcctacaatgactatgaagccctgattccgtggagtacgctgtctatatgtaacagataaatgtctctggtactcctacatgacaaggacctaataggaactaatactcttagcattgctatagaagcaagaattgctcatcgtggttgatctgtaactcaagcatcggtccacaactagggccacaggcgacagtattatcgttcgctttcgcgcgtgaaagatgaagaacgtcaagggctctctagagaggatgggtatccttgcagcaactctactcagagctccaggggaccaggactccagtggagaacgtctaattgcgcagaggctctcccgtggccaatgattgaaccagggtcccaccagttatacctagtcctgccctaatttactatagaaatcgaactcaacgaaacagcatgagctacgaaacacatgagactgcaccactttgggactgaccacgtcgccacaccatagaaacactgtacacatagacataggccttgccaatgcgaatagcgaacgtcggatttccaactttaaaagacagtgcataagactcgtccagaagaacctctgaaagaggcacaaagcaatcacttgcaaggaatgaacccgagtccttacaaaggcgaccaccgaagatgcgaaggcaaagtggccgttggttagatctgtactcatcgacacaccaggttgcgaaagggaacaccaccaagatctgggaaactcggctgtgagtccacgaaaagcggcactagatttgggcatatagaccaagttgaggacgcaatagcctgcctttgtattcaaccaaacgttagataatctgctgttctgcggggaagttacggctacaacaactgtggagcttgtgccattggtaaccaattatgagtatggacgacacagaaaccaccgctatgctaggtggtgtggaatatttcgtctcccgaatagttgggagtccctccatggaagaaccccaaagaaggaccacctcaagagcgaagtacgttatgaaaagccgccctagtaaagcagaggtgggcccgaagattaaagagcatagggggcgataatgtgagtaaacgcccccggaggagggaggcacagtgacgtttaatgggtttcggactgtgcctcaacctttgcatacaattagagaaggcaccgggttgccagcggagggggaagaccgatggggaaccttactatgtagacgaaacttaggttcaaatctgagcatcgcagctggtcaataaccca

SEQ ID NO: 554545 - DNA, 694 bp, Homo sapiens
  misc_feature (31)..(31): n is a, c, g, or t
  misc_feature (64)..(64): n is a, c, g, or t
  misc_feature (84)..(84): n is a, c, g, or t
  misc_feature (117)..(117): n is a, c, g, or t
  misc_feature (163)..(163): n is a, c, g, or t
  misc_feature (165)..(165): n is a, c, g, or t
  misc_feature (187)..(187): n is a, c, g, or t
  misc_feature (208)..(208): n is a, c, g, or t
  misc_feature (219)..(219): n is a, c, g, or t
  misc_feature (235)..(235): n is a, c, g, or t
  misc_feature (240)..(240): n is a, c, g, or t
  misc_feature (273)..(273): n is a, c, g, or t
  misc_feature (351)..(351): n is a, c, g, or t
  misc_feature (432)..(432): n is a, c, g, or t
  misc_feature (629)..(629): n is a, c, g, or t
  misc_feature (632)..(632): n is a, c, g, or t
  misc_feature (670)..(670): n is a, c, g, or t
ctgggagcagggccctcagtgacgttggcanttgtctggaacagcaatttggaaccctattctntggagggcagggcaggggtnccgctcgcacgggggcggccatcagagggtatnggtgtaaacacgcagacacactcaaggcacggtagtcattttttangnggtttgggggggggcttgctgntcaggatctgacagttttttntattttttttntaaaaagttttctagntttgnagttttttttttttcttttctttcatttttttnaaaagctacgagaatgagcaggtggactgtggtttccaggaatggtggcgtctcacgcttcttgtgctttttcctttngggcctccgatcggctggggttgggggactgggcaggaggctccctgtaaacatttggacttgggctggggcaggggctgntgttgggcaaagctgggggtccaggctggaaaagcaggggcccctccagacgcagccttggggagactcagcatgtgcccccctcccctcatcacagaacaagacaatggttaaaaaccagaacagatgcccagaagggggtacatggccattaccagcatctcagacaagggcaggcttcaaacagggagggctgntgnaacccctcccctacgtctggagctgaggggacaggggngctgagaaaaagagaggaaaaaga

SEQ ID NO: 554546 - DNA, 495 bp, Homo sapiens
  misc_feature (59)..(60): n is a, c, g, or t
  misc_feature (357)..(357): n is a, c, g, or t
  misc_feature (383)..(383): n is a, c, g, or t
  misc_feature (428)..(428): n is a, c, g, or t
  misc_feature (473)..(473): n is a, c, g, or t
  misc_feature (481)..(481): n is a, c, g, or t
gcagacaccccactgtcgccgctggcaagccctctcctccccaccagactgccagacgnntacatcattctgcccacagacctgcgctgccacagccatcgccatccattgcatcccaccgacagaatgctgctcctagtgatctggactcacctcggaggtatttgggctggccacagtccctggacagtgatccagacagctggccgccccccaagggatttgtcaccttcagcgagacctatttcctccccacccccagaaaccttttgtgtttttgcctaggcccaggtgttcctggcagccaaatcgagtctttcatttttttttgtgggccagttagttttgcccataacncagtattttgagtttgcaactgtctntttgatgtgggccttttgttcaacccagtaacccctgcattttgntttgctttaaaaccctacctggagaaagtcttttccttattttcnataaatgnccggcctttttgga

SEQ ID NO: 554547 - DNA, 1166 bp, Homo sapiens
agtttatgcaagcatgcccggaaagcaggattggttattcctccagaaaacatcggcaccgttccatacatctggcctgtacagctgggtatatttgcatgcctatgttcctccatgagggtgatgcacgcatatccatctctttcaaaggagggactgatagcagagacactgacacgcaatgcacagcacagcactatggcaatccaccacagtgtccaatcccggcaggcatcacacacagcactcatgcatgcccacactttcaacacatacacaggcaacttccccctggaaacacaagctcacaggcatcatctatatcattggcacagctcgacgctatatgtctcacaagtcacactcccagcaaccaattggaccgggcactatcagataacccataatgagataaaccgttgaacaaccacgctcgtattatcacaaggcaccatagcaacttatgcggaaccattcaaacaagtactaaaagaacccgttcacgggcatgcgcagacgatatatgaatggggacatctgtatcagataagacacgcatcatacaagtgaatatgatttacaaaggatttacggacacatgatatccaaatgaataagtgcagtgaagaccccaatgtggacacaccgagtgattaacagggccacaatgcacttcaacacctgggtaacggacaatggcacaccaaaccgcgagggcaaagaaacatcattgggcacaagttcgatatattgaacaccgaggtttatgggaccgggatatggatttggataaatgtggacccaacgaggcacaggcaatgaataacgcacagacaaagagaacatggttccactgggacacagcttaactaaggtacagggataatgtcaacccggaccaaacaacggaccacacagggatctagggaacaaacacaaaagcgccacacgtgcactggcggcacaacgtgccatggggaaacgtaccaatagggcaagttaacagccaacgaccgcactacacgaagacaccccccactcaatggagaggagcaacacacccacagatcttaaaagaggaccaaggaggaccacatacactgagttgacaaggaaacacagggtcgacagtgcaactcaccaccttgaggaggagccgtaacacg

SEQ ID NO: 554548 - DNA, 496 bp, Homo sapiens
  misc_feature (144)..(144): n is a, c, g, or t
  misc_feature (290)..(290): n is a, c, g, or t
tgtatctatcacatatcccagcagaacttctgttcaaaacatgttccattggacccaggctgttaagtttgggaaattcacagcttatgcctggggaagcccagttcagaaaaggatgccctatgatcagtcccaacccccttntacaatgtgacaaccatgaatgtaccaattccagtgtggaacggtggcaaggacctgttggctgacccccaaaatgttggccttttgcttccaaaactccccaattttatttaccacaaggaaattcctttttacaatcacttggnctttatttgggcaatggaagcccctcgaagtttacaaagacattgtttttatgaaatcaaaaaaaaaaaagtagttttggatttaaaaaattacccgtttgtttttccaaaaaactttattctttcaaacaaaggattttcaaaatgtttgacaagcagggcttctttctgtaattttgactttaaaaaaaaattggcctccccca

SEQ ID NO: 554549 - DNA, 301 bp, Homo sapiens
cccaaaaaaaaaggaattttccccactcataggtattggaggggcacaaccccttgctggggttgcctttaaaaagttttttttgatattccttatggaacagaattccctcagagcccattttaaaagcatatgggaaaaataattattcttgctggcctttatgcaaaaaatcaggccaaggataagactaaagttttttttgccacccatcctattatgatttgtttttaacaaaaaagaagactggagagtttcaaaacttatccccccggtccttaaattttagtttttttagtta

SEQ ID NO: 554550 - DNA, 648 bp, Homo sapiens
gggacgctccgagaggtgccgggcgtggccagagtcgcctttcccactgccccgcctccagccagccctgcccgaactcgcagacatctcagtgcgcagacgactgccctcgccaggccgcgccgccctgctcgctcaccccgcccgcgctgaccccagccccagcaaggagtccgacaacggcatcgaccaacggggatcgggagctactaccatgtcgcacggtgtggcagtgaatggtgcgattctgtctgaccagagcctcagggaaatccccaccgacgacaagggcttcactgccatccacttcgccgcccaatggggcaagcttgcatgcctgcaggtcctggtagaggagtacaagtttcccgtgacctgctgaccaacaaatagccagacacccctgcacctcgtccatccacagggacaacaccaccgtggcctcccctgcatctactaacctgctggacgaaaggggccagacctcgacagctcagacatgcaatcggtccacggcccctgcacctggagcccgtgacggtttggatggacctgtgtgaacggtcctggtgcagagttggcgccaaagtcgcatgcccacgatgccatgggctaaaacccattgacttctgcacaattatggaacac

SEQ ID NO: 554551 - DNA, 1000 bp, Homo sapiens
gatgtggctgggggctgcggggggaggatgcggaggggtttctgtgcaggacggcagctctcagagaggagtacgcgagtgtggtgggagtggagggccggccacgcggttggacacgagcgagggtgccaggctgacccgaagaccgtcaccacccgacagctacgcatgtgcctttgaccttgatttggagcttttctcccttttgcatttcggtgctacagacttgagacaccagctagaagttgtgttcagcccggccccgctgcgcctgtccgtggccggggtctggcgccggttgtgttggtgtccagccttgccttctttgcagccaagcagttcttggtggagctggagtgcggacattagctgctgcgccccaggggtcttcacaggattcacggatgactttctcttcttacacatggtttcctctcgcgcatgagcccggtgttgtgggggaggtctgtagtgcgggttctcaatcgcaggaatccattcccgtgggaggttctccgcgtggggcatggggaattggggcatgagcccgttcgtaaggttcgcctccatttaccgacgttattcttcccaggaagggaaaaggctcctcgggacttttcgccatggggtatacccgccgccagtgaaagcgggggatgtggaccccaatatgggtgcccttttaaaagagtgccggaataaacgcggggggggggggggagcactttttgggggggacagggtgggtccccccccccccgctgctgcagaatgggggggggtatttaaatcgcgccaaggagggggggagagaggatatctatttcatatgggggtccgccccccacagttttttttcgcacggatattttcttaattttccccccccccgaagaaagagcaggggggagggagggtgggccacacataaggggcggggggggagaaacacaagctttcttttggggacatgggttttaagatagagcgcaccccacaa

SEQ ID NO: 554552 - DNA, 233 bp, Homo sapiens
tggaacttctggggcataggtttatgaacatgagggcgatttctcgcgtgagggaggtttttatgttgctaatgcgacccaccgagggagcccaattgtgtcggggaaaacatgtagagggagtatagggctgcgactagtatgttgagtcctcgaagcaggagagtgatatttgatcaggagaacggggctactagcacagagagctctcccagtaggttaatagcggctga

SEQ ID NO: 554553 - DNA, 104 bp, Homo sapiens
ggtgccctagattatccgtatacacccacactgaatttaatggaggtagtgcttttcttatactggggagtgtggtatagggtagtatagcctcggtggtatag

SEQ ID NO: 554554 - DNA, 595 bp, Homo sapiens
  misc_feature (4)..(4): n is a, c, g, or t
  misc_feature (22)..(23): n is a, c, g, or t
  misc_feature (25)..(25): n is a, c, g, or t
  misc_feature (32)..(32): n is a, c, g, or t
  misc_feature (34)..(34): n is a, c, g, or t
  misc_feature (49)..(50): n is a, c, g, or t
  misc_feature (56)..(56): n is a, c, g, or t
  misc_feature (93)..(93): n is a, c, g, or t
  misc_feature (106)..(106): n is a, c, g, or t
  misc_feature (117)..(117): n is a, c, g, or t
  misc_feature (128)..(128): n is a, c, g, or t
  misc_feature (135)..(135): n is a, c, g, or t
  misc_feature (140)..(140): n is a, c, g, or t
  misc_feature (144)..(144): n is a, c, g, or t
  misc_feature (162)..(162): n is a, c, g, or t
  misc_feature (167)..(167): n is a, c, g, or t
  misc_feature (187)..(187): n is a, c, g, or t
  misc_feature (198)..(199): n is a, c, g, or t
  misc_feature (201)..(202): n is a, c, g, or t
  misc_feature (215)..(215): n is a, c, g, or t
  misc_feature (229)..(229): n is a, c, g, or t
  misc_feature (250)..(250): n is a, c, g, or t
  misc_feature (253)..(253): n is a, c, g, or t
  misc_feature (263)..(263): n is a, c, g, or t
  misc_feature (265)..(265): n is a, c, g, or t
  misc_feature (274)..(274): n is a, c, g, or t
  misc_feature (322)..(322): n is a, c, g, or t
  misc_feature (359)..(359): n is a, c, g, or t
  misc_feature (368)..(368): n is a, c, g, or t
  misc_feature (390)..(390): n is a, c, g, or t
  misc_feature (398)..(399): n is a, c, g, or t
  misc_feature (401)..(401): n is a, c, g, or t
  misc_feature (405)..(405): n is a, c, g, or t
  misc_feature (432)..(432): n is a, c, g, or t
  misc_feature (435)..(435): n is a, c, g, or t
  misc_feature (447)..(447): n is a, c, g, or t
  misc_feature (449)..(449): n is a, c, g, or t
  misc_feature (453)..(453): n is a, c, g, or t
  misc_feature (457)..(457): n is a, c, g, or t
  misc_feature (471)..(471): n is a, c, g, or t
  misc_feature (477)..(477): n is a, c, g, or t
  misc_feature (483)..(483): n is a, c, g, or t
  misc_feature (494)..(494): n is a, c, g, or t
  misc_feature (502)..(502): n is a, c, g, or t
  misc_feature (512)..(512): n is a, c, g, or t
  misc_feature (521)..(521): n is a, c, g, or t
  misc_feature (533)..(533): n is a, c, g, or t
  misc_feature (541)..(541): n is a, c, g, or t
tcanttaaattttttaatgggnntnaaaattntntgaaaaatttttggnnaagttntttccattaaaaagtactgattttaaaaaaaaaaaanttaaaactgccanacgcaaaaaanaaaaccaaagngggccanaaaanattntcctttccttctgaaggntttangatgcatttttataattaancagttttttannannaaacttaaatggncaattgaaaaaaanagttctgagaccgttcttccnccnctgattaagngnggggggggngggattaggggtaatattcatttagccttctgggctttctggggaganttggggaccttgccagccccagcagccttcttgtccnctgctttgntgaaacccaccgcaactgtttnttttaaannangaanagcaaagcgacccaaaggggggtagtntgngaagccctcaananaaangggntttccagggaccanataaanaatggnagcctcaccanatttcaanaatttagggncatcttccngctttttaccanaacggggntcaatcttttccttcagcccagcaaacttgcatgcaatgggggcggggggggaa

SEQ ID NO: 554555 - DNA, 266 bp, Homo sapiens
cccattccatcgtcgccggcgtcagcgccaccggcgacgccgatggctggctcatcctgccggccgacatgcccctggtgcagcccgcgaccatcatggccgtggcggcaggcctggagcgctatcccgtctgctacgcccagtaccgcggcatccagggccatccggtgggctttggcaccgagctgtattccgagctgatggccttgcagggcgacgagggcgcgcggcgcatcgtggcgcgctacgcggcccagccgattgcc

SEQ ID NO: 554556 - DNA, 327 bp, Homo sapiens
gcatgcacctgcatgctgctggtcaactctacgagatcccctgcggaacccctatcatacgaagggcaatgcttttagattaaaatgaatgtactttacagcttatagtctagtttaaaagttgtaggtaattaatcataatttcgaagtgcgatcttgttaaaacagataaatttataactttaaaagtatggaagcagatatataaaaagacaagctagtgacacaaatatgctaaggtgccttatgtacgacacttccgaagacaaattggaagatagataaccagatatgcaaaatgactattttgtcgatcagtttcagtat

SEQ ID NO: 554557 - DNA, 714 bp, Homo sapiens
catttccgcgcagcactccctaagcttgatcctttaggaaggtctaagccaggcctcagggtgacgggatcaggacttgaggggtggacaaggtggccctaagtagtggcttccagaccccgtagccccacgacctcaccaggtgcccgccatgagggaccctcaggtggcaggtgaccccgtcactagtatcaagacatcttctcctgctgagcagaaggctatcatcccgtgcaacgtacctcttcccgacgtctgttctcccctggtaccttcgaagaacctctgtacctctccgtcctcctcctcgcctcctgccagtgcagtggccttggtcttgggaaactgaagggagtataggtctggcccccagggtggggctctcctttccctcatccccagccccgccgtcagcactggctctctctgtgaggttcgatactttgttaccgccgcctctgtcctctgtgccattggtacctgggcataagtctaggaggtaggaaacagcacaactcacagtttgagactggggggtggtcttggcaaggcatcctgtctgtacccctccctaaccttctcagaagaggtgcacagcctctcgggtgacgttggaaactcgcatggtacgaaattccattctaacttattttgacatgatacaaacacaacgtgttagagattcacttgtgcaaaccctactgttacatcatg

SEQ ID NO: 554558 - DNA, 582 bp, Homo sapiens
  misc_feature (29)..(29): n is a, c, g, or t
  misc_feature (65)..(65): n is a, c, g, or t
  misc_feature (81)..(81): n is a, c, g, or t
  misc_feature (83)..(83): n is a, c, g, or t
  misc_feature (99)..(99): n is a, c, g, or t
  misc_feature (105)..(105): n is a, c, g, or t
  misc_feature (123)..(123): n is a, c, g, or t
  misc_feature (136)..(136): n is a, c, g, or t
  misc_feature (140)..(140): n is a, c, g, or t
  misc_feature (143)..(143): n is a, c, g, or t
  misc_feature (148)..(148): n is a, c, g, or t
  misc_feature (170)..(170): n is a, c, g, or t
  misc_feature (173)..(173): n is a, c, g, or t
  misc_feature (175)..(175): n is a, c, g, or t
  misc_feature (198)..(198): n is a, c, g, or t
  misc_feature (200)..(200): n is a, c, g, or t
  misc_feature (311)..(311): n is a, c, g, or t
  misc_feature (346)..(346): n is a, c, g, or t
  misc_feature (455)..(456): n is a, c, g, or t
  misc_feature (461)..(463): n is a, c, g, or t
  misc_feature (468)..(468): n is a, c, g, or t
  misc_feature (488)..(488): n is a, c, g, or t
  misc_feature (502)..(502): n is a, c, g, or t
  misc_feature (577)..(577): n is a, c, g, or t
cgtttttcagtgcagtaacattgaggttntccttgtttcctttattcagacagttctgcaaactngggaataaataagggngngggcacacaggggctngggggnggggcgggtgggggtgangggggttgggggngggnggnggggnggggggtggccctggtcctggnggngncgggactcaaggtggctcctggncngggggtgcagtggggggtgcgtgggggcgtccgctctatggtctcctcagtggtctattttaggtgtgggttttttttttttttttactgctaaacttttttacctcatantaaaaagtaactagtcaaaatttagaacattctgntcaaaatgggtctgcacatgcctttcaaacacctgctggtcatagtcagggggggcctgctcgctgcccctcgggccccccttcccgtgcctttccccctgttcttccnntttgnnntggtnatggttgggggggaacattnactcacaggggggncacttcttgtgaacatcaaagctggaatcaaagcaaaagcctgtcccatgcccacgtaaatgttgccttgggggntcagg

SEQ ID NO: 554559 - DNA, 347 bp, Homo sapiens
cacgttactagtgatggaggcgcgcctgggcatcgaagactttatcgtgcgcaaggccagcgcaatgatgggcgtgggctttacggtgctgccaatgatgtactgcgaagaggaactggccagcggccggctggtgcaattgccaccgcagtggtcattgccaggcggctggcttgcaggctggtctacccgcaccggcgcggcgtgctgccggccatccgggcctggatcgactatctggaagaaggcttcaaaggctgtggagatcggctgttatgagcatgacggaagaacaagtcgcacgtttctgcctgagcctgccaggcgcacgggaagactataaatgg

SEQ ID NO: 554560 - DNA, 411 bp, Homo sapiens
gtcacaaaaaacaacaacaaaattttttaaaaaataaagttagaagaagtaagttctagtatttgataatacagtagaaaaattataatgaacaataatttattgtatatctcaaaataactaaaagaggccaggcatagtggctcacacctgtaatcccagcactttgggaggccgaggctggcagatcacgaggtcagtggatcgaggccatcctggctaacacagtgaaaccccgtctctactaaaaatacaaaaaaattagccaggcatggtggcgggtgcctgcagtcccagctactcgggaggctgaggcgggagaatggcgagaacccgggaggcggactttcagtgagccgagatccagccactgcactccagcctgggcgacagagcaagactccgtctcag

SEQ ID NO: 554561 - DNA, 790 bp, Homo sapiens
  misc_feature (74)..(74): n is a, c, g, or t
  misc_feature (89)..(89): n is a, c, g, or t
  misc_feature (91)..(91): n is a, c, g, or t
  misc_feature (93)..(93): n is a, c, g, or t
  misc_feature (121)..(121): n is a, c, g, or t
  misc_feature (135)..(135): n is a, c, g, or t
  misc_feature (137)..(137): n is a, c, g, or t
  misc_feature (147)..(147): n is a, c, g, or t
  misc_feature (159)..(159): n is a, c, g, or t
  misc_feature (167)..(168): n is a, c, g, or t
  misc_feature (191)..(191): n is a, c, g, or t
  misc_feature (204)..(204): n is a, c, g, or t
  misc_feature (209)..(209): n is a, c, g, or t
  misc_feature (216)..(217): n is a, c, g, or t
  misc_feature (224)..(224): n is a, c, g, or t
  misc_feature (230)..(230): n is a, c, g, or t
  misc_feature (254)..(254): n is a, c, g, or t
  misc_feature (259)..(259): n is a, c, g, or t
  misc_feature (267)..(267): n is a, c, g, or t
  misc_feature (272)..(272): n is a, c, g, or t
  misc_feature (285)..(285): n is a, c, g, or t
  misc_feature (287)..(287): n is a, c, g, or t
  misc_feature (308)..(308): n is a, c, g, or t
  misc_feature (318)..(318): n is a, c, g, or t
  misc_feature (331)..(331): n is a, c, g, or t
  misc_feature (344)..(344): n is a, c, g, or t
  misc_feature (421)..(421): n is a, c, g, or t
  misc_feature (423)..(423): n is a, c, g, or t
  misc_feature (458)..(458): n is a, c, g, or t
  misc_feature (467)..(467): n is a, c, g, or t
  misc_feature (471)..(471): n is a, c, g, or t
  misc_feature (507)..(507): n is a, c, g, or t
  misc_feature (610)..(610): n is a, c, g, or t
  misc_feature (620)..(620): n is a, c, g, or t
  misc_feature (685)..(685): n is a, c, g, or t
  misc_feature (701)..(701): n is a, c, g, or t
  misc_feature (703)..(703): n is a, c, g, or t
  misc_feature (709)..(709): n is a, c, g, or t
  misc_feature (748)..(748): n is a, c, g, or t
accgcggcggtagtaggaggcgggagaaggtccgtagccgcgccgccctgccccgccatgggcctcctgtcggncccggttcgccggcncncncacgcccgcctagtgctgcgcctcaacncgccgttatgcgtncngaactacgtngcgggcatcgcntggatctnngcgctggttttcccgccgctganccagcgcacttanatgtnggaaaannccatggnctccancatggtggaggagcagtatgcagncaganaccgtacncgganttttacccgggantncaccgcccaccgcaagaagtngggggctctnccagtagcctggnttgaacggacgangcggtcagtagggctggaggtctacacgcagagtttctcccggaaactgcccttcccagaagaaacccacgaacacnanatggtgtcgggcaccaacgtgtacggcatcctgcnggccccgcntgcngccagcccgagtcgcttgtactcaccgtgccctgtngctctgactctaccaacagccaggctgtggggctgctgctggcactggctgcccacttccgggggcagatttattgggccaaagaaatcgtcttcctggtaanaaaacaagancttctgggcactgaggcttggattgaagcctaccacgatgtcaatgtcactggcatgcagtcgtntccctgcagggccgancnggggcnattaaagcagccgtggccctggagctgagcagtgatgtngtcccagcctcgatgtggccgtggaggggcttaacgggcagc

SEQ ID NO: 554562 - DNA, 223 bp, Homo sapiens
gagattgaaatggattgtcagaaaaggaaaatcactaaatggctatggtggctactaatgaaaaaggcaagtggcttggccagtagttaaaatagtagaccagcaacttttatatccagagttttatgtggcacatacaattttcttttcataggtcttctgattctgggtacaggggtatcatctggtaggtccgggtggtaatcactataggaatattctc

SEQ ID NO: 554563 - DNA, 827 bp, Homo sapiens
gaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgtggccctggtggcatgtgagcctgcggcgggaggagaaggagggcagcggagggggcaccctgcacagctaccgcgtcatcgtgctggaccacgcagctccggacactccgtggtaccatctcggaggacgcgctgccgcggggccccacggggtctgtccccaaggaaacttctggagcactgtggcgccgcagactgagccccagctgcctgcgcctgggctcagcttcacccaaggtaccacaggacgctgctcacactggatgagcaagtgctgagcttccaacgcaaggtgggcatcctgtactgccgggcggccagggctcggaggaggagatgtacaacaaccaggaggcgggaccggccttcatgcagtttctcaccttgctgggcgaatgtggtgcgggctcaaagcgctttgagaggttaccggggccaaggtaggacaccacaatcgggattccacagagacaccgcactcccctctacagccacataccaggaccacggaggatcatgtcccacgttgtcccacgatgcttgcgttaaaacaccttaagtaaaccagccaggaagggccgtccgcgaagggccaccaatggggcaccggcaactggggaccatatcgggttcca

SEQ ID NO: 554564 - DNA, 523 bp, Homo sapiens
tccatttatgctatggaaaaaccacttggaaatgtcttgggaaaccttgcacaggccccgccctagggagtggtgatgtgttgggggaggtgcttgttcccaggtccattcccacacgtttgctccagttgggatctccttatgtggcaggcgtggccgtggtggcttttctctcctcggtgtttctctttccttccttccagaataggggttctgcaggactctctcgtgctttagcaagtgtggtgtggccaaggacgtggtgtggagtgggttggcttgaaaccagcgccaagttgctctacaacagttggaaacgtgctcgtgtcctcccagcggcacttcagtgatattgtgctcccaggaagtgggcaaaaaaaccctcaattgggtccagagaatcgtaatacttctccgtgaatccggctgggcacatcatttctttcagggggccacatttcttaagtgattccaatcctttccccgtccgtgcctctgccactttaagccaggtggtaacaga

SEQ ID NO: 554565 - DNA, 257 bp, Homo sapiens
  misc_feature (4)..(4): n is a, c, g, or t
  misc_feature (79)..(79): n is a, c, g, or t
cganagggggggggttttgggggggggacccccgttttcttgatgaaggaacgtttcttggggggggggggcaaggttntggtctagggcctaaagtcccttttaagggtggcgcaaagcagaggggggccggtccccccccccattaacaacagaaacccctcattcaccgggggaaaccccctcagggtaaaacccctatcccccattttcctcctatccctcaacccggacatcattacgggggtttcctttta

SEQ ID NO: 554566 - DNA, 108 bp, Homo sapiens
ccttcacgctgactgtctcactttaacccccactgagcccagctcctacctctgaccccaacttctctttgatctctgaatcccctctgactccaacttctctttcac

SEQ ID NO: 554567 - DNA, 227 bp, Homo sapiens
acacaacatcccatcaaatacatgcgaatcttaaattcataagatcataaagaaacaagactacacagatccacgctggaggacgcggggtgacacatcactagctatagaaaaaagagtggataaagagaaggagtcgagcctcccacctctctgtccacaggaactgtctgctgcggttgcccagcgtcgatgagggcggctctcctgagagcgggagccctgct

SEQ ID NO: 554568 - DNA, 853 bp, Homo sapiens
ggttatgacactgtctcaggcactacggtctgtagcagatacagcaaagcctgttgagtatgactaacaacactaatgggagcctgcctacgtctccttccgccgacaagtggagttggccaggtcggtccgaggatttttggggagtgactgcccgtggttcgtgcctccctggtcctcgcgtgatgacgctctatgagaagcgatcggtgcggatggtgcgtgtgggtgtgccagacgtatgccttgctgcttgctggttgttcgggtgtacaggccctggcttccatccgccgtggcagccttacattgtcttggccctgctatcctttctgctgaccatcttgccttctgtgatgtactaagggtcggtgaggcccagcgttagtccggataatcagcacttgaaaggtgaatccgctattcagggatatatctggagtctgatgtggctgatatgtgacggatctctggtgcaagaggctacaagtaattactgtcccttgggatcgggtaaatctgcccgataaaggaactcaagcgcccttgtcttagtttgctgatttagttgcattctcttgaactgtgctgatgtttgatgctggggtcttggcctattgttgatgtccttggtaggaatggttctgactgtgcctgactctaggggtggtcactatgcacttcttccctgtgttccctgttggtctatgaaccggcccctgggcgaggtgcactagtacccacggccggtttccctatgtttgaccatgctgtggctcaccccggcgccgttccggtggagcgccgggtctggaaagcccaggcttgggggtcccgaggggggttccttcca

SEQ ID NO: 554569 - DNA, 518 bp, Homo sapiens
tttttttttttaaaaaaaaaatttttttttaaaaaaaaagaggcccccgggggggaggaaaaaaaaaaaaagagttttataaaaagagggggggggaaaaccccttttttttgggggggtctccccccaaggggggaatttttattttttcccaaaaattttttttttggaaaaaaaaattttttttttttaaaaaaaaatttttagggggggaaaagggttttggggcgaaaaaaataatgtgggaaatttttttttttgggacaaaaccccccccccgccggggggggggtggcccccccccaaaaaatatccccccttttttaaaaaaaaggggggttttttaaattttttaaaaaaaatttttttggggggggaaaaaatgtcccccccccaaaaagttttttgggaatctccccaccaaaagaaaggggggccccccaaaaaaaaggggggaaaaatttcaattcccccggggaaaaattaagggcagtttaatcaatgcaactatttgtaaa

SEQ ID NO: 554570 - DNA, 695 bp, Homo sapiens
cgctttgtctcagtctaatacttagatcttgagaaaaaatatttttaactatttttttaaaataacagctttattgagatacatttcacttttaaagtgtacagatcactggtttttagtatattcagagtagtacagtcattaccactatttaattttagaacattttcaccactccacaaagtaaccctttacccactagcattcactccctatttttccctctaatctacctggcaactcctaatctactttgtatctgtatagatttgcctaagatataaaatcttttaaaattattgtttattaactgaacagttatttaccagtcattggtacaagaacatgaatatgcttcttttttaaaaaggacataatcagtctattgtgtttatattaataaaacgtcacatatataattaattgactaaggaacttatctatttgatgtattacattttttaaagtcttgtgtttagtaaacaaaacagctcttatataatagtattaagctagttcaaaatctagagaatgataagaactcttaattatttctattacctcttctaggtatttcccaagatcactaggttagtatctgatacattactaggtattcattaagaaagcttattttattttggtgatagagctggaataagaatcagctttcctccaggagtcccttctcttca

SEQ ID NO: 554571 - DNA, 103 bp, Homo sapiens
cctcacatgactgcgccggcgcatgttagcactgagctgggtcctgcagcctcgcttgctgtgggcatcatgaccgtccccatcgcaggcccagagacccaga

SEQ ID NO: 554572 - DNA, 103 bp, Homo sapiens
tcgagctcggtccaccgacaggggataggacagcctaattattagcatcatccctctactattttttaaccaaatcaacaacaacctatttagctgtttccgc

SEQ ID NO: 554573 - DNA, 128 bp, Homo sapiens
  misc_feature (16)..(16): n is a, c, g, or t
cactctataggatccncaggcgttctccatgcgcaggtattcaagttcagccatcaactgctcacgcggtttcagcgcatcgtctttatcttcgggcacagcgggtttgggcttcttcgtcattacga

SEQ ID NO: 554574 - DNA, 121 bp, Homo sapiens
ggcaaaccaaagtttaccaggcagtccccatgatatatccaactctacaggaatcaaaattcatggacaggagttggtgttaaagcctaagacctgcgatgacaaggtggctgctttgcca

SEQ ID NO: 554575 - DNA, 142 bp, Homo sapiens
cagcggactgggaagggaactctatctcggcctggactcccgctgtacctttgttgggggctatgtttgaggctgcggtcgtccgagctcctgggtcgtgcgggcgccgcgatcccctcttcccgtagaaggcccaggcgct

SEQ ID NO: 554576 - DNA, 324 bp, Homo sapiens
tttttgctagagtctagctgtgttacccaggctggagtgcagtggagcaatctcggctcactgcaaactctgcctcccaggttcaagcaattctcgtgcctctgcctctcaagtagcaggaattgtaggcatgtgtcaccacaccagctaatttttgtatttttagtagaaacagggtttcatcatgttggccaggctggtctcaaactcctcacctcaagtgatccaccagcctgggccgcccaaagtgctgggattacaggcatgagcaccatgtccagccacttttacttctaatgaagtctcaatgggtcataagtcagc

SEQ ID NO: 554577 - DNA, 368 bp, Homo sapiens
ccaaagggaatttttttttgtaaacaaaatttaaagtccaacaaaaaaaattttgggcaaattgtaagtcacaaggattttttttaattaaaacttttgttttccaagggtccaagttttgatgtcaaaaatttccccccaatttccaaaaacaatgttaaatgggaaaatttagggacatttttcactttttattttaagcaatggccttttgtttggcccctgggtttttcatcccctttttaccggaataaaagaaaaatcctgttaacaaaagggaaggttctaataatttttttacccaaatacctccaaatccccaaaaaactcctttaaattaacaggacaccatttgcccacctgtgaat

SEQ ID NO: 554578 - DNA, 130 bp, Homo sapiens
aggggccaggagttcgctgactacaccaggcaggattagatgtattagagggccaattagggggcgggcagggatagtccatggtatcccaaaaattctctaaaaattgtgccaggcaccagttgtggaa

SEQ ID NO: 554579 - DNA, 106 bp, Homo sapiens
actctagagatccgagtgggaggagtgaaagtggctctgaacagttcatttgtgtcttcatgcttcgtgagtcaggagaggagtgtcgaaatcgtgtggatcgtga

SEQ ID NO: 554580 - DNA, 261 bp, Homo sapiens
aatcagtttacgacaggagagagaggcgagaaaagccagtcgaaatgagcaactcaccttagcctctgtagccgtgattagacagggatcaattgtaaagtgagggcttctccatgacaccagtagttctgcccaactactgcgatttgcggataagacaattctacacttgtgatgtctcgctttcacaattaaactcacagtcttaaagaatagaaataatctgaaaggaaattagaactgcacggaaattgaggggta

SEQ ID NO: 554581 - DNA, 231 bp, Homo sapiens
aagaggacgcaggcgtgtcaggcaagacatagtcggaagggctgaaggtacgagactggagtacaaggaagagcaggactacaagaagagtgtccccggctacaggatatacgtacgcataccaaatgtagctcccagtgctacaggtgcctagccagtctaccacctagctacctacatcctaactactacatacaccagactaggaatagtccatcataggatacccta

SEQ ID NO: 554582 - DNA, 84 bp, Homo sapiens
aacagcagtaagaagaaaagcagtcaatggattcaagcattctaagctttgctgacattttctctgttcctaggacttcttcat

SEQ ID NO: 554583 - DNA, 333 bp, Homo sapiens
ttttttttagacagggtctcactatgttgcccaggctggaatgcagtggtgcaatctcggttcactgcagccttgacctctcgggctcaggtgattcacctcagcctcctgagtagctgggaccacaggtgtgtgccaccacacccagctaattttttgtattttttacagagatggggtttcactatgtggcccaggctggtcttgaactcccgagctcaatggatttgcctcccttgcccttccaaagtgctgagattataggcatgagccaccatgcctggcctggaatcttcatttttaacaagtgccccagtagagtgtttgtcgacg

SEQ ID NO: 554584 - DNA, 269 bp, Homo sapiens
tgccaaagtagctcaaaattcagttgaatgaaaaataatgtttacacgaataaagtagttaagcaaatgcttatcatcagagtgaagaggcagtgggggccaatatatttatttacaaggtatgcaatgcggagttatgaggaagcagcctggtacggaggaaagtgcattgaagcaggcatcaggagacttagctcatgactggagaagttcttaaaaccatgactctaggcagaccttgatttctagctgtagaattttggccaggg

SEQ ID NO: 554585 - DNA, 465 bp, Homo sapiens
  misc_feature (97)..(97): n is a, c, g, or t
  misc_feature (109)..(109): n is a, c, g, or t
  misc_feature (130)..(130): n is a, c, g, or t
  misc_feature (136)..(136): n is a, c, g, or t
  misc_feature (146)..(146): n is a, c, g, or t
  misc_feature (149)..(149): n is a, c, g, or t
  misc_feature (163)..(163): n is a, c, g, or t
  misc_feature (205)..(205): n is a, c, g, or t
  misc_feature (232)..(232): n is a, c, g, or t
  misc_feature (240)..(240): n is a, c, g, or t
  misc_feature (244)..(244): n is a, c, g, or t
  misc_feature (433)..(433): n is a, c, g, or t
  misc_feature (441)..(441): n is a, c, g, or t
tcatcttgggcctgtgttatcacttcctcttcagtattgcatggcatggtttttaagaaggaaacacgatggtgatgtacatctgtcacagatgcanaaatagcagtgnactcttgtccttttgatggcntgatancagaaactanggnaccagtgttgatanagactgatgaagaattgatgaatttaagtaagggagaagaanatctcatggatgcataagtcatagctntttgcctnttangatgcaaatgttgtagtaacaggtggcaaagtggcagacatggctcttcattatgcaaacaaatataatatgatgttagcgaagctaaactcaaaatgggatgccgaagactctgtaaaacagttggtgctacagctcttcctagattgacacctcctgtccttgaagaaatgggacacttgagacagngttacctntcagaagttggagatctcaggtgg

SEQ ID NO: 554586 - DNA, 392 bp, Homo sapiens
aaaaaaagaaaaaacccttatctctggcccttatttggaattttccactctttcattaatttgttttaagccccgggtgggaaaaaaggggtagggcattttaaattgcccttcaaacgcttttaaaataagacaaatttacttgataagggccctttatttgatcccaagtgggataaaaccaataaatttgggttaccgcagtagtaattttatgcacccgggggttttctggttaaaaatgcaaaggaggcaacggtttttttagttacaaaagtttcaagcttcacttttgggcagtaaaaacaaaagtaggctccagtttgggccatgttgagggccagtttttgaaattgttttacaagactttgaaaataaaccccttaaactta

SEQ ID NO: 554587 - DNA, 1239 bp, Homo sapiens
  misc_feature (867)..(867): n is a, c, g, or t
cttcttcggtctttgtcatcgttgtgtctcacataacgtgggtcattcttgtcctggagatggtccgacccgctgccgcttaagggaagggtctccggatctcgcgcccgggggtttctttgttgcgcatctcccctctgggccgccaaagggaaccgtgctttcctcccgaccaattcgggggggtccagggccctccttgggttgtgccttccagccttttgccgccgttgtttccgcccaccccaggcgggcccttagccatctcttgtttgagcctcgagtgtcccacacgtgggcccctgacccctacgagtcctgccggacctggatttggggaaaccggtgttcttcccacctggggccacctttcttgggcctggatgctttcttaacctgagctgaggtgtaaaacttctgtggtcccttcccccgccggagggaccccggcaagtctcctgttgttgaaggacggctccgccccagcagccttgtctgttgaagtggggtcttctccccaagacttatgcgcctccaggacctcggggggggagcccaatctctcacagcacagcgccgtcaccacggatcccacccacggcaactcggagaccactgtggaatttaagagtatttttgaggtcgtccctctgtgctgttacccacaatatactgcgggttcttgggccactgttcaccactcacctcccagcttgttctacctgaggacccttttcacgaattcaccaccacggccctcttaccgctggagtttacactttgtgggcccacagaaactcacacacgtcaagttcttgttttttggtgttctcacgccctattgggaaatgattgtcgctcttgtgntctgttgcttcgttcaacaggtctcacgaccgagagctcaacttctggacacatctgacaccacatttcccgctggttacacacggcacacgcgtgcctcgaatgtaaattcttattaccaccctcccacatttcacagccacatggtggcttcgccgctggacacacggtggaccggcgaccctgtggcccgccatggaacccttgagaaccccagggacgacgcccagtgcccgggaaggaactctcccgggactccccgagcctgcaccttaactgttcttcttttctggctattttttgttgtttgtttcttttgtgttgactttgtccctggccaaattttcccctctgagtaaaaccagtttccta

SEQ ID NO: 554588 - DNA, 122 bp, Homo sapiens
tgtgaggccctgtggctgctggctgagggttcttgtgtccggtgccaccccattatagtgcagttccctccggaataatggacataagaatagtaaactgtgtagaaaatagtaatcacgat

SEQ ID NO: 554589 - DNA, 135 bp, Homo sapiens
aaaactaggccggaccctttttttttcggagtagtagtacaatatgggagattattccgaagctggtaggataagaatataaacttcagtgttgaccgaaaaatcagaataggtgttggtatagaatggggtctc

SEQ ID NO: 554590 - DNA, 80 bp, Homo sapiens
ctcttggggaaggccccaacgagatatccaaggatctcaattgtgctgcggtaccgcctaccgataaactcatctttgga

SEQ ID NO: 554591 - DNA, 427 bp, Homo sapiens
  misc_feature (204)..(204): n is a, c, g, or t
atctagagttcccaggcaaagtctacagctgtcctgcagttatgatatctatattcaaacacatactaacaatctctggagaggaatttactgataacacgtgtgacacattccaggaagttagaaattaggacagcaatggtgggatatggatatggaaagattctcgttctaaagattaaataatatccattctagcacatncagctcccccatgggccctatggaaaatagatcttttgcatacattatcccaacaagggtagtggggagttggagggagttggaaatttaagtgagtactggccctgtgccaagatgaaacagtcctgcctctagcaagggctcgttttagttcgagctgttgtttccattctctctggagaatggcagtatataagtggttaagttcatggactttgtagtt

SEQ ID NO: 554592 - DNA, 117 bp, Homo sapiens
ggtgtgttgattagtagtagttacggttgaacatgtatgtaggtgtatatatgtaattgagattgtcgggggaataggttatgtgattaggagtagggttaggatacagtagggaga

SEQ ID NO: 554593 - DNA, 135 bp, Homo sapiens
accagctcgtacagccctaaggtacagccagatccgctcttcctggctccttcccaagcagttcagccatagggtgcgctgtcgggctagtcggggctgtcgggctagtcgggtactgtcagggctagtcgggga

SEQ ID NO: 554594 - DNA, 256 bp, Homo sapiens
acgatattatgaaaagtgaaatacatattctttaaagtgcctcccttttaaggattttgtatcaacaaagctactgattgtggaattcatgtagtagtcttcatgaagtcacagtatattatgactccgcactatcaagtagcagcttaacagagctctataaaagcaaagcattatcacagtataggtcaagatcatacattatattgataatttgctatcgattagtttatccatagccaactgagctgagttc

SEQ ID NO: 554595 - DNA, 790 bp, Homo sapiens
gcaccaggtggtctcctctgcacttcaacagcgacacccacatcctccacctttgacgctggggctggcatgccctcaacgaccacttagctcaagctcattgtcctggtatgacaacgtaattgggctacagcgagacctaggggtggtggacctcagtggcgccacaagtggcctccgacaggaggtaacgaccccgtggaccaccaggccgcctcgaggcgaagaggcagctaagagacggaaggagaagagacccatcaccctgcgtgggtgagtccgctgtccgacactcaagtccccacaccacacttgaagtctcccgctccttacaggtagccgatgttagaccgccgttgaatcgaggggatggggtcgctagggaggcctgcactcttgtcaatgtggccattcaattataaggtaccctggtgcttctaaccaagatacatgaaaagaaaataggctcgatggcgtctggcgtcgggagtcgcggcgtaggaagaaggtcttcgagcttggcgctcgatgggcacgtaacctggtcgttgccctatgcccgtgtctttcgtcggtccacccggggggtgcgcctctgcgccggcgtctcgccgctaatgagtgaagcgtgccatcatgtactgggagtatcccggttgttaccccggggcattgtagcccgggggaaactttggccttgggggcccgtagagggctttgagccagcgggttcctgttgacccaggtgttgggcacgattaaattctctgcggtatcggggtgacaaggt

SEQ ID NO: 554596 - DNA, 239 bp, Homo sapiens
aacacctaggagaactaaatgggcagctgaaatattaccagaaacaggtgggtgagatgaattacaacttgaaaatgtcatcaaggaaaatgaaagagtcttgctctgtctcccaggctggagtgcagtggtgcgatctcggctcactgcaagctccgcctcccggattcgtgccattctcctgcctcagcctccccagtagctgggctacaggtgcccgtcaccacgccatctaattt

SEQ ID NO: 554597 - DNA, 116 bp, Homo sapiens
catcccacgcacagaggaggagggaggaggctacagagggctcaacaaaggtgaacaggaaagctgccgacagaggctcccccatgcccaagaaagcccgtctccctagttaagac

SEQ ID NO: 554598 - DNA, 137 bp, Homo sapiens
cacagtctgcgattctccctcggatgctcccaacccatcttcgtgctttctctgccagctcctggtccaactccgcatctttgctgagtcactcatggctcctaatgatctccccacccacttgggcctcctaacac

SEQ ID NO: 554599 - DNA, 127 bp, Homo sapiens
gcttctttctttctttctttctttctttctttctttctttctctctctctctctctttctctttctttctctcctctctctttctctctccctctctctttctgtctctgtctttctcactttcttt

SEQ ID NO: 554600 - DNA, 116 bp, Homo sapiens
agcggggaacaatcactttggctaggacctagcaaaagtgaacaaataggattacatgaagtgaaaaagcttatgtacagcaaaggaaacaatcaacaaagtgatggttccccgcg

SEQ ID NO: 554601 - DNA, 274 bp, Homo sapiens
gaagtggagagccgtatctcatgcctcgagtctagtgaggcgctcttactctccgctgggcaccaagaacatggatggatgaaacaaggttcctgtaggcaggtacacctgattatgcctacagctacgtgtgcgacacctctcatgcagcagtgccatcagctcttcatacctatttgaggacatggatggagctcacggagcaggaagtgtatctctggggaacgtgctgtctacagcggacatagcccgccacagcagggtgtcaagtctg

SEQ ID NO: 554602 - DNA, 535 bp, Homo sapiens
ggccagcgaatcaaaagtcaaacatatcacatgacatctccaaagcacggagtctcactctatattcgattacctgcacacgataagacaacagaagagtcagagagaatgcagctgtcgctaggctccggagatagagcaaggggccaccagtcaaggaatcagaataggttctagctggaaatggcaagaaaattgattcttactttgagtctcagaaggaatcgtaaaccaaaaataaaatactaagcatggcccaaccatctgaatggacaccccctctcagacaatggcattccaaagttagtaaaagaaaacttagggtacaagctctttgatactggccttggtaatgattttatagcataccacaataacagctcagacaacaaacagcaccccataacacaagtgggcactacaatgctctatgtatatttaggagtatgctttattctccaaacataaatttttctcatttatttacgattatatgcattgattttggaggacctcactctgtgtggtagacaca

SEQ ID NO: 554603 - DNA, 1535 bp, Homo sapiens
  misc_feature (969)..(969): n is a, c, g, or t
ccagtcccgcattggaacggctccccggcagtccaccgccacccattggaatggccaacaggggatcctgcattatggcactgagtccggggagggtgcggcctacgaatgtattgatgataatcacattattgattgcagagtctgtgatgcagactctctgaatccaggtggactcaccgaccgcagttgccgcatagtgctgtgggctcggcccctagaactggaacgcgaagaacttcctagcaatcttgggctcatacggtatgtgcatcgggtgcttatgttgtagactctattatactgcaactgtactctccgtaggggcctaggcccgcgcagttgaacacgcaagagtccacgtgcctgtccatacattggcctttcatagcacgataggtgaagcagatctctactagtctccgtgcggacgcaagtcttgatgcgcttatatggcaagttagacaactcatctggatcaagtcttttccaatgaccttgttgggaacccgtccttgtgcggacatgcgcagaacacgacagcatgggggccctgttagttgacatgccggagaagagacttgcattcgcaaattcctagggcgttgggagcctggagcctaagttaaatgcgcactggaagcacttgcaataggggcttactttactacctgtgtgggattcgcccaaacctgggatttcccccttaaaaggaacctattcgcaaaacggtcagcaacgttccccttccgggggaaaccgtatcttccgggtcatttaacgcccaagcgttggccacacgcaagggggccaacggaaacctggtggaattccgggcggtttaaccacggaatgggggggcacccacatacccgtcggcggggcggttcttacaagggccacgggccatgtgcacctttgggcgttaaccggggggaattgggccccaactggcccaaggagaatcanctcttcgtgagagtttgccaccaccgccgcaaaagggaccattggtcccacccactgggaccaccagtcccccacaagagaaaaatggggggttcaagcactaactaacatcacatcggtcagaaagataactagtgctccatatgtagcatagagacacaggggcgaccagaatatcgccgcaagagaggaaggcccacactcgaagagagatatcttacaaagagagtcaccgatatctcacttggcacacaggcagagcagagagcggggattacaagcacgcacgaggtaccatcgggtcacaccactctgtgaaaggtacgccaatacgcagaggagtagcacacaacagcccacaagagagaagataacacaagacactactcccacagtccacacaaaagacgaagaaacaacacaggtaccaccaagggacacacagcacaaatccacagcggagcagaaaacaaggagcacagaaccaatacagcacacaccgacgaacagctagtagaggcagtacatcacacccggtggtaggtagtatacgcaagagctagcca

SEQ ID NO: 554604 - DNA, 198 bp, Homo sapiens
cttagctcatctgctgagctctctggagcatcagtgcagccatgccgtggtgcagcagtgggcttccccacccactttatcaggtgtctacctgccatgcggatcactgttagtcctatgaggccctgggttaccacttaaagaactcccatgccttgcttggggttggccaaagccacaagggcacagtccattggc

SEQ ID NO: 554605 - DNA, 417 bp, Homo sapiens
  misc_feature (191)..(191): n is a, c, g, or t
cgcatctgtgggaaccgctttctctttctttgcaggagggtatactcagccgtgtgtcccccttgatcagaaagactctgttgtgaccttcacggaatcacgcatccccaggggtggggaaattcttccatctctctgagatcacctcgcggtcccatttgtgtctcttccacacaaactcccctataaanaccagcatggttccatgtgtcatacagggtggtagcctcaaagctccacctatatgaacagcgttcagccacgtgtgggtgtgtcttggtctcgccttcagcaacgttcacatgggctctactcgaagcaagaggggtgacattgccgagacaccagcataggctccacaaccacagtgcaacgggtgctcacagtaccctagccatgctgagctgcagaggccat

SEQ ID NO: 554606 - DNA, 274 bp, Homo sapiens
cagtgatatgtaatacattcataagacaagttgaaagaagacatggcagacacacagatgcaactgtgaaagttccttttcttaagaaatgcaaggtaagcaggacttcttaattacttacttgaagcaaatattagacaaagttcattcaattccagataaactcatggatgagactacttcagactcagactatgaagaaatcgggagtgctctttttgactgttgattgttcgaagatacatttgtaatattttgaagcagcgaggtaccg

SEQ ID NO: 554607 - DNA, 157 bp, Homo sapiens
  misc_feature (9)..(10): n is a, c, g, or t
cctacaaannatatgaatgtggtcgcatgtgcctgtagtcccagctctcaggaggctgcgatgagagaatcacctgagcccgggaagttgaggctgcagtgagtcttgattgcaccactgcactccagcctgggcaatgatgtgagacctaatctca

SEQ ID NO: 554608 - DNA, 159 bp, Homo sapiens
tcaaagggagatatgtcattgaatggactcggggatatcttacagttaataccttgatcactactttcgttactagctttctcgagtactatgacatatatgtccaatagtctataagggaatgatatgtcattgaatggactcaggggatatctgggc

SEQ ID NO: 554609 - DNA, 451 bp, Homo sapiens
tcgatagtaggtaactggaagcccagcaatgaagagggtgtatctatccccaccgcatgtggatcctgggtgatacggctagtccgggaagaaggagtacagaggtggaagagcccgatcaggcatgtccagacaccacaagggttatacaggatcgcgacaccatacacaacacctcgcaatgaggatgggattctagagatgatatatcccaacgatggttggggacttcagcaggtactcagtgtaagccacgataagcgtatagctggccaaggtctagaagatgtcctagtatgagatggtcaaagacagccgtatactacctcgtacaaactcaatacccgaactacactgcccagctctacgaagagggtacacaataacggatctggcagctaaccagcacacagcctcccagccgtacaatacacaggcactagatggtact

SEQ ID NO: 554610 - DNA, 812 bp, Homo sapiens
  misc_feature (36)..(36): n is a, c, g, or t
  misc_feature (68)..(68): n is a, c, g, or t
  misc_feature (73)..(73): n is a, c, g, or t
  misc_feature (93)..(93): n is a, c, g, or t
  misc_feature (684)..(684): n is a, c, g, or t
atgctttagatctgaacgcgaggactgttaactgtntctggcaaacatgaagtcaggcctctggtatntcttnctcttctgcttgcgcattanagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaattttgatcctcctccttttaaagtaactcttacaggaggatatttgcatatttatgaatcacaactttgttgccagctgaagttctggttacccataggatgtgcagcctttgttgtagtctgcatttgggatgcatacttatttgttggcttacaaaaaagatgtgaccctataatatggaactctggcacccaggcatgaagcacgttggccagttttcctcaacttgaagtgcaagattctcttatttccgggaccacggagagtctgacttaactacatacatcttctgctggtgtntgttcaatctggaagaatgactgtatcagtcaatggggatttaacagactgccttggttactgccgagtctctcaaaaacaaaaccctcttgcaaaccagctttggagaaagcccagctcctgtgtgc

SEQ ID NO: 554611 - DNA, 876 bp, Homo sapiens
  misc_feature (748)..(748): n is a, c, g, or t
gggagaacggtatgaaggtagggaagaacgttccataccatggaaggaacaagtgcaaagagcctgtggcaggaaggaatgaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaattttgatcctcctccttttaaagtaactcttacaggaggatatttgcatatttatgaatcacaactttgttgccagctgaagttctggttacccataggatgtgcagcctttgttgtagtctgcatttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgtntgttcaatctggaagaatgactgtatcagtcaatggggatttaacagactgccttggttactgccgagtctctcaaaaacaaaaccctcttgcaaaccagctttggagaaagcccagctcctgtgtgc

SEQ ID NO: 554612 - DNA, 1465 bp, Homo sapiens
tggggcttaaacacaaacttatattggagggccctcagcacctagtttctctttctccgggcacagtctgggtcccccggagacgttcagttccgggggggcagcaatgtgaaacccactttgggggccagcaggggcattcttctgtggggatgtgggtggagggctttgccgagtggtgcgtgggtggtgtgccacctctccaaaagggatgtgcctccacgagggattctcagtggccaacacccccgtatatcctcggtgtgccagaaagtgtctccctcttgttggccttatatatatttgtggtggatagcgcccgcggtgcacagcccttctcaagaaagtggtgtgtgtgtggtacaattctggagaccccactctctccagagccacacacacacacacacaacacacacacagagctctctgtgtgtgtggcccgtgagaggaggagatataacacccttctctgtgtgtgagagcaccccgtgagaggggggcacagctctctcacaccacagcggggcgtctatatctgtgggggactcccctccagaggggggtgtggagcgagagaggatataacacggggggggcgcgtatatagtgtctccccctgtgtgtagtcgccccgtgtgcgcccacaagctttgtgcgcccacgggcgtccctcacggaagggcgtctctcctctctctctccagagggggaggcccccagcggtatttgtgtggcccctctcagtggcctctgtgtgtgcgcgcccacgggggtggtagcggcactatttggcgcatatgtgtttgagagagtcgtgggggccattctgtggcgcggggaagtgtacaaaccaacattctggggggcccctgtgtgtgtgatatgggcgcccattcagggcggggggacaaattagacacacagggctcttccccgagacacgggagattcttataaaacaaccgagcagataacggggaagctcccccggggaaagagaaccccacctcctatagtgtggccagatgtgggggcacggccgcccggcgtggggcccccggggggatcatggcggggaattagaattggtccccctttggaacaaggaaagtagccccctatatggtagtgtataaccctcagagagacacggcctaccaagggcgtacaaaaaccccaacgggaggacggcagacaaaaggagagcggcagtacaagaaagggcgcccaatataaaaggggggggagcgccatcacagcggtgtgccgcggcggcgggtgaaaacacacacaaagtataaccccgtgggggcggccccccatttaccacttcctgttgttcccagggggatactctacacgggggcccacatgtgtgtgcgaaagacgggggctccctcggggtaaccccccgggccaatatagtgtggaaccacaacgtgcgcgtgtgttgacgcgcaca

SEQ ID NO: 554613 - DNA, 383 bp, Homo sapiens
  misc_feature (79)..(79): n is a, c, g, or t
ttttctcagagcagaacaatggttctaatgaaactctgttgcgcttctattccaatgtccaatttatggggaaaaaaanctaaataatgccattttaactttagccaatatgttcacacatagaatctgttaatttttataaaccttttacaacttgttcaaacctttagctttatttaatttaaacaatcctttaaccctctaacctaggcaaaactttacattcccatactttcttataatctcgtacaaaaacacattttattccccctacacatcttgtatgtaaacttattttttcagtagtctcaattacatattacgatgttaactcctagtaattttacttttggcgaaaaccttggtaagtaaggggtcgacgc

SEQ ID NO: 554614 - DNA, 634 bp, Homo sapiens
ggacaatttcccctgtatcttttgatcttcattccgaaggctcccatatatacatgataaataaatctgtatgccttttctctaattaatctgccttttatgagttgatttttcagcaaaacatcaggggaccaagggaaagctctcccttatcccctacggtatccaaaggaaagaaaatcagtgtgtcaaaaagatacctgtatttccatgtgtactgctgccctattcacaacagccaaaatatggaatcaacctaggtatccaataataaatagataaattaaatgtgatatatatatgcactacggaatactactcggtcataaaagagaatgaaatcctgccattcacagtaacatggattgaagtggaaggtaagtgaaataagctgcgaacagaaagttaaactccacatgttctcactcatgtgagagaaaaacagttgatctcatagaagtaaaaagtcagagaatactagaggctgagaagggtagagggaagggagggttagaatgagatttctaacaggataacataatatagctagacaggagaaataagttctagtgttctgtaccacatcataatgactgatagtaacaatagatatcatatactttctagctgcatt

SEQ ID NO: 554615 - DNA, 151 bp, Homo sapiens
ccactgggtctgaacactaacattgctaagaaacccacccaccaccaggatatatggaagtaacttcactatggaaagtaagagtagtcacaatactcatgaccctgttgtaaatatatagtccttgcgtatactgtcactttgtttatta

SEQ ID NO: 554616 - DNA, 635 bp, Homo sapiens
cccttttttttttgttctttctctctttctctgttcctgttgtccctgtttttgtttcctttttttctttcttttttcttttctttgtgtttcggcttttctttttttctctattctcttgtgtgtttctttctgctcccctttttgccggtgctattgtctttcttattcctttgtattttttttttccggtctcttgttcgttgttttctattgtgtcactctttgtcgtctcaactcgtcgtttcctgatcgatgattgtgttgttttgtcttctctgctttcttgtcgcaggtcgtcactgctattgttctttccgtcgctgctgtctatcgatcctctgtggcttgctgatcgtatcttgcgtccatatcgttcttgcgcctgtcggtcgtggactctgtgtgcgcgctgcaggcccttctgccgcctcgacggcctacgagtacgaggtgtccttcactggacgcgcacagcacgctaccacacggtgcacgagctgtcggcgcgcgagtgcgcactgcgtgtgacacctacactcactcggccggcgcggcggcaactccccccgcctcgacggcacacactggccaggccccgcgaaagactgggtaagccgagagcacgccaggcc

SEQ ID NO: 554617 - DNA, 1685 bp, Homo sapiens
ctatcccaaatcttttctgaagatgaacgagtttagttttaaaactgcactgccaacaagcttcactctcactactataacacgcattatttctctactcctttctgaggctgaactactaatttatacttacacatgtacacacagctctctttaatactaagctattctctccacggtcttcaccaagtatcaacagtaataacacaaactgaagctgtcattattcaaaatagtccactgactcctcacatctgttatcttacttataaacgaactatcttgtagtaactatcagaatctacattctaaaacagaaattgtactttttttctatgccacattaaccatcttttaacagttcgatgagaactcaacgtatggacacaaagtaaggccatactcttacataataaacatccctttctaagtaatttttctcaaagaatcacagaattctagtacatgtaggtaaatcataaatctgttctaagacatatgatcaaccagatgagaaactgggtggtctaatactgtgccagtcgagcattagtcatatcactaatatactaacaacagaatctactcttcatctacggcctgtagtgaactatctgagcctagagttacctagctttacatactatatcttgggatcctgaaccttagactccgaaggtttggcggggggtcccatccgcgcaaaccccagcggcccggcaaacagagatccggcgcgcagacttttctccgctttaacaatgaagtcgtccccataacacgagaactaggaggacggggccacaaatgaagcccgacgcaggcagagggcgcccacataaaataagatagaggtagtgaaaaaaaaaaaataaagatagcaccgcgcagcgagccccacacgccgccaaccgacacccctcaccatgtcgtgacaccagcgactaagacacaacggactgtgcaccccgcgctcgggtagtagctcagccccgtaggggccgcgccagagcaccgcgccctgcgctagcggcaggagagtaggggagtagaggcggacacgcggcggggccgcgtcgtcacacccatccgcccgccccggcgccccgcgagggcgcagccacagaagagacagcgcagcgagcaggaagtgggaagagtagggagtcgccagaggcgcccgtcgtccgggcggcccgaacccacgagccgctctccgcgcggcgccggcgacccgaccgcgacggcaacgcacgcgcggcgccggcccgcagccgtaccgccaccacgcgcgcccggccgtggcctcgtgcgcgccgcgttatcccgccgtccccggcagccgcgagcccggcgggagcacgacgccgcgtcagtgcgccagccggcgacgacacgagagggagccgagcgtgcgcgggagcggggcacgatcggacgggggcggcggcttagcaggtctgccttcgaactcgcgccagcgccgcgcccgcgcccgcagctagccgcgcgccgagcagggcggcgggacagaggcgggagcgaccgcgcagaacgaggaggcagcagacgcgccgtgccgcggcgtcgcgcgggacacgcgcgcgggcacggccgatgagcgctccgctagcggcgccgcccggcgcgggagggagaggaggctatggaggacagcacgacgc

SEQ ID NO: 554618 - DNA, 751 bp, Homo sapiens
tctcattaaactttttaaagggggcctcaaaatcctggggacacaaatttggggccacagtggttcccattaaaaagtcatcggttttataaaacacttaatacactttaaacagcgtgcccacacgcaaaaaagaaaacaccaagaggggctcccacaaacaactatctctctcctttctccttctcgtgagagggtttacacgacagtgcctgtgtggttactcatttacacgcgagctcttttatcactcacttcaacactttaaagtagtggccacgagtgtgagaacacaaaacacagagagtctctgtgagagacaccaggtctctctctcaccacacacagtgtgtgtactctaaagagagtgtaggggtgtgtgcagagagtagttataaagaaggagagactaacaatattatctcctcttatgcacacccctctctctgtgagagccctatatctctgtggggggcgccgcagacacttgctgtgtgcgtagacaacactatgtgctgcgcgcagtgctctccgcgcagcaccagcggccggcctctctcttcctgtggtgtgctcccacagcggtgggctatatgatggatagagaacacacccccaccaccgcgcgcacaaaccgcggtgggtgcgtgtgttctcatcatattttctcaccgcaggaaaacacagagagcaaatacgagcagaaacccaccaaaaggggggggggaataatagtctgtgtagagaagac

SEQ ID NO: 554619 - DNA, 251 bp, Homo sapiens
gggccccccaaagggggggggcccaaaccccccccttttagggttaaaaattttcggggggggggttggggggcctacccaagggccccattttgttccccccctgggttttaaggggggggggcccaaaaaagggcctttttttgggggccccccccccccccccccatggggggggaaaaagttttttctgggaaaagggccgggaaatttttcctttttttatggaaaacccggtttgggacccttta

SEQ ID NO: 554620 - DNA, 487 bp, Homo sapiens
tcttggtgcccttgatgctttggtcaggatccatgaccttcacaagacttcagatgctactcagggagtttggggtaggtcgcatttatgaataatccaagtgtcccgaggtgtctagctttggccacattggtcaagagccatggaagccaaccccacgatggttttggggctgggcttttttttttaatcccctcaagtgtcagtggctgcaagtggactcagagcaggtcccagggcccacgctgttcatattggtgtggcatagcccactactctgcagacagaaagcatactggcatttttctgcctgaacgcctgtcttgaaaacagcctggaagatgtcagtattgccattgagtgggtttgggtgacaagcggcccccacgagtcccctgtatgctatatgaacagctgaaggtcggagacatccatgtccatgggcctgtcatccctagtccgggccggagagatgccacgtagacgc

SEQ ID NO: 554621 - DNA, 202 bp, Homo sapiens
tgaacacgtgtcccgtggggtgtgcgtttaaaaactcgattcatagacacaggttccatgttccatttccgtcatggtgaagcgaaatgaattggcctggctaccactgtggtcgcgtgcgacaggtttgacaaagaagatatcatgtttctgattttttttgtgtagttggacgacgaattgttcatggggtacctgtagc

SEQ ID NO: 554622 - DNA, 112 bp, Homo sapiens
  misc_feature (112)..(112): n is a, c, g, or t
gcattcggcagcggccttaacctcccttacacctcctattcttttcattcttcttgcagcttctcgcagtaaagctcccagccatatttacataatagcgcgaggcgcagcn

SEQ ID NO: 554623 - DNA, 659 bp, Homo sapiens
atcaagataaaaatcggaggcttgtttccattttctcgataatagtagccataggtcaacacaagactcccataaagatatgactcactatggggcagccagatacctatttgtagtgaagcttacgtatccatgcatgcacgcacaacacgtaggcgtgttccttccaaagggagacatcattacacaggcaggggggaacagtcgacatagtgcttcaggcaaacacattccatgtgcttcttgcaatcacgcatgcaatccgataggcatcagcagaacaaatctgcttgttcgtcattcgtgcaggagttcgtctgcagcatcatcccattccacgtctgcgtatggccattctgggcccatatggatcattccacacaaggtcacatggaccccaaggcttctatcgtacacacgtctctgtccacgcaagccacgcaagacattatacccgttgttacgccccactaatataacacggggtgtccatggggacctacccgtgtaagaaacgcgccgttagccccaataagtcgctctgcaaccttctgttgtcccagcttagcttcacttgttaccccaatttaaaacaggcgtggctcccacaatggcaccttgtccttcaggattccaattacgaacgcccgcggtggaac

SEQ ID NO: 554624 - DNA, 658 bp, Homo sapiens
tttaaagtacagttggctgggcatggtggttcgcgcctgtaatcctaacactttgggaggcctaggtgggtggatcacctgaggtcaggagtttgagaccagcctggccaacctggtgaagccccgtctctactaaagatacgaaaattagctgggcatcgtggcgggtgcctgtagtcccagctgctttggaggctgaggcaggagaatcgcctggacctgggaggtggaggttgtagtgagatgagatggcaccattgcattctagtctgagcagcagagccagactctgtctcaagaaagaagacaataaagtacagttatttgctctgagcctatgctaacggtttggtgttcaggcattctttattttatgaaatgcagtatatatagactatgggatgtttctctcataaccttacttggcaacagccttactttatggtctcaaaattttgggggaaattttattggactttgaaatgtagatttctgggaagtatgcgtgaggcgatgaatattatggatagggtgaactaggtgcctctgagaccccttactgccctgagattctttagggctgcaggctgaatccttatgccaatgagtcatccatacgcgagcttttggataggagagtgggtgatgtgggcggcct

SEQ ID NO: 554625 - DNA, 145 bp, Homo sapiens
  misc_feature (28)..(28): n is a, c, g, or t
cccccctttggccccggggggggccccnccccccccccccccaaaaaaccaaatggggtcccccggcccccccccgggggcccccccccctggggggggccccccccccggggggtttttttcccaaaaagccccgggggttcga

SEQ ID NO: 554626 - DNA, 476 bp, Homo sapiens
tggttccatagcacacttatacgttaccaaataaaattttatttaaaatttccatataaaattggataaagaatcagaagagaaaacccaaatcaggggcaattgttagcaaatacttaatcataatctacagcattaagaggtagtaaagatttttagccaaattttgtcagacccacttggtccctgattccggcagatggagtgggagtagcttatacgatggtcacactggtgcatctaccactatcacacacacctgttagtggacagaagtcagtccagagtggcttaactctaagagtacaagaagcaaattggagaacaggagtgaagaagagagaaagtaaacacactttgaaactgttcagacccttgctggataggggtatggacctcatgccacccaagcccactctgcaggacactggcttttgtgcagctcttcatcacagagtctgttgagctacaaccca

SEQ ID NO: 554627 - DNA, 467 bp, Homo sapiens
gcccgatccgatggggtgcctatcttatccgacttatgcgcctgaggtacacacactatcggacatcgattgcaaccgggagctggctgactagaggtagtgactcatgtcacagccactagagtacaagcagtcaagagctacaggaggatggcctatggaacttctcaagacggctagtcgtcagagcatggcaagctgtgtcatgactgcgaatatggtagatcggcgaacgatgtaacacgaacggaccagctcacggtgcagattgccctactagctccaggtacagctagagacgagaggctttgacgtgataggagacggtgcctgttgcagatacgacgatacgtgggaccttagtgggcatgcagccttatgcatctcacggacaatatgagcatgtgagaccaagggactagagacagttttacaaggctgcccaggtttgaagctatctagaggac

SEQ ID NO: 554628 - DNA, 224 bp, Homo sapiens
taagtcaatcttacagctggagtatatttttcaaagcacaaatattggctgccaagactgggtgagtaaatgtactttacccccttattattttggaatagtccacataagataattcttctgaagacctttgtgggtgcagctgaatttgtgtgatagtaagtaactacacactctgtattattctcccatttgcatttccaggggtataaatagtcgttttt

SEQ ID NO: 554629 - DNA, 289 bp, Homo sapiens
tggaaacggagcttggctttgttgcccaggctggagtgcaggggccccctcggttaattgaagcctcggcccttgggttaaggcaactcccttgtttcagcttccaagggggctggcactacgggcccccaccaccatgtccggctattttttgttttttcggtagaaaggggtttcaaccatgtggcccagcctgacctgaaattcctaatttggggggaccggcctgcttaaccctccaaggggctgaaattacaggctgggcccattacaaatggccaatttcatg

SEQ ID NO: 554630 - DNA, 1883 bp, Homo sapiens
gtgagcctcaatacacagagtggtgtgtctcgttgatgtgggataggtggtggtctgagggaagattgattgatggcggggaagactgtgtgttggttggatggacggcggttggtgatcgtgcggatgtgagtgttgagtttgttgtgatcgtccatacatgctctcgttggtgaatgtaggggaagacacgcaatgttggcacgccagtctggggggaagaatggatgtgttgggaggtttgttcggtgagtgacagaatagaggggcaggatgacagtagcacaggacggagggggtgtgtttgtggttggatgagatggtctctcgcgccctacgcccagtgcgttaggtaaggagtgcatgtcaagtagttgaggtgtgggtgttgtttgagaacagaaagtagtgtatgtgctaagcaggttggtggggtgggcacccccgacagagaggagtggatgggttggcctactaacccactgtgttctgttaatttagttgctagaactcttgttgtgttgtgtggaaggagtgcaagtctttcgtaacaggactgctgtcgtaatcattgtttgatatagtgtttgtgctcgacttcagtcaacaacatgggttgggtgtgaagacgacaacaacatactgagtggtcgtgtggagcgcgccaaactggtacgatcatctccagctgccgtgtgggaagatatgttctttttgggaagttgtggagaacccactgcatcatgcttgttggtgagaatcataacaataagttctccttgtggggggacaatatgatgatgttgtggggtgatgataacgttatgatgtggtggtggagtaatcttgttggttatgccacgcctccactggaaggtctcgcacaacatcagatgggggacacgaacaacggttggtggagtaccaccaacaggaggatgtggacgaccacgacaactgtgtgcacccacacacaagcgtgggaggtgtggagagtgtactacgcgtgaggagctgtccgcccacaggggagtgactacacacccacagcggtggtggaagaactgagagtcgttttgtgctggtgcgacaggtggggaaaagagaagtttctactccactcatcatatattgtgttgtagtagtccaacacagaggaggaagagatgtttgattatagtaatcttggtgctctctgtgagtggtattgtggtgagtgttgtctgtgttgagctgggtgtggtagacaacacaccaacatagctcgcttccacacagagaagatattgtgtgtgttgagaagagagcactcaacagacacgctgtgtgcgagagtgaaattgagagagagagtgtgaaagaatgtgcgcaaaatagttgttgtggtgagaagagatagtgtggagaacacatcgtgtgcgcacacgtgtgtgtgcacaaatgtgtgtgcacacggtgagccggacacacacactacacacgcagcgtgtgtgcacacacatagtgagttgtcacagagcacgcacacatgagcacacacacaagttgttctgtgtgtgttgagtgtgtgttggccacatgtcacctctggatatcacaggatatcacacagagggaagaggaagatatggagaggcacacccacaaactgggaaactctcacacttggtgtcttgaacccttgggtgcacaccatggtgaagtgtcgaactcggcatgtaaagaatcttggtatggcgtggtctaagaaaacaatgccgaaaataaaaaaaataaaggcagttaacttcagggtcgagaagagtatcggatgcaacctcattttcagtatgtttgttttgttggttgttgtttcgtctttgttttttgctctgttgtgtagt

SEQ ID NO: 554631 - DNA, 1448 bp, Homo sapiens
ctgttgaattttgcactttgtacttctgatctgctttcgtgttagtcttcgcctcttgcttgtggttgtattgattgtgctcctgctagttttcgcttgatcatcattcgcttgcttataatgaattatatctgctctctcatcgctctgttttgcctgtcacctttactcgtattctctattccctctgtccatttctatacattgcggcgcgtcattctcttagtctataggtcaccctcgttgtattgtggtctgcaaaagttgtacctcagtgagtagtgatcgtgctgggctgacattaaacccctatttgggaagttaaattctaagttgttccgccctggtcatcggtcttttgcaagtcgtgttgttgtgtcttttcctcttagtggtttgcgcctatacttgggtgctttgagctattgtacttctgtgagtgtttgtgtgggttgccccagagtgtctatgattctgtacgtctgttgcataagacggcttgtagctttccgcccagttacgtgtctcttgtttccatcctttttagctgtttccttggatacgagtccttagttttaacctctgtattgggcttttgctatgtgtagcagatattcttgtgcttcaatcatctgtattgggtttcgtcgcgcgtactctcgtccttggtgctgcgctgtatggccgttggtgtcggtaagtgtagttgtctgttcgtgatctcattgggctgcttgtcctcagacgtcagtgctgatacattgcaattgagtcaccctactagcttccaattccccgtgtgtctacgttgtctccaggatggctggtaaacgtcgtgattatctcgctgtccctcagtgtaagcgcgagtcataaacgtctcataactttgcgctcttggagggtcggtttcgccccagtccggcgtgaccctgttgttgtcagcgcccgttgtgctgactcccagatttgttccttggtatgtttactccgtgttcatctgagtattacgtgtgggttactgtgagcacttttgcgtgggtgtaaatgctgctcgtctctgccgtgttagttcttctctatctacaattgtgtaaatgatctaaatttagttgtttatatgtggtgtctatagcgaagtttttctatcaagttttcccccatccgcatccccatcgctggacctcatcttgagatagacttgagagagatgtcttggatactcacgtctgtctgcatgtagctcatctgcttagtttacgtggtctgggatacaggatgtaagtctcctttttgtcaaagccatattgacagattacaccgaaatactcctcctctttgtatcacttcagccttttgctttagtttggtaagttttaagaaattgcaagcagcaaagttgtgattcacgtgggcacgatggactccaaatgcttccaatgttatga

SEQ ID NO: 554632 - DNA, 165 bp, Homo sapiens
gctgaacttatagcaggccaagcaatgctttgagcgactaaaatgaggttgggggtaatgctaatcgtcaccctcacaggaatggccacggggactgttatttcgcgagctggtttctagacctgttagctggtaccatggtgagcaccatttctggacgctcag

SEQ ID NO: 554633 - DNA, 1069 bp, Homo sapiens
gcgagaccccggaggctttgggtgcgctgcagctggtctgcgtgcgcgcagctgtttcggtaactgctttgcctcccggctcccgcaggagtgatgcttggtggtggaggtcggcgaactggcctgctccctgtgatgttggtggatgccgagtgctggtgcatgtgccctcctgtggagctgcctggtgtgtgtgtgtggtgcctgcactgtgtagtgctgcccttgcctcctgctgtgtgcccctggccagaactctgcgcctgtggcctccctgctgcttgctgatgccctgaagaggcgcggctcttggcctgagatctggctgcctgtgactcttggtcatgcgcccctgctgtccagaactctctggcaccgacagccctgtgccctgacatccgttcaagctgccaggcaacgagggagagcttccatgggagcagagctgctcttggcaggcttgaggccctgggatgacccggtcgtcagtgagctcctgcgagaacgattacggcagggccatggctgctaaagaagcagaaactagaacaggcttcaggggccagctcaagccaggagtgccggctcgagccaaggctgcaaaagaggatgagaccagtgatggccaggcttcgggagagcaggaggaagctggcccctcgtcttcccaagcaggacctcaaatggggtagccccttgcccaggatctgtctccttgtccagcttggccacttgcaggccttcgacctggtcaaggccaggccctggacttggcgttgtccagtctaagagactggccacaacggccggcctgcccttgcccaagagctgcggcttacagtaatctacagagacctgtgtgagcgaggttcttctcagtgcggcttgcaacgtccggacgttacttcctggtttaatcctggtgaccccttcgggattcacgccaattatatcggtcagtgtgggcccggagacaccatccattcaagaacttgttggtgttggcgcctttgaaccagggtagaagacctgtcctttgtatcgaggctgatgaaagtggtaaactcct

SEQ ID NO: 554634 - DNA, 258 bp, Homo sapiens
ctcaatgctgcaccacagcagccaggcgacactgaaaccacatcttacctgacgacaccacaacctcaggcctcgcgcagccatctacacccacccacagcagcactggctcgctacacacaacactgacccctgccagctccacaagcgctggccttcaggaacgaatctaccactttccagagctggccaagctcacgtgacacaacaccttcacctcccggcctccggcgctgcagcctgtgggtggccagaatt

SEQ ID NO: 554635 - DNA, 551 bp, Homo sapiens
agcggactttttcttcgttttttttttttgggaaacggagttcgttctttcgcccaggctgtcgtacagtgggcgatctcggtcatgaacctctgtccccgggtcaagcgattctcctgcctcagcctccggagtactgggattacaggtgcccgccaccacgcccggtgatttcctcttaagactttctacagcttccttatgaaatcttctgactgggccttgagcaatagggtctttggctacaatttaatgctcttttccatcacactatactgcaaaaactctccgtgtaggtcctgatctgtgtcagtcaggcaaaattacatcctgggaaaacgtcagatgaccaggggaggccactcgcttccgtgtctcatccagtttcagaacacgtttctgtggctattcatttagcttccagagcctcagccctgtgccctcgctttagctgtacagtcagaagctggttatactaccgcctcgcgagggtggccatggtcgctgtatgggagagacggaccgcttcaccaccagacctcgttggcgaa

SEQ ID NO: 554636 - DNA, 1493 bp, Homo sapiens
actccagcctagccccataccccccaattaggagggcactggcccccaaacaggcatcaccccgctaaatcccctagaagatcccgcacggttctccctggccatcgctatgagttgaccgatgcctgacccctatcgcatccttcaatgacctgggacctggcaggacccacaccacagtgcaccacctggagatccatactcggacgtgcccatggagattcctggacgacacgggcatatccacggtgatatgacactcttgatacccacgtcctaaaggcctgcggataaatctacgggtgcgagacgacggtgggtactccgcattctgacacttgggactcacagaggagacccgtgtggccttccatttacttcatgtgcgactacacccacaacacctggcccaggccctaccatcctatgtaccctaaagacccccatcctatatgtcgtgcggatagcgcgaagctgggagatacacggctgtccttgactcctggacaaccacagccgctgccttgactgagccagtttgccgaacgaacgcacactcacacgcgattgggacgacacacacgatgctgaagacttcacacgcaccaccttcccaactgggtacgatcctcgctaagcacgcacttccttaccaacccggcatgcgacagccatgaggcaaaagacacacaaggcaagcacattctgcaacgctacatggaaccgatttcccctcacccacaaccactcaaacatttcccacttaccccacgttccgattcgcattggacggaatgatcccttttcgcaaacctccgaagttcccacctccacaccgccaccaggcgatggcatcagcactatacaaccttatgtccacagacgggcgcgccttatacgcacagaagagtaccccttaacacaggacactcccacgaaacgcaaccacccgctttcccgatgaattgtatccccgggcatatcacccgcagtacaggtccgcacaccggaggacaccaccgcgtccaccgctataagggaacccacttatacaccacattgcggccctatggcgttctcactacaaccgcgcccacaaactgcgcacttgtgactcgcgcaacacagcttggccaggaccgcgcgacagtacatcttatcaagaaaacacctgtggcacacatcagcacagatccagggacttgacaacaccaccccgcggacgatgcctcgcaacaaccaccccaaaccttggcagctcccaagtggatcaagggcggaagaagacgcctgggacacatgcgaagcggcgaacagacgcggaccaccgaccgcacacacggtcgcatcacagagagacaagcatgagcgagacacgacacaacggcgccaccactcacagcggtcacacaacaccccgaccaaccaacacaaggagacacagaggcaaacgctactgtaccaaccacagggggacacaagccgcatagcgg

SEQ ID NO: 554637 - DNA, 470 bp, Homo sapiens
cgacactcttggttggaaggtctatatttcatcttggattgacctctcctctgttttcagacatcttctcagggagtctgaatgcataaggaattacttctcaggtgcttcttgagggagagagactttatttttatttactttttttattttttattttttgagacagggtctccttttttgcccaggatgaagtgcaggggcgcaatcatagctcactgcagccttgacaacatagcaagactctatctctacaaaaaaactaataatgtgtggtttttttagtatgtaaattatacttcgccaggcacagtggctcttgcctttaatcccagtattttgggaggctgaggcgagaagatcatttgagcctaggaggtttaggctgcagtgagctatgattgctccactgcattccaggctgagtgacaaagcaagactctatttgataataacaaccaagagtgtcg

SEQ ID NO: 554638 - DNA, 163 bp, Homo sapiens
  misc_feature (85)..(85): n is a, c, g, or t
tgggcccgagagctgcggcttcgatgccggggtgggagctactcaggccgcgcgcagccgcagtcctgtgcagcgcgtgccctgntcctccggaccgaaaagccgaagccgtcccccgcgacctaccccgcgcaactggctcgggtctgcacctagatggctg

SEQ ID NO: 554639 - DNA, 269 bp, Homo sapiens
agaggaaaatatatttgtactaagaggcaaattatccacagtcaaaatgactaatcattgtttaacttaaatgtgaaagataatggagagaggaatgtagcatttgtaaggaactgaaagactgaataatgtattagcaggtgaggtgtgggcctgtgagtatggacatacacccatggtatgtttgtgtgtggggtttatgtaaaacatagaaagacatatctacttttgcaaaaataaatcaacaaaatatgctttctaaaaaaaaa

SEQ ID NO: 554640 - DNA, 114 bp, Homo sapiens
tggcctcttgacagtctccagcctaatcctccctgacagtctcagcctaaccctccctgacagtcctcctgcctaagtctcctcctgtcctctccagctggtatagtgctcgct

SEQ ID NO: 554641 - DNA, 590 bp, Homo sapiens
ggaaccactgtagtacatgtggttgtcattgactgaaacatgttatatggtgcatggctatttctttaggagagattccagtactgacagtttaaaaggccaaaacttgttttgagaaaacctatatagttttggttgttgtggcctagaaattgtcttgaaactaaataacattttaattatcccacgccttcaactaacataaggttgagtcaaagttaattaatagattgaaggttgtttgcctcaggatagcatttagaagacatgtgttaattccttagttgaatttctgacttgaagcacaaaataaataataagcattatttcaagaaaagatacttttctatcttccattaagctttgcaaaaaaggtaaacttataaataagaataaataagaaataagaacctacagagtttattatttccaagagacatttgcaggtggctgacttctgtttaaatttaggtggtttcaaagaacaaatataatgaaagtgcttaatgattagaacttaaatacattaggatcctcattaaaatctagaataatctgcttgaaattaccattcaatgtagatgcatctc

SEQ ID NO: 554642 - DNA, 199 bp, Homo sapiens
cgtcttgtgccggtgtgctcgcagcttctcaggcccgtgattttcgttaagttgacttgccagtgtccaggtcatgcttgctttgctcgtctctcacatggcctgctccgtgctgtcttgttggcccctccaggcccagcctctggctcccgttgggctctaccgttgcccgaacgtctgcctcacagcagattcttca

SEQ ID NO: 554643 - DNA, 436 bp, Homo sapiens
  misc_feature (16)..(16): n is a, c, g, or t
  misc_feature (75)..(75): n is a, c, g, or t
  misc_feature (91)..(92): n is a, c, g, or t
  misc_feature (136)..(136): n is a, c, g, or t
  misc_feature (166)..(166): n is a, c, g, or t
  misc_feature (170)..(170): n is a, c, g, or t
  misc_feature (195)..(195): n is a, c, g, or t
  misc_feature (217)..(217): n is a, c, g, or t
  misc_feature (225)..(225): n is a, c, g, or t
  misc_feature (228)..(229): n is a, c, g, or t
  misc_feature (235)..(235): n is a, c, g, or t
  misc_feature (239)..(239): n is a, c, g, or t
  misc_feature (247)..(247): n is a, c, g, or t
  misc_feature (255)..(255): n is a, c, g, or t
  misc_feature (281)..(281): n is a, c, g, or t
  misc_feature (288)..(288): n is a, c, g, or t
  misc_feature (298)..(298): n is a, c, g, or t
  misc_feature (306)..(306): n is a, c, g, or t
  misc_feature (308)..(309): n is a, c, g, or t
  misc_feature (326)..(328): n is a, c, g, or t
  misc_feature (336)..(336): n is a, c, g, or t
  misc_feature (342)..(343): n is a, c, g, or t
  misc_feature (350)..(350): n is a, c, g, or t
  misc_feature (368)..(368): n is a, c, g, or t
  misc_feature (372)..(372): n is a, c, g, or t
  misc_feature (403)..(403): n is a, c, g, or t
taaacactggtatttncctcataaacttcaactaaaaaaaaaaaaaaaaaaaaatatgaaaactacaggaattanaactacctgcaaaaanntcatgctgagcctgaacttccaagtgacagcagaactgaaaatngtatgtctgcacaaatgccaaggctaagtnagtnacacaggcatgttacagcaaaaggncagagccaactgttaatttgtncacaattnagnnattggnaganttatattntcattttntatgttttttgtttattttattatanttttgtnctaggttttngatttttntnnttttttttttaataaannngttttatncaaacnngctattngtttatttcaagaaaganaatngaaaattagtctaaggcctttgttttaaatnagcttaagctatatgatatatatatatgtatgt

SEQ ID NO: 554644 - DNA, 164 bp, Homo sapiens
tactcggcgttctagaggatcccaggatggaagctgtaaaccacgttaagcttcgaagtttgtggcaaggagaatagagaaatggtgtggctcctgcgtcagggggcggggtggggattttttttttttttaagatgggcaactcttcatctacaacagatttt

SEQ ID NO: 554645 - DNA, 989 bp, Homo sapiens
aatgattaagtctctcttcacctgccagacatgtctaagctcacagtctcctaaagagcacgaacgaggtgagtgaagcatcttcattggagggttgagctttgaaacaactgatgagagcctgaggagccattttgagcattggtgaacgctcacggactgtgtggtaatcagagatccaaacatcaagcgctccagggtctttggtgtttgtcacatatgccactgtgaaggatgtgcgatgcagctattaatgcaaggccacacaaggtggatggaagagttgtggcaccacagagagctgtctccagtagcaagattctcaatagatcaggtgcccacttaactgtgatcaaagatatctgttgcgctggcattacacaagacactgaagaacatcacctatgagattattttgtgtcagtatggaccaattgacgtgattgaactcatgaacgtgaccgaggcatgtggcctagaaaaggggctttgcctttgtgaccttctgacgaccatgactccgtgagataatgattgtcatccagaacatatcatactgtgaatggccacaagtgtgaacgttagaaaacagcctgtcacagcgagagatgggctagatgcttccactccagaccaaagaggtcggacacgtgggttcttggtagacttcgctgatggtcgtcgagagtcggttcgggcgcaaatgactgcttacggcccgtgcgaaggaaactccaggaggatcgatcggtgggcgccgggtggccaccgtgatagctggtgcgatttgggtgcgcgtggcgatgttatatcgatttgtgatgcttggctgcatatggatggggagactaaaaaattcggatttacacaatccgctcaaatatggccctattgcgaattcgcgcaacttgcctttcatggcacttttacaccgacaagtctggccccgcatatttgggccaacacaccctgagagacaaagaacgcct

SEQ ID NO: 554646 - DNA, 528 bp, Homo sapiens
cttttacctcgcggcctatttttttgggaatttgtgagggaaacaatttttccccggaaacaatttttgccttttttcccccaagccgaaattaccccccctaaaggggaaaaaaggggaggcccccgcggggggggccccttttaaaatgggtgatcccccggggcgtaagaatttgggcaaagggggggggaaaattgtctcgccccaggggggggcccaccaaattaatttttggaggggggttttcgccttcccccaagggccaaggggcgggggaaacggtttacccccccttcccgggggaacaaatgggggcccagccggtctttgggcgcggaccccccataggcggtaaaaaaccgggggtgggcccctcccagggtggcccaaagcccccccccccccccaggggagggctcctgcctcttgttatggagcttgggaataaaaaaaccgggggtttttcgccaaaattcattaaaactttttaccggcaataatgtctaaaggccagatgtaataaat

SEQ ID NO: 554647 - DNA, 174 bp, Homo sapiens
aacccccatttttaagcctggcaaacccaagcaagaaatgttaccgtgttggttctttgccagccttcgtttccgaatgggagcaggttggagggagggagagccagatatacactatgggctgtattaagcccggttggttgccatgttgttaacgagcccctatttccttta

SEQ ID NO: 554648 - DNA, 163 bp, Homo sapiens
acgtccgatggcccacggtgctatgtaaggagacagctgacttcacggatgtacacaaaagggcgctggcagataggtggagctgaaggtcaccgatgaaacgggccccaagggagaggagcgcgtgaagcagaaggcactagggggattgagacagatgtat

SEQ ID NO: 554649 - DNA, 324 bp, Homo sapiens
ccacccaggcgcacttctggctgggcctgccccacaacgccgagagagtcctcccttaccactcagggtgtggacgttatcagtaaaatgctgatagatgcagatattgtgaggatgaggacgacctggcctacgcagagactgagaacaagacgaggaccgactccacgttcgacgggcgccctgcctggatgcggaccctgcactccaccgcgtcctcctcgttgcccctcatcccccatacgctgagccacctcaagcgctccgtgccgcatatcgaggatcctttgtccaggttctttgagagacaagtgcgcctgggtg

SEQ ID NO: 554650 - DNA, 237 bp, Homo sapiens
aaaccgggggaaccctcccatcctttggggccttcctaggagagcaaaaaaatttggtttggccttttcctttttcggattgcgggctggaaaaatttggccggtttttaaaagaggttttattttgttttcccgggaagggccagtttgccgggtcaaagggggattttttttaaggggggttttttggtttcccatttcaattttagatccccttttttttttgggggctgccca

SEQ ID NO: 554651 - DNA, 980 bp, Homo sapiens
aacacggtaacctacaaatcgcgtcattgcgtacctctatcactcagtcaaatagcccttgatactgacagccattctcaatccaaacgctccctgaagtttctaccgagccgacagctcaattctcatatactcggccctaagggatcattacatccaactacttgagctatatctgcactagactaaagcgtcttacactacggaatcggccactcacagatcgatttcataatgcctctcctcaagggacttatccagagcttacaccccacataattatgcatctatgttgagtaacttgtcatagtcaagcactcgagtaactctcgtcatctaccgccccactattatataacttactggtgagaacctggtcgtgtttgcattagtattaccgacggtatctcgctgaatcataactatcgacatctcctatgtatacaggacctgcatggcaatacgtatctgacgagccccatatatctcaccttcttactattattatcacgcaaccagatcgagccaaatgggtggcttcatctgctaacttccagccaacaattaatcagactatgaaaatccgctcattccacaagaggaaagatcaccctgcatgttcatacacccctatatcgccccatattctacctaccttatccgctacaaatgccccgtacaatacagtatgagccgggattttctaccttgctttaacacacacataatttctcagagctaacacccataagaaaacaaaacctacgccaaaatccatttcgactatcataattcagtgcgggggtacactctaaactattcctttccccgaagaagccacttttctcgggcccttattcccgggaaattgcccccgaagaaaggtccgggacctaacccccgaaatggccataaaaacccaacactgaaaagtattccgtaatgccatcctcgaaacggccccattccatgttcgtaca

SEQ ID NO: 554652 - DNA, 412 bp, Homo sapiens
gccactcaaatccaggccactgtactggatttccacatgaggtctcttggctgcacacagatattccaagctctaaaatatattttttgagtctgggtggctcatgcctataattccagtgctttgggaggccaaggcgggaggattgcctgagtacagtagtttgagaccagcctgggaaacatggcgagaccccatctctaaaaagaatagaatagaatagaatagaatagaatagaatagaatagagaataatagtctagcatggtggcactgcatctgtgctagctactcaggaggctgaggcaggatgatcgcttgagcccaggagtttgagactgcagtgagctaccatcatgccacccactccagcctgggtgacagagcaagatcctgactctaaagacatttg

SEQ ID NO: 554653 - DNA, 1133 bp, Homo sapiens
  misc_feature (152)..(152): n is a, c, g, or t
  misc_feature (431)..(431): n is a, c, g, or t
  misc_feature (442)..(442): n is a, c, g, or t
  misc_feature (463)..(463): n is a, c, g, or t
  misc_feature (468)..(468): n is a, c, g, or t
  misc_feature (478)..(478): n is a, c, g, or t
  misc_feature (543)..(543): n is a, c, g, or t
  misc_feature (546)..(546): n is a, c, g, or t
  misc_feature (562)..(562): n is a, c, g, or t
  misc_feature (581)..(581): n is a, c, g, or t
  misc_feature (707)..(707): n is a, c, g, or t
  misc_feature (761)..(761): n is a, c, g, or t
tggcggcggcagcggtgtcagagtcttggccggagctggagctggctgagcgcgagcggcggcgggagctgctgctgacggggcccgggctggaggagcgagtgcgggcgggggtgggcagctgccgccgcggttttcaccctgccgctgcngcactacttggaagtgagcggctgcgggagcttgctgcgcgccggggcctggcctggctgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggcaaggcctgggccccgccgagccgccgggccttccgcagctgcagagcctcaacctcagcggcaaaccggctgcgcgagctngccaggccganctggcgcgctgcgccccgcgncctgnagagcctcanactcaccgggcaattgcctaggactcctttcccgccgagctctttcgccccggcggcgctgcccntgntcagtgaactggcggntgtgaacaatgcctccgangaactcagccccgaatcgcccaactggcctcgctcaagacgttggacctctcgaacaaccagctgagcgagatcccttgcagagcttgcgggactgccccaagctcaaggagatcacatttccgtngggaacacggctgaggggacaagcgcctggagaagatggtcagcggtgcagacnagatcatcctggagtactgcgcgtgagaggccgtggtggtgggaaggggcaagggcgtgcgagggctcggagacaaggaagaagagccgcgaggaaagaggagggagaaggaagcacaggcgggaaggttgtgcttgtcgaggagcagtgatttggagatccgggcgggtgtgtcagggtctgcacgtctctaaaacccgtaactatgacagtcagagtgagcccgaggtcgggaattcggcctaaatagtggggcctgtgaagatactgacaggaatccccagcggtctactggaacagtcacagactttaaaagagtcacctccacagacgcaaaccgtatccgcaagaaatctgcgaacacaagagaag

SEQ ID NO: 554654 - DNA, 128 bp, Homo sapiens
tcggaccgtcttcatatactactttgatggctacctcaaatcaaatcatatgaacttggggtcaggcatggtggctcacacctgtaatcccaacacttgggaggccatggtaggtatgatgaaggacg

SEQ ID NO: 554655 - DNA, 397 bp, Homo sapiens
  misc_feature (75)..(75): n is a, c, g, or t
ctgggtgcatgatgtggcccagctacttgggaggtgggggggagaatgttgaactgggaggagaggttgtggtgnggcgggattgcgccattgcactccagctggggcaaaagaacgaaactccgtctcaaaaaaaaaagaaagaaaattatacttggttgaaataattttatttcattagatatggataataattttaaggtctacaattttatgttcgcttgtgtatcggagtcggtaaatcataaggatgggcctatggggcattcatttcaatatagtataagggtaacagagcaaagagtatatgaatactcatgatcctaccacatttggggatatagtcggtagacccttttggtgcccatgtgcacacattcacatgcatgcacccagg

SEQ ID NO: 554656 - DNA, 336 bp, Homo sapiens
gctgaatttttttgattgcttgctttatttccctgttacatctttggatgacctatataggtaatcatatcatttgtaaataagaataatggtttccttctttctctcttttcaaaccacttattattcagttttatcttttatttattaacagagcatccagtgcaatgtttaatggaagtaataatggcattcttgtcccattcctcactttactgcaatactgctaacattttataatgataacaatgtttgctgtgggtttatggtaaatactttatcaagattattaagtgttctgtttccagatcataaagtattgtagtttgataattt

SEQ ID NO: 554657 - DNA, 165 bp, Homo sapiens
tggtacccattgtatcgagagaaatagttgtaggcataaaaatgattaaggatctagtataatgagatcaggttcgtcctttattgttgtgtactggttatcatttgattttcgaggttagtttgattagtcattgcttgtggtgggtagattaatacggttgtt

SEQ ID NO: 554658 - DNA, 138 bp, Homo sapiens
ccggagcccgggaagaccgccatccaggactcagatgcaggagccctgctggccacatgcaaggaccagcatctcctgagaggaccgctgggcttaccttggggggcaggatgcctggggacagttcaggacacacac

SEQ ID NO: 554659 - DNA, 183 bp, Homo sapiens
cgcctcctgggttcaagcaattctctgcctcagtcttccaaagtgctgggattacagtgttgtgagccaccgtgcccggttggcagcactaattttaaaaaaatgtttggtatgcttggtaattcatggttgtaacaaaccaacagtatagaaaaatataattgaaagcccctgtcttagtcc

SEQ ID NO: 554660 - DNA, 210 bp, Homo sapiens
aacaggatcttcaaatgcacattagcatggcttctcagcgaaggcatccgtctccaaggctgctcaaatttccgtgtcccatatcgctaatgcgatgagcgacagccctctctgtgtgcatcagcatgctctgtctaccctggaataagcccagctatagagcaaaagaagggaactagaggttcatctcgccattgtgtcaaaggcgtg

SEQ ID NO: 554661 - DNA, 367 bp, Homo sapiens
  misc_feature (3)..(4): n is a, c, g, or t
  misc_feature (82)..(82): n is a, c, g, or t
  misc_feature (101)..(101): n is a, c, g, or t
  misc_feature (111)..(111): n is a, c, g, or t
  misc_feature (113)..(113): n is a, c, g, or t
  misc_feature (179)..(179): n is a, c, g, or t
  misc_feature (191)..(191): n is a, c, g, or t
  misc_feature (226)..(227): n is a, c, g, or t
  misc_feature (254)..(254): n is a, c, g, or t
  misc_feature (283)..(283): n is a, c, g, or t
  misc_feature (291)..(291): n is a, c, g, or t
  misc_feature (307)..(307): n is a, c, g, or t
  misc_feature (339)..(339): n is a, c, g, or t
ttnngcacgagaaatagttcagtacattttttaaagttgtgcagtacatttttgtgaattatcaggagtaaatttgacaagnacatgtgaataacctcctntaaatgaatntnataacaaaaatgtactgcacaactttaaaaaatagttcagtacattttttaaagttgtgcagattngcaattttttgntatagctttgacttttctatgctgtgaattaatanntgcgatttggcaaacagccctgttgtntttgttaaaccctaaattttaagaggaantggcaganttaaaagcagaaacangaagatggacatggattagaggttatgtattntgaagtaaactacaaggtactaacatca

SEQ ID NO: 554662 - DNA, 341 bp, Homo sapiens
  misc_feature (3)..(4): n is a, c, g, or t
  misc_feature (82)..(82): n is a, c, g, or t
  misc_feature (101)..(101): n is a, c, g, or t
  misc_feature (111)..(111): n is a, c, g, or t
  misc_feature (113)..(113): n is a, c, g, or t
  misc_feature (153)..(153): n is a, c, g, or t
  misc_feature (165)..(165): n is a, c, g, or t
  misc_feature (200)..(201): n is a, c, g, or t
  misc_feature (228)..(228): n is a, c, g, or t
  misc_feature (257)..(257): n is a, c, g, or t
  misc_feature (265)..(265): n is a, c, g, or t
  misc_feature (281)..(281): n is a, c, g, or t
  misc_feature (313)..(313): n is a, c, g, or t
ttnngcacgagaaatagttcagtacattttttaaagttgtgcagtacatttttgtgaattatcaggagtaaatttgacaagnacatgtgaataacctcctntaaatgaatntnataacaaaaatgtactgattttttaaagttgtgcagattngcaattttttgntatagctttgacttttctatgctgtgaattaatanntgcgatttggcaaacagccctgttgtntttgttaaaccctaaattttaagaggaantggcaganttaaaagcagaaacangaagatggacatggattagaggttatgtattntgaagtaaactacaaggtactaacatca

SEQ ID NO: 554663 - DNA, 420 bp, Homo sapiens
aagaagtctcccggggggatttctctgtgggcaggtgtttttgaagtcccccccgcgggtgaaaacttcgggttttgggtgcgctttttctcccgggtcggccccccctccctgtcccggggataccggggccttgcccccgcgggcgctgtccccccgtgctaccgggacttgggtgcccggccccgggcccgggccccctcctttctgttcttgagggtgggggagttttcggcccgccggtgccgccggccggctgtcttgcagttccccggctcctggctcgggtttccgctgcccccccgggtcttgcgccgtcagccccagccccgtttctcctccgaggggcccccccccttttttttggtgccgggcccttgtccgggtgtgccccaaattaaatcaggaacgccccggtta

SEQ ID NO: 554664 - DNA, 621 bp, Homo sapiens
  misc_feature (578)..(578): n is a, c, g, or t
  misc_feature (580)..(580): n is a, c, g, or t
  misc_feature (616)..(616): n is a, c, g, or t
tgggaggattgcttgagcccagtagttcaagaccaaactgggaaacatagtgggaccccatctttgcaagaaaaaaaaacaaaaaacaaaaaactggctgggcacggtggcttacgcctgtaatcccaggattttgggaggtgggcagatcacctgaggtcaggagttcaagaccagcctggccaatatggtgaaactctgtctctactaaaaataaaaaaattagccgggtgtggtggcaggcacctgtaatcccagctatacgggaggctgaggcacgagaatcacttgaacctgggaggcagaggttgcaatgagctgagatctcgccattgcactgcagcctgggcaacgagagcgagactccatttcaatgaagcaggagaattgcttgagcccaggagttcgagattgcagggagccatgattgattgcaccattgcagtctagcctaggtgatagagctaataattacgttatagaagaggcattaacttcaagataactaaatgaaagcctggtattaacaaattttaaaaaagtacaaataaataatgatctaagctacccagattagntnctggaatttgttaaccaagacaatctccaagggtangctat

SEQ ID NO: 554665 - DNA, 630 bp, Homo sapiens
  misc_feature (606)..(606): n is a, c, g, or t
aattcggccattatggccggggaaatcgtttttgaggatccaaggttcccaggagggaagcatttggcctatcaaaactcctggggcctgccacctggacctatgggggttatgaccatggttaatggggccaccatgggttaagtattaccacccggggtagcatgtgttcaggtggggattattccttggggcattaccaaggcactttctgaagaggccaaagaagcgctgattgcaaaaggcatggattatcgaaggcgattactcagggttaacatccgcgttagagctgatttacgagataataattctccaggttggaaattcaatcactggaagctaagggaagttcccattagactggaagttggcccacgtgatatgaagagctgccagttggtagccgtaagacggaatactggaggctgccagttgctgaaattgaggcagagactaaacttcaggctattttggaagacatccaggtaacctttttaacagggccttctgaggaccttaggactcatatggttgtgcttattccattggaggactttcagaggatcttagattctggggattgttcagattccattctggtgnggttgactgtgaggactggttctt

SEQ ID NO: 554666 - DNA, 163 bp, Homo sapiens
attttacattcaaatacatagtctaagagtttttaaattaaattcatgtcatcattaccttattacctcttagaatatcatgtaccagatgggcactcctcccacctccccagtactttatgacagcatttcaggtggaagcagtcttatttaccataacaat

SEQ ID NO: 554667 - DNA, 252 bp, Homo sapiens
agctcgatcagagctaggtttaggtatcagggtctgctggcctggtagaatgaagttaggaagaattccctcctcttttattttctgggatagtttggagagaatgggtattaattcttctttaaaggtttggtagaacttcagcgagtaaagccgtctggattttggatttttttgttggttgaaagacctttttactacatgattcgtctctcacagacttggtaattgggtctcatttgtcgttttctg

SEQ ID NO: 554668 - DNA, 452 bp, Homo sapiens
agctaatacagctatactgatttcttccctacctgttcacatccgtaagatttaggatatacattttggataggtagtctgtctgatacaatgtaaatgacaaaacataattcctgagaggcccagaacaaactggagtctagcctggagttaaattgagacttctaaaatgattggaacaaagactaagtcgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccccctccccgggatacag

SEQ ID NO: 554669 - DNA, 150 bp, Homo sapiens
tgcactgcgatacagcatcacaattcctagttatatgcacatcataaactttatcaactctaactatctccattagaaactgaaggagctaaggcgttcgcctagcactatataagtagtgagagtacatgctcagactttgtaccctgt

SEQ ID NO: 554670 - DNA, 323 bp, Homo sapiens
ggggggggggaaaaacacccccccgcaaaaaaaaaatatctttcccccctcctgaggggggggggagaaaaaaaaatctttggcccccccccccacatatattggggggttttttttttttttcccccaaaaaagagggggtttttttttttaaaaaaagggggggggggggttttccccctttttttccccccccctttggggggggggggggggggggttttggccccccggggttccaacaattttttttaaaaaagggggggggggttttttttttccccccccttttttaacctttttttaaaaaaggggctttttta

SEQ ID NO: 554671 - DNA, 913 bp, Homo sapiens
  misc_feature (386)..(386): n is a, c, g, or t
  misc_feature (802)..(802): n is a, c, g, or t
gagaatattccaccagggtatgaagttagtatctcttctggaggccctcaatcggggcccctcacgcccgatccccagcagttccgtcgcacttcacgtgcttggagatggtcacctctcaggaatgctcccttcatatgggcacgtgatgggcaacctggccccccgtcaggactgactctcgcctcattgtatcggctctgtctgacagtcagcatgtcagggactcaaactcaaaaaggagtcgtctctcgagatactccagcattctcctaagaatcgtctttcccagtgcctagcatttacagaagtgcaagcactgatgcaattgcgctgtcgaggcgagatcgtgacgactagcagctctcgtcagagtagccggtcgntatcagtcaatcatcgagagtacggaagtggtggatgctgacgtccaggaatagctgagcacaatcatcaagctgttgcatcggtcactcatgcgaggctagtctgacccacgatcgaatctgcgaacaccaagcgggagcgtcgctcctggtccatcccagcttaatctctccgtacaccacagtagcaggctccctggcacaggcacaggcaggtcgtgtgagtcgcgcaaggttcactgatcagtgtatccagtgggcagttccgtctcccagcaattcgaggccaccgtgatcaacgcgaatccgtcacttctcgatgatcctgggccttccattaacagttcgtcctcgctggtccacttgacacgagggacggggaggaagggcatcttcgtcgctttcgcccctctagnccctgtcctagcagaggtgccccccgtcaaggaacgacagggaagaaggggcgctgccaattcgggaggtgctccaagacgagcaacctttgcctggccctccatactggc

SEQ ID NO: 554672 - DNA, 170 bp, Homo sapiens
aattccatgccagcgtagcagcgtacatacacacatgcacacacacacacagggtatatatattatagtagtgcattatatcgtagtatctttatatatgcattattggggggagcagttttagattcacagaaaaattaaatgaaagatacagagacttctcatgtacc

SEQ ID NO: 554673 - DNA, 131 bp, Homo sapiens
agtacccggtcactgcgtacgcttactaggttgatgttggtttacgtcactggataagtattataatagagctacttagctgtggttattaatacccttctgttaacaatttgcaggcaaacttaatggcc

SEQ ID NO: 554674 - DNA, 266 bp, Homo sapiens
cagatggtattgacccaagaggaactggcagacttcaatattgcaactatgggtccattctgggcttccccaaggcgaagccctattaagtgaagcatcttgcgaggcccgactgtggacatactgattcctagttgcgcagttgcatgaatgcagttgcacctaatccagactgctccctagaggtctataagcctgagatcatttcctatacggtgccatatgggccatctactcctggaagctgactagatcttccttggagc

SEQ ID NO: 554675 - DNA, 342 bp, Homo sapiens
  misc_feature (33)..(33): n is a, c, g, or t
  misc_feature (97)..(97): n is a, c, g, or t
  misc_feature (130)..(130): n is a, c, g, or t
  misc_feature (132)..(132): n is a, c, g, or t
  misc_feature (187)..(187): n is a, c, g, or t
  misc_feature (189)..(189): n is a, c, g, or t
ctctgaggaggctgccacagtgaagcaaccgtnacaagtggtgcccgaccagggacctgaacgaggaaggtctgccagagcagagaaagtgaaactnatcagacgaactacgaacccctggacgggagantntgccggcggagaatataaggagatggacaaaccgtgtgggtgccctccaggtgtntntgaccatggaacgggagaccggagggttccatggtattcaaccgtgggcctgttacctccagtacgagccatgagccagcggaatctgaatgcaaagacagaacaagggccgaccggagttcacaatgacatccaaccccataaacatggggg

SEQ ID NO: 554676 - DNA, 994 bp, Homo sapiens
gggtaaggctgcgagagtgaaagaatgctgagcgccggtgatatacattctcgagctctgattcgcttgtgtaccagggtctactcagggctgtgtttgtcgcctctcgtttggctagcccagtgcattcagtctccaacacgcctttcgctaccagggtacgtgccctagttcgcaggtggtccggatgggcgttgtcgccagaacccaggtgttcgtgcctcccgctctcttggctcgactggccgttcgctctttgatgggtgctgggggcagcctacgacttggtgttggcctgtggttcggggtctcgggggcattggggaagcctttgttttcggccagcttgcctcatttgggtgtagtgccgaggaaacgactgattctgaggacagcagaatctttcatccattaggcccatgctatgggtaggcaccttgcgctgaagcgccatggggcataatctgttcagatcgtggcggccagagaaaatgttacatgcggccaatggtagagcgttccaatggtcaggatcagacgacctagaggcctagtggggattccataaaaccgttgctttgccggccgcgggtgtgggatagcgctaactccatttaccctggaaggttacgtcggattaacccaaaacactgagtgattgggaagttggtttgtgtcgtggatttctggcaaggaataccggttaaccataatagggtgaagaggtgggcgtcctcccaaggagcttgcattggttggatttggtggcgaaacatggcagcttcaagtggagcatgtgtggagtgttccacaattgacagggcgtggtgccccgcgtttggtccagagaattgcgcttggcttggtgcattggggcaaacacaagcggggtgatgcaaccacgcgcaagaggagaaccagcgatgatgacaaggctcttcatatgatgacactacgctcacacagagaaggtggaaaaacaacactatcaaga

SEQ ID NO: 554677 - DNA, 145 bp, Homo sapiens
gacctccagccgagcatccttcatgagcctgcagaactgctttcgtatgtttacccaggggacctcctttcagatgagctgggaagagatggaatgttttttcatatttaaataaataagcccattaaaaagcaaaaaaaaaaaa

SEQ ID NO: 554678 - DNA, 210 bp, Homo sapiens
  misc_feature (5)..(5): n is a, c, g, or t
  misc_feature (87)..(88): n is a, c, g, or t
  misc_feature (122)..(122): n is a, c, g, or t
  misc_feature (148)..(148): n is a, c, g, or t
  misc_feature (154)..(154): n is a, c, g, or t
  misc_feature (162)..(162): n is a, c, g, or t
tgtangaagcgctgcgtcaaccctggagactcagttgaattatttttttaaagtcccatgtgggttaggattggagttggactagtnngatggtttgaaggattaggcagcactgccagcgncttctcatgcatgatgtctgtgcatnccttgnatatttgntcccttctcctctgtagacacattggcattgttcacacctagaattcc

SEQ ID NO: 554679 - DNA, 772 bp, Homo sapiens
gatgtttgattatgtttatcttgtgcaagattaagtcaagctaattaacacatcacctcatttactgtatcatttttgtggtgaaagcatttaaaatctggttgtttagccatctagaaatgatatatgcattatggtttattgattggtcatcatgtctgtacaataggtcactgaagcttattccttctgtcagctgaaagcttggtacccttgatcactctctcctctttctctacccacctggcttcccccagcctctggtaaccaccattctacgctctcgaacttcttgtagatttcacatataactgagatcatgcagatgtgtgtcgtttctgtgtctggcttatttcacttggcctaatgttctccaggttcactgaagcaaatgacaggatttccctcattgtaaaggctaagtcgtattccattgtgtacatacaccacagtttttttaatccattcatctgatgtgggacattgaggttgcttccatatcttaactatcgtgaattacatttcaatgaacataggagtggaaatatctctgtgggcataggattctcaattcctttggcatatacaccccacatggtaatcctatgtgaagttcttctgaggaactcccagtactgtatttccatagatggctgtattagtttacgtttcccaccaacagggcacaagggttcactttgtccagtacccacaatcaagcttattatgtctttgcgataagtagtaatctaacaagtgtcgatgatatatc

SEQ ID NO: 554680 - DNA, 244 bp, Homo sapiens
  misc_feature (244)..(244): n is a, c, g, or t
ggcattcctgaaggatccaccccatgacccaaacaccacccactaggcccacctccaacattagggatcacatctcaacatgaaatttggaagaggacaaacttctaaactgtatcattgtcctaacaaaaagaaccagtcagatcatcaaaatcaccccaaagcattacccaagtggggcttttccctgagccgcgcataagagaaagtgtctgcatgcgctatttcagtcgcgccccatgtn

SEQ ID NO: 554681 - DNA, 564 bp, Homo sapiens
cggccatctttatgcaaagtgtctatcaagctggctggattgtaatatttcacacagaatctatacccaccagagatgatgtccggagctacggggtgacgagggagtatgatgaccttatggatccaagccatatgacggaatccgccagcgagaccctccatccggaaaaggagaacgcctccctcagcaccatatgtaccatcgatgtctcaatgatcatggtcaagtgctggctgatagacgcagatagtcgcccaaagttccgtgcagttgcatcatcgaattctccaaaatggcccagagaccccagcgctacaccttgtcattcagggggatgcaaagaatgcatttgccacgtcctcacagactccaacttctaccgtgccctgatggattgaagaagacatggacgacgtggtggatgccgacgagtacctcatcccacagcagggcttcttcagcagcccctccacgtcaaggactcccctcctgggctctctgagtgcaaacagcaagcattccaccgtggcttgcatagctcgaaatgggctgcaaaggtgt

SEQ ID NO: 554682 - DNA, 1679 bp, Homo sapiens
ttgagtaggcgccgtgtgctgctgtccgtgtgtgttcgtcgtcgggggcggatgttgttgaccccgcggcgccggtttggccgtctgtggcggctgttggggagcaccgtgaggcgcggtgtgtgtcccaaacgcgcggtggttccgccgttcgccggttttcccggcggaatgtcctgtcgaccccaccgtcttcccggtctgttcgctgccctccgggggggtgtttttcaccacaggaggctgtgggtttataaccccgcgggggttcactctcttgggggagattttgtcgctcccccctcgcttgttgcttctacaggatgagttgtcccccacagcacgttgtgttgtcggccagaagtgcgtgttggcggaaagagatagtgctctcggtcggcgcgctgtcaccgagagagattggtggcgcgcacaccgggtttgatatccggggggaaatgtggtggccacggcgcccgccctgttggtgcgcggggggcgataattaaggggggtgtcgtcagccgcttgggggaggaccttctgcggggggtggacaacacaacaaaggggtgggtaggcaccacccgtcctgcccctctgttagggcgagcgcaggtgagagcacggcgctgtccgtctgtgactccttgtcgtcgtggaggagaaggatgttcggcggttgtgttgagcagcgcaccagcgcagcacgcggggcgccaaacacaactgggtggtgagaaagagggggcccccccccggccagctggccgcctttttcaggggggtcccgcgttttagcccctgttgtttctcgccctcctattataatagagggccgcacccaccgcgggcctgtgagttgtttcgtccggggtggttttggcgtctgtgtggtgtgccgcacaaaagggggtgtgggggacgcatcttcttggggggccttcttcggcccactacacttgggcgcgggtgttgtgtgttgtgtggagaataaagtgtggggagaagagacagtttttcacggagaggggaccccccttctgtgggagagaacgcacccggttttagggcgcccacttttggtgacgcgcctctgtgtctcgacgtgaagacacactctgtgtggaaagaagacactatcttacagttggcgtcccacatgtgttgattgttgtgagacacacactgtctccacagcccccaaagcacctctggggcacactctttattgtgtggaagagcgtctctcctctctctctcaccctctttatactctgttctttttctctctctcttcttctctctccaacactttctctcttatataagtttctctcattgcgcctttgcgcacgctggggtgtgtgtggtgtgcacccacggtctttgtggtcttctccctcccccacacctttgtggtgtgggaagatgctggggcgccagatccctgtggtccaagacaccacatccattgtcccctgcgccacaagtggctgcccagagaatagttgttgctaacacccacccggttttttgtttgatttgggagaggtcaagagcccaggcccccccattggcttgaagaggcaccatatttccagaacattttttttttgtgcacttggggggtttatgcctttctatatttctccttattaactccctccaccttttta

SEQ ID NO: 554683 - DNA, 186 bp, Homo sapiens
  misc_feature (1)..(1): n is a, c, g, or t
  misc_feature (21)..(21): n is a, c, g, or t
ntcgtatgtcaccgcccaggntcttttgctgcgggacatacactgcaaaatagataaagggaatgaaatacctagaaaccaacagacactgctagcaagaactggcagctccaagaaactatcaagaaaggagatctgctactaaacagagttcaaaaactttccagagtaattattatgtaaagc

SEQ ID NO: 554684 - DNA, 137 bp, Homo sapiens
aagataagtagaccactccctcctcagctagctggttccggtcactgccaccacgactctatcctgtaattacttctctctaagcacccatcttcctcactccactgtaacattcaagattccttgtggcaggggct

SEQ ID NO: 554685 - DNA, 156 bp, Homo sapiens
tacttttccacaggaaagaaaagcttcttacatggcagcacaagagaaaaatgaggaagaacaaaaagcggagaccctgataaacccatcagatctcatgagatttattcactatcacaggaatagaacaggcccctttgattcaattacttcccc

SEQ ID NO: 554686 - DNA, 770 bp, Homo sapiens
caacctgaccaacatggagaaactctgtctctactaaaaatacaaaaatactaaaaatacaaacttagccaggtgtggtggcgcatgccttgatcccagctacttgggaggctgaggcaggaggattgcttgaacccgggagacggaggttgtggtgagccaagatcgtgccattgtattccagcctgaacaacaacaacgaaactctgtctcaaaaaaaaaaaaaaaagaaaaggtcagccaggcggaggggcctcacaccgtgttaaccccagcacttggggaggccaaggggggcagatcaccgtgaggctcggaggtggcatcgcgtgcactccagccggggcgacacagcagggctccatttaaaaaaaaagggccaggcaggggggcttcacaccgtgtattcccagacacttggggtgggccgaggcgagggggtcacctgaggtcaggagttcgagaacagccgggccaactgggtgaaacctgcgtctctacaagaaatccaacaactcggcggtgtgatggcaggtgcctaaaaatccccagctacccaggaggccgaggggcgggaagaaatgggctgtgaccccgggggaagcgggacaggcgggggagggcatgacgggttgcgtggaccgaaatcagcccattcattcagcctggtgagaggcacacttgtccgaaacaaaataaaaaaaccgggatatgggtggggaaaggtagacggcatgccacggcggacctcgggaggggagcgccagggt

SEQ ID NO: 554687 - DNA, 239 bp, Homo sapiens
  misc_feature (59)..(59): n is a, c, g, or t
  misc_feature (61)..(61): n is a, c, g, or t
  misc_feature (66)..(67): n is a, c, g, or t
  misc_feature (76)..(76): n is a, c, g, or t
  misc_feature (83)..(83): n is a, c, g, or t
  misc_feature (95)..(95): n is a, c, g, or t
  misc_feature (107)..(107): n is a, c, g, or t
  misc_feature (126)..(128): n is a, c, g, or t
  misc_feature (150)..(150): n is a, c, g, or t
  misc_feature (153)..(153): n is a, c, g, or t
  misc_feature (166)..(166): n is a, c, g, or t
  misc_feature (188)..(188): n is a, c, g, or t
  misc_feature (203)..(205): n is a, c, g, or t
caaagttgacctcaagataacatttttcattaaagcatctgagatctaagaaccaattntnatctnncatgttatnagctcantcacttattttnataactaatgancacagctattatactactnnntcgttattttgtgtgcatgccncanttccctgacttanacctcactgagagcgcaaaatncagctttatactttnnnctttcaattgcctagcacaatagtgagtacattt

SEQ ID NO: 554688 - DNA, 383 bp, Homo sapiens
gaggcggaggcgcacgatgcctggagttactgtaaaacgacgtgaaccatgcaggagttcgtcatagctctggcaggcttcctcaaaacacgtccgggaatctgttaacgtccccgaatgggtggataccgtcaagctggccaagcacaaagagcttgctccctacgataagaactggttctacacgcgagctgtttccacagcgcggcacctgtacctccgcggtgacgctgatgttggctccatgatccaagatctatggtggacgctcagacaaacggcgctcatgcccagccacttcagccgaggctccaatagtgtggcccgccgggtcctccaatgccctggaggggctgaaaatggggtcacacggatgtctcgct

SEQ ID NO: 554689 - DNA, 115 bp, Homo sapiens
gggaggaagagccgagaaactgtgtgaccggggcctcaggcggagtgcattttcggggtcccttttgcagatgccgattggcatcaccggtgcaggccatttgagggagcgggat

SEQ ID NO: 554690 - DNA, 164 bp, Homo sapiens
atgagtggaagtgccctgttctccccacattctcctggaagggcggcagaggctgctcttctgcaggtttatgtctcgagtcaaacaccgcagcaatcaccagatgcactccatgattgcagctcacaaatgggcttcatgctcctgaggactcatagagcacg

SEQ ID NO: 554691 - DNA, 560 bp, Homo sapiens
  misc_feature (258)..(258): n is a, c, g, or t
ggcagttcggcggtcccgcgggtctgtctcgttgcttcaaggagtgtcgggacggaagcagagtccggggactctcgttccagcactccgatacgccctccgatttgccctctcgcggcttgcaatctccggtgagccatacttctccggccagtcgtgccgtagcttcgtggagacactgcgcaggcatgcgccggttgttgggttagacatcccgtcgttggccagaaccaacgcgatgcagctgcccagtattcngtcgaggaattcatgtgccacccgacgatggaggtcatgccgtcatagcagcgctggatacaatctctgtaacctgtcaggccttcctgacagctaacactcgtctctgaggctgtctattttcgaccgcgatcgatgtggctctggaaggcgtgagccactgtcttccgcgaagtggccgaggagaagcgcagagggctacgagcgtctcctgaagatgcgaaagcagcgtgggggccggctctcttccaggacatcaggaagccagctgacagatgacgtggggtagaagcccagatcgc

SEQ ID NO: 554692 - DNA, 408 bp, Homo sapiens
gggttctacccacgtccaggcgcatggccaggccccggcaaactttttttgctctgaccaacgggggcttctcctgtcccgcacgttgtgcctggcccggacctggttcaaaacaagggggcctgcagcaggcgggtgcggcatctcggccgggcgtggcaggcagggcactgggccacctgtgtcctgcccccaagtccccgcccttgcatgaccttgagccagctcctcatcgcctctgcacctcagtttcgtggtcagcgcccagaggacaggagaggactccatcgcgatccgtcccggggctgaccgcgcagctcgcccggcgcctcgagtgtgcttggcgaaatgactgcgttgcgcccgtggagtgaagcagatgtggggtgcgtgagggagggacacgcg

SEQ ID NO: 554693 - DNA, 719 bp, Homo sapiens
ggtctgcaggagatctacaagcgcattgaccctcgggcccaagccccagtgcctggcaagggcccctttggagcgagatggaacttctgagtgcgcaaactcatccacgatgtgctgcgtgcatctggaagatacgcgactggggcagcttcagagatgtgctagtgctgctgatgacagatgtactggtgtttctccaggaagacggagcagcagtacatctttcctaccctggacaagccttcagttggtatcgctgcagaatctaagtcgtacgagacattgccaaggcaggagaaccgggatgtatcgtgatcagacgcagacccacctgagatgtcacgaggtgcacacagcatcccgggatgcaccgtgagcaccgtgcatccggggtcattcagccagagcgtgcgcacatgcccatccaagggaggactatcacccctgatcgagacagcaggatgaggcttaccctgcgagcgaataaccgatggagtatgcagcacagaaggaacagggcacatggtggagctgctgacaagagaaggtccgcgatagatatggctgcagcatgacaccaatatgccagagcacgaaagacggatcggtgaccaggccagactggacacgataccgcaagcaagacccaaagaggacataaaacgatcataaaaacacaatgaagacaacaacatggcaagacgacatgcaggagagat

SEQ ID NO: 554694 - DNA, 467 bp, Homo sapiens
agatgcaagtgattctacctgtctcagcctctcaagtagttgggattacagttgcctgccaccatgcctggctaattttcgtatttttagtagagaggggattgtcaccatgtggccaggcgggacttgaagtcctgacttcagatcatctgcctgtctcagcttcccaaagtgctgggattacaggcgtgagccactgtgcccagctgagatctgatggttttaaaaagaggagctccccttgcatgagatctcacttttggcctgctaccatttatgtaagatgtgacttgttccttcttgccttccatcatgactgtgaagcttccccagccatatggaattgtaagttcaattaaacttcttttctttgtaaattacccagtctcgggtatgtctttatcggcagcatgaaaacggactaatacagtaaattggtaccaggagtgggatgttctgaaaagata

SEQ ID NO: 554695 - DNA, 402 bp, Homo sapiens
agggaagggtcagtaggcagaagatgtatgctgtgataacatcttctgcatcgtgtgacaacgggaacttctatcacaggctctggggctctgaagaggtaggcggaggaccacggcgatggggtacaagtgtgaacgtggcatggcaccggaggtgtggacccccccattggagacgtggagtagctaacagccttcaggacagtggtgatgcccatagaccacgatgtctcacctgatgtggtcctagtcaccgccgggcttgatgctgttgaaggacatctgtctcctctgggtggctactctgtcaccgacagatgtctcggccacttgaccaggccgctgatgaccccggcagggacgccgagtggtgctgacgctgcacgggggcgatcctctaga

SEQ ID NO: 554696 - DNA, 922 bp, Homo sapiens
cggccgcccttttttttttttccacctgccccatgcctttgggttggtgaccccagaactctgtgatcccccaggtccatggtgctgctccatccgcccccctcccctgtgtaacgcgccccatcctgtgtgtcccagccttttgagccaaaaactgccaggcaggaccagctggggcccgtgcgggggcacccatcaggcactcacccgtgccagatgtatgtggcactcacatgtattaacataaggctcgccagagagccaggatctcaaggtcgtgaacagcaccacacgaaaaacatctaaaacaaaaaaaaaaacagggcgccacgatacaacaaatatcacacccggaagggcccacaagataacagcggtttaaccccgacgcctttacctgtgataccccaaccaggtgtggctccaccctaaatcaacgcgtacaggctcgctacctatttacatatcaacggccaacgaccgttactgagggctccgtgtcctgtcttattacaacaacatcgcttacgcagtcgccttcctgccgacaaacacgtgggcaacagcctagcgcggaatctataccaggcaaacagggaccacccacacaacccaccggccggagtgcccacacaaaaaaagtgggcgccgcgaacgagatcccaccgacgcgaacgaatcctacagagcaggctccctaaacggcgacaacactaataaaacgctattacgtcacgagcggacacaacacggccgccaaacaacccacagccccggcccactcatcgctatgaggcgcgatctgcgccaacacagcatctgaggcgccccacgcgtggaacactaactggacaatagaaagacgaacacagcgtcaaacgtaaacaacaccacgacagtagcaacgctaccacgacacaaa

SEQ ID NO: 554697 - DNA, 646 bp, Homo sapiens
aggaaaggccgggataaggagtgatgcccgtcaccaagttggccgctgtgtcaaggaacatgaagatcaatgtcccgtggaggagatcatatctcttctccctgcccattagggaatcagagatcatgtgatttcttccgtgggggcctctctcaaggatgaggtttggaagattatgccagttgcagaaagaagaacccctgttgcctggccagcggcaaccaggttccaaggggcatttgtgtgcgctatgcgggggactacaattggccacgtcggggtcgtgaggtgtaaagtggctccaagagggagttttggccaacggcaaattcgggtggggggccattcatccgtggccaaagctcctccaattcgtccccgtgcgcaggaggcgctacgtggggggacacacggactcgggcaaagcccccaagaagtttgtcccttttggcaagggtgttggaccaggcccaggatttgagggatacgaggtagtggagtaacagccattcattccccttggcaacccacagggggccagttgggagaattgggtcctccggagaccttggtggcctaaagaaaagctggcacaatagattgggagtggaaattcagtagatgtgataacacctcaagcccgggg

SEQ ID NO: 554698 - DNA, 243 bp, Homo sapiens
  misc_feature (95)..(95): n is a, c, g, or t
cagtaattagctacttaagtattttctatgcttcttctgcagagggccaacagatatactgtttagtgtcttgtcacaaaataatattataactntatattagaacgtatatttgatataaactatgttataataaggatcgaatctgattgaaacagaataacacagtgggcgctgagattagcgcaacttattcctactattatacttcttccaagaacagtcagtaagtactcctcaacg

SEQ ID NO: 554699 - DNA, 110 bp, Homo sapiens
atgaggtgcaagcgaggaggagaagagggaggacaaggaggacgaggaggatgaggaggatgatgattgagccatgtggacgaggaggactgcctgggggcggcagaggg

SEQ ID NO: 554700 - DNA, 273 bp, Homo sapiens
tttttttttttggccaaagtaatggggttccacccatggggaaacaacccaatcttttttttccttgttccaatggaggcaaaaaagcccaggccccaaggtttttggcaggggttttttaaatttccagtggtcccagctcccccccctggccctgccccagcctgtgtagttttttctgcatttggattctgcatttttggtttggggtttggattttgccttgcccccctgcctttcccttttggtaaaataaaaaatttttaatgccca

SEQ ID NO: 554701 - DNA, 174 bp, Homo sapiens
gtgtggtgtgagggggctagagatactagggaagttcctctcccggtgaggaaaggccccttctggctagtagtgagagggctggtctggaagtttctctcccggtgggaaaggctctcctgggtgtagtagttaggggctggtctggaagtatcgtctacccggtgggaaagg

SEQ ID NO: 554702 - DNA, 1056 bp, Homo sapiens
gcatgcaaggtaccacacactgtctgaatttcgcacgaaaaagtgattgtcggatcaggtgatagccccggaatgtagcagtgtcttgcgtgctgcaagatgccttctagaggctgacactaccttgggaccctacatgtgggcgatgagagtatcagcctctagcccaggtggttgacatgacgcactccctttggagaggcacttgaagggtataggggagtggtatgtgtctatcttctaatggaaatagcacatgagtggttgatacgcggatgtaagtactaaaggctgtatctaagaggtgtgattgataattagagagaatgaccaccacacggtagaagctgaataaaaggggcgtgctgggtagagcatggtagagagctcatagcagaactagttaggaaatggggactgtatctgagttatttactgagtatcaccggtctccagcttattgataggcgcagagtcttgattacgagggatggagacacgtgggttcacttttcctgtgatcgtgggatggtcgggaaggaacttcatcatttatctttgggctcgtagtctggagactgcagatggctgctaaactaagaactatggcttcgcattgagtggaattccggagccgtggtggctctcccttatgtcccggagctccgtatgtgccgtgggcaggccggtctggaactgactagtctcgaacgtgtcgcggggttgttccctggaggtcttgctctctagtattgctccgaaccggccgtccgtcgtctggacgcgacgagtcctagctttggtactactggcgttggaccagctcgtgtcgggaaagagctcaagctcccactcgtacaacagagtgagtaggagccaaaaggcatgaggtctccggggcggcaaggacagtgacacccacttttctcggaccacggcgggctctcaaaccggcgcgaatgccctgacggcgagaacacggaccaacgggcatgtgaacaacgacattggaagcagaaaagtgacacgaaacaagaaacggaaaatgaaaagaac

SEQ ID NO: 554703 - DNA, 378 bp, Homo sapiens
gtaaatgaaaagggtagcctgtacaagactgacaccccaagaaatcactgatcttatagcttggatcctgaggggactcacatctcctatctgtgccagagacacgggtacctgccatctttttttccctagaatcattggaggtatcgaccactcgctgtacacaggcaatctctggtatacacccatccggcgggagtggtattatgaggtgatcattgtgcgggtggagatcaatggacaggatctgaaaatggactgcaaggaggtaagaaaaccaagggagagcctgggaacatacgggggtaggcagtacaatgtgaaggaagactctggttatcatgtcgggacgatgaggcagacgtaatacgtcctgca

SEQ ID NO: 554704 - DNA, 89 bp, Homo sapiens
aaaattaacaaataaatattctaaactgtataggctacagggacaaagggtagaatatttatttgttaattttattaaaatgctttaaa

SEQ ID NO: 554705 - DNA, 340 bp, Homo sapiens
agatggtcatcaacgtataagcgccactgtgggacaggtagtctgttgcgaccgttcgctcgccagtttaaccgtcgaacttgactgcgccctaacgccacgctgatgacatgcaggacttctcccgtcgccgtatcgctgtgtatctccaaacccggcagatacatgacctgggccacatgctcaacagactttgcctgccacactcgtaccttgcgtccacgctgcccagtgccatggtagaaataccgatcgttatccgcaggccccgccttgcgcagcacctgggtgacttggtgcaattgattacggtcgtcccatgtcatcctcgggttgcttt

SEQ ID NO: 554706 - DNA, 442 bp, Homo sapiens
cctgaggattcagtcccttctctaaatcccacaggtccacggggaggtaattgaatcaagggggctggtctttcccatgctattcttgtgatagtgaataagtctcacgagatctgatggttttatcaggtgtttctgcttttgctgcttcttcatttttctcttgctgctgccatgtaagaaatgcctttcacctcctgccatgattctgaggcctccccagccaggtggaactataagtccaattaaacctctttttgttcccagtctcaggtatgtctttatcagcagcatgaaaatggactaatagtaccagtagagtggggcattgctgaaaagatacccgaaaatgtggaagcaactttggaactgggtgttgaactaatctggagggctcagaagaaggaatggagggtggacaggtcgaccatacgtgaaggca

SEQ ID NO: 554707 - DNA, 330 bp, Homo sapiens
cacgaggaaccgcgaaggggcggccaccctcgagttgaccatcggtcgacacgacggcgggctggtctcgaaccatctgtacgaccacgcccgacgcggcatggtggtcggactggccggcgtcggcggcgatttcgtgttgccggacccgcgcccgcggcgcgtcctgttcgtctccgggggcagcggtatcaccccggtgatggcgatggtgcgcaccctggtttcccagcggcatcgcggcgagatcgccttcatccactacgcgccgaccccggccgaggcctgctaccgcgactaattggtcgcgctgccgtcggtgcgggtgtt

SEQ ID NO: 554708 - DNA, 176 bp, Homo sapiens
cgaccagacacttgacaggcacaccggcactcagaagacactgatggcaacccccagcctgctaatccccagattgcaacaggctggcttcagtggcagctgcttttgtctatggactcaatgcactgacattgttgccaaagccaaagctagcctggccagatgcaccagcctta

SEQ ID NO: 554709 - DNA, 200 bp, Homo sapiens
ggcagcctgggcctgccgctgggggtgatccagggacagaacctggcgctgatgctggaaagcaaactggcccacgccagcgatacccgtgatttagacaagctgccgatccccttccgggccgtggctaccgatatcgccagcggcgagaaagtggtgtttcgcaagggccacctgccccaggtgatccgcgcccgcat

SEQ ID NO: 554710 - DNA, 758 bp, Homo sapiens
cggtgaccgcggcctggctgctcggacccgggaacatgatggtcgctggagcagaaggcgctgagaagggaccacggcggcgctgggtcgtgctgagccagtagcgggctgaaacgtagaggccagaaccaggtctcagggtgttgcactagaatgtgctgtgtctggagtgtaatccccacacctgcttcctcctggaagtcatgtgcttggcctgtggatgctccctgtatccatgtgactgtgtttgtgtctgcctctgtgcctgtgctgtggatccatatgtgtctctgtggaccctccctgtgtgactgctgcctgcctcccctgctgcaccataggccctgggagtacggctgtccccacagcttggacctggcagtggtgctcgtgaaatgttatgtcaagtggataaatgaccatggcctgtggtctccgcgggaggtgaggaaactgaaagccacctgaggaaaagggggtgctgctccttaatgaagtgccgcgtgtcactgtgtacgtatcaaaagaatggcgtgactgaagtagggatggggacctgcttgatgaccctcagaccctggactgtaagtgaagatgaggtgccgtgaaggggcaacccaggacactgagtcctgaaaggcaaggaggaacttccataaatgaagtggcgcgaaactccttcctgcatattgctcaagcggtcctatacacgatcaagttcttcccaatacccaactggggatcctgatttcaatctc

SEQ ID NO: 554711 - DNA, 660 bp, Homo sapiens
gcttgcgaggtgatcagaaggcaaagatgtcggagcgaaaagtattaaacaaatactacccgccggactttgacccatcaaagatccccaaactcaagctccccaaagaccggcagtacgtggtgctggctgatggcccccttcaacatgaggtgtaatgacgtgcgtgagaatacatctacaaggggaagaaattcaatgctcggaagtgagactgtgtgcagaacgagtgtctacctgggcctgcccatcttccgcttttacatcaagtgcactgctgctgcctggcagacgatcaccttcaatgacagaccctgaaaacacagactacaccatggatgcatggatgccacagctggaatttccagtgcttgagaagctcctgtgagtgagtgacgtgacgaagagggtgcatgaaggatgcggggagggactgagtgagctgaacaaccccatgacatggtgctggatgaacctggaccaatggactccaatgctggagatggaggtgcttggagaacctccaggagctgaaagacctgaaccagctggcaggcgcacgtggacttcgaggctatgctgagtgcagccaccgcctgtcggaggaggagcgtcggaggcagcagcatgaggaggacgagcaggagacgcggcctgttg

SEQ ID NO: 554712 - DNA, 305 bp, Homo sapiens
tgagaacacgggtcacagtaccttttattcgtcatgatacaacctgatgtgacaggaaatacagccactatctccaaacagtcttaatgcctttcagagtccaatgggaaagcccaagacggcgcctctattggggaagctatgaaccttccgcctttggatgccacaaatgggaacgatagaagtacaggaggtctgccttccacgccggaccatccagtgcagtcccatgcgcggacacagtgaggcgggacttggtacagaacgttttcctgataacacgtcacacgctagagcattccaga

SEQ ID NO: 554713 - DNA, 107 bp, Homo sapiens
tgatcgagctcggcccggctactggacttctggcatacctggacttctggcatcctggaccttctggcatacctggaccttctctaacagccttaacccgagcgcta

SEQ ID NO: 554714 - DNA, 251 bp, Homo sapiens
  misc_feature (24)..(24): n is a, c, g, or t
  misc_feature (61)..(61): n is a, c, g, or t
  misc_feature (96)..(97): n is a, c, g, or t
  misc_feature (135)..(136): n is a, c, g, or t
gcttagtgtaaactttcgtttatntgctaaaggttcaatcaccttgctgtttcccgtgggnggtgtggcttaggctttaagcgttttgaggctgcnnattgctgcgtgccttgatgccttgtcccttttttgatnncgtggtgatttaggagggtgaacctcaactggaaccggggatgccttgcccatgtgtaatcttactttaagagctaatagaaaggctaggaccaaacctatccaagttgcgtgtg

SEQ ID NO: 554715 - DNA, 704 bp, Homo sapiens
taacggctaggtagaggctggtgttaatcggccgagggacagctcggaggatctggggcggagccgcatggacctggctggccgccgatgtgaatgtgtgactccgtgggcctggcgtggaggcggggtgcgctaggctgcagctggctcggaatcgcggctggtttcctgtctggaaggggaaggggcctgcagaagggagctggggacagcagcagacatggcacaccccatgccttcctctctccctctcctcccttctctggaaaagctgagctggtgatgaacagctgcacaccaaagacgagacttggacactcttgtgcctatgagcccccatatgcatgcttggcactttccatcctgggaccaccacattatcctcacgttcgctattcattatttcttcaccatgcctggctcccgtgcagggcccctggagacagcagttggtgctgcggaaaatttgtcacagcagccagagtgtgtgttataacaggagtgcagatgggataatgtggcagcttactgccctctgcccaatgagcttggccacctctttaaagacttggtggaacatgtgtggagtgaggaacttgtgtggacaagtgtggtacctatctgtcccccctctggaggggttgacaaagtggaaagggcactggggggcaacagagaatgcaggacagatgcacatcctggag

SEQ ID NO: 554716 - DNA, 392 bp, Homo sapiens
tgccaggcctcatatgaagtgctgaggatacagactatgaataataacaactcttagcatgtttcctagctagaacttacaattcttgcctgacccatgtaaaagtcgtaaatctaggctgagcgcggtggctcagacctgtagtcttagcactctgggaggccgagacgggtggcatggcttgaggcaaggagttcaaaaccagcctggccaacatggtgaaaccccatctctactaaaaacaggaaaattaaccgagcctggtggcgcacagttgtaatcccagctactcaggagcctaaggtgaaaggatccacttgaatctgggaggtgaaggtcgcagtgagccgagatttcaccaccggaccccaacctgggtgacagagtgagac

SEQ ID NO: 554717 - DNA, 106 bp, Homo sapiens
accgagtattttgtgatgtgtcagcactggtgctcactgtgtcgacggaacttgtacagcggaggcatgcaccgaagtggttgaatacactgtcgaccatggctcc

SEQ ID NO: 554718 - DNA, 1371 bp, Homo sapiens
tggggggtttccttttaaatttttcttaagttctggggcccccccttaatttaaaaattgtgtggtgtgtatatttctctcgcggtaacttaaatctccttttaaaggtgggcaaaagccccattccccaatctcaaatatacacgggtccatacgagttggggttccgtgagagggggtggtaaaagaaaaactcctaaattattactctagaggtgtgggcactataagagtgggtacaagacatataccaagagaggtgaagagtttacacacgtgggcatcccatattttataaaagagctctgtgtgtgcaccctcttatagacactctgtggtacagaagtggtggagagaggtgtggtggaacaatatatctctttataatatattctaccacaatatatcacccccacacacaaataaaagaggcgctttccacacaataaagttacaaaagaaaaaacacctctttatatacacatataacacaggggagacacttatatctacatatatagatgattgtgcgcgcacatagtcgtgaacagggcggccaacacaaacatatatagagaccatagtgggtgaaaccctcttaatatatatatattctttacaacacaccctgtgggggcgccactatataaagagagaagcgacacacaacatagtgacaaacacctgttgacacacccaacacaaaaaacacaccccaagcgggggggggagacactctgtggggcggaagagagggacgcccataacaacgacacagggagtgagacacgcccaaaaaatttctctccccccccccgaggacgataatctttctacaccaccactcatatattaattattacatcaacgacagtattataatcccccaccggaggtgattaattctattatactaccaacctcatcttataaaacgatacttaatattaaaaaagcacccccaaaaattacttcttccccaaagaagaaaacagcaggagttataatattacacagcagcgaggtcgtgggcgacacatccatacgacccaccaaaccatctcttgtggcggggctagaaaacacacagaagcggttgtaggcaacacacaacattattactaaaaacaaaaaccacgcgcacgaaaaactgcgctcgcacaaaacacacgaccacacaacaaaacttccagtatgtaacaaccacaacacggcgggggggggtgtaacacaaccaccgcacacggggtcggacacaaaacaccccccaaaaatgtaacaacgcggtgagaacaaaccatgggggcgcgaagagcgactacaccaacaacatctcacacacacaaagtccccgacaaaaacacacccgcg

SEQ ID NO: 554719 - DNA, 207 bp, Homo sapiens
gagacctgaaatgaggaggaggagactctgcgctgagtactttgggtccggagggggatattccgggggaagcattcccgggggggtgaacgagggcggttcctcttggaattggattcgccattttattattctggctgctgaatcagcgagcccggaagataagagagtttgattgtctgggattcctgcatgaagacacccggg

SEQ ID NO: 554720 - DNA, 696 bp, Homo sapiens
gggctgtggcacccgtcagtgtgggtcccgttgaccctgttgcccccgttttcacgctttcgtgtcccagcaccatgtccatcattggtcaccgtggtctgctctcggtgtcctcttcttgccgtgtcgccgtgccgtcttgagtgctctcttcttgagcgctctttgctgcccctcatcttgttcgtcaccccctctttccgcccgcggttttcgttgatgttcacttcttctgtattgtgttcttttccagggatacggaccgagaggaagtagtggggatacagagcatgtcccaatagaggcgtaaatgcggctgacggctcttgagtgaggggccacggaagtcagggccggcaaagtctgtaccttcataaggtggtatgcagcgcttggggtcaggccctcgtaacactctgtcctacttgacgaatctgtcacggggaaaaatgtcaaggcggtagcaggaggacagagccaggagtgccagaggcagagaagagatggagtcttaggggccagggtgagcgaggggtcacagggcctagaggtgcttcctgggggcgggggaactgcagccagtgtccccctcccctcttccaccccagctccagccgtggtgcttagtctatttcatccctcttccaccaacgacagaaagaagttggggacctggcatgttatcgtgttcctgtg

SEQ ID NO: 554721 - DNA, 179 bp, Homo sapiens
  misc_feature (170)..(170): n is a, c, g, or t
atgtcagagccgtatcttcatgtgtgtttccagtattagtatagctatataattgtactgagtcacagcgacattagatcttcagttgaagcttagtacatcattgctagtcaggcgagaaagaactcaaagcacttcttgtctactgtcagtacctatgcagtcagatncatattcgc

SEQ ID NO: 554722 - DNA, 918 bp, Homo sapiens
atcaccatgtgtggctgagaccctgatacacgtatcctgaaaactggagggccttcaaggctctcatcgtttctcaatacaacagagctcaggtccgcggtgctctccgcatcaccccacttccattttgtgctcataatccaaccgcgacccgctgaattctcctccagcacatatttctctagccggcacatggctccacaagccacttgtgacgtggatgtatcgcatggcacttctcgtcgctcgtctttgagagcataggcctatctcgcactacatatgtgcatgcaatagaggagctgccggggaagtactccataggcaagcaaccccaggttggatgcatgtggcgatgaatcatttgcttgaattccgagtatacctgcccctcagcgctagtacctgcggtgttccccgacctatgagcattcatgcaccactaatcaaacacggccaacatgagtaatgctaccacggaaggagattgcgggcgcaaattctggcgagctgcttggcatagcttaactttggaatgtactgagggactttatactggttgtgcgcgcaactggagttggatcattagagcttggactatccactagtttgtcttgcacacctagttgttgcgctctattccgcaggtacttagtagccttcttttccgcctaggccttttccccaagtaaccatacactgtctgtgtttccttcatcgtgcttttaaccgagccccagttccgggcttgtcttgggcgcaagtgaaactgtgctgagaagatggcccagtttgatgctaaaaagtctgcagagacccaactaaaaaggacacaccacggaaccgagaagggttcacgggaaagagaagcagaaagccccaggctgagcggaaggaggagaaacaggcggctgccct

SEQ ID NO: 554723 - DNA, 173 bp, Homo sapiens
gatacggctacctgatattaggtgtctgctgtctctatccttctacagcaacgtgtaccgcttagcctactacaagctgcttaagtcagaagattgagtggtctggaggggagagggacaaaggactgcactatgggaagtggggcagcccctgggtgctggtttggaagagg

SEQ ID NO: 554724 - DNA, 359 bp, Homo sapiens
aaatgggttttttgtttaaatcccaaattttttgggtgaaaaaaacatccccaaggtttggattaaaccaggtgttgcttgttcagtatttccagccccaaaaaattaatttatcccttaaggaaaagacctttagcttgtttcaaattcaacgggttttatttagccaaccccccccgtttaaaaccaggatatccgggaatttttggatgggatttatgttttttaaaaaagaactgttcaaccggcttattaataaaatttaaaaggtacctgggtaccaaaaaaaaatgccccattaccctttaaacccacctgtgatattttaatgatgccataaaaaacccatttatttggga

SEQ ID NO: 554725 - DNA, 392 bp, Homo sapiens
agagtgaaactctatctaaagcaaaacaaaacagacatacaagcagccaacagacgtaaaaaaatgctcaacgtcgccaatcatcagagaaatacaaatcaagaccacagtgagaccaattaatagctcacaccagtcagaatggcttttgttaaaagtgaaaagataatagatgttggtgaggctgtggagaaaagggaatgcttgtacacttttggtggaaatgtaagttagtttagccaccatggaaagcagtttggagatttctcaaagaacttaaaacagaactaccattcgacccagcaatctcattactgggtatatacccaaaggaaaataaatcgttctatcaaaaagacacatgcatgcacccagggaactcgaacccagtg

SEQ ID NO: 554726 - DNA, 329 bp, Homo sapiens
tctggtcagggatatctcttcaagctcgagacctacttctgcctacttgacatcttcactgagatcaccttctaggttcctccagcatcaatatctgccacaactagaattgtcatgtgtctggtcggccaaatacaagctatgttgtcccaatagcactaataacacctccttttatttctgaacatgtgcctgtttggacaaaaaatgatatgggcatcctaccccaaagaaacacatgcctttcctctcctgggtctagccaggtgctttttggccatcatatagcccatggtggagttgtcccgaagtgcctgggctttcatgat

SEQ ID NO: 554727 - DNA, 180 bp, Homo sapiens
gctccaccttactacagacaaccttagccaaccatttaccaaataaagtataggcgttagaaattgaagcctggcgcatagatatagtaccgaagggaaagatgaaaattttatccaggcttattatggcagggcataaccctatacctattgcataatgatttacctggaagtaacttt

SEQ ID NO: 554728 - DNA, 1576 bp, Homo sapiens
  misc_feature (602)..(602): n is a, c, g, or t
  misc_feature (946)..(946): n is a, c, g, or t
cccgctggtgggtggtgtttccacttccctgttggtcggctgccttgggttggttagtgtccgctgctgcccgcggtggtgttgttggcgcaccgcagcttgggagtgactaggccccccgcgcacctggccgggggtgtttctaagagctgttggtgaacgcttctgtgtagggtgtggtccacaggcgcgagccatttcgggggcgaccccacccaacgtgtcttggtgcgagtggtgcgccctctcttctccggcgccctttttgggggcgcttttccccccagcctgtggtgggctgtgattgtaacagggggccccctttttgctgagggttccccattacgggcaggatttgtttggtggagagctaatgtgtctctgtcgttgggaaggcccccctattgaagcccaccaccgggggggtttaaacagataaagtgggtgcccccacccaccggcgcagcagacacaccccgccccgtgtgtgaggcttcattgttggccatctcttctattccgcgccctttggaatgtgaatgtcacaatgaatttttgtgggccctcgacgcttttatacttccgggacatcaccactcggngcacacctctttttgggtgacaaacacatgttttctcggtgttctcgagatggaattcccccctctaaggagaaccccctcggggtactgtctgtggtgatgtggagagtctccccgctgtgtccgcgctcttgtgaagagttatcacccctgcgtccgcggggccctgtagaagagacacactctcgcccaccaaaatatcacacactcgcacatgtgcccacacaaagtggccgccttctcacagagagaggtgccctccccacacctctccgggtatactctcctggttggggtctctgagagcgccacatctgttctcgctctgaggaggtcacacaggncctctcacagagagagagaggagcccacacagagagcgcgtgtgagtgcccccctgagaagagaaatttgtgtgagcgcactttgagcccccccccaactatgtgggctctccctcgggcccctgtgggcccacacagctcgtgtgtgtagagagagtctcacacccggagaagattcactctcacaaggccacaggggaagtgtgttgttcacaccccccccctctgtgtgagagaattgaacttcggaccctcgggggaatcgcctcgggcctcttctttctacaccaagtgtttgaagctgcacgcccttggcacctcgagaggagccacgccacggagaggaaggttgagaggaaaagccctcgtgaagaagtggccagagacctcggcctggggagcctgtggtgccccctgtccccaggaccatctcgccccactggccagaagaaagaatcggggacacattaccctttaggctggtggcccggcccgccatccagaaccaccttttgattgagccggttgccctggcccgtctccctggggccgggttgggcccccatgtggaagggctctgagactgtgtccctcccttccatttaaagatttttatgtctccgtgtccag

SEQ ID NO: 554729 - DNA, 315 bp, Homo sapiens
cacctcggcatcaaaacatcaggcaaggccaggctctgtgactcacgcctgtaatcccagcactttgagaggccgaagcgggcaaatcacctgaggtcaggagttcaagaccagcctgaccaacatggagaaaccccgtctctactaaaaacagaaaattagttgggcatggcggcaaatgcctgtaatcccagctactggggaggctgagattacaggcacctgctaccacccctggctaatttttgtatttttagtagagacagggtttcaccatattagccaggctgggaaatccggtctctactaaaaata

SEQ ID NO: 554730 - DNA, 189 bp, Homo sapiens
gtgcaaatcttaccgctgtttacaaaaacatcacctctagcatcaccagctattagaggcaccgcctagccagtgacacatgtttaacgcgccgcggtaccctaagccgtgcaaaggtagcataatcacttgttcctataagtagggacctgtatgaatggctccacgagaggatcagcgtgtctctta

SEQ ID NO: 554731 - DNA, 96 bp, Homo sapiens
gaactgtctggggccacatataaaatatactaatgatagctcatgagctaaaaaataaaacaaaatcacacacacacacaaaaaaaaacacaaacc

SEQ ID NO: 554732 - DNA, 377 bp, Homo sapiens
tcccccagttcctgctcttgaaagaaaatctggtagagttgtaaccacacgactgggatgcaaatatgtcagtctaaatgaaggatcagagtacgaccacgtctaagtggagaaagttagtccggtcatgatcgtacaggcatcagctatattagattatcttttggttaacaataggctgagtcatgtctatgcaagaagtagatcagccaccgcattgggagacaacctgcaagaattatacgagacttatgtcaggacatggaagtacatgctgaaaaactctaaatggctgaatataactgtattggagatgctttcagattgcattctgagtttacctgaaagggatcaaatttcaagaagcaggaactgga

SEQ ID NO: 554733 - DNA, 558 bp, Homo sapiens
  misc_feature (18)..(18): n is a, c, g, or t
  misc_feature (115)..(115): n is a, c, g, or t
  misc_feature (155)..(156): n is a, c, g, or t
  misc_feature (159)..(159): n is a, c, g, or t
  misc_feature (227)..(227): n is a, c, g, or t
  misc_feature (232)..(232): n is a, c, g, or t
  misc_feature (240)..(242): n is a, c, g, or t
  misc_feature (257)..(258): n is a, c, g, or t
  misc_feature (274)..(274): n is a, c, g, or t
  misc_feature (280)..(281): n is a, c, g, or t
  misc_feature (291)..(291): n is a, c, g, or t
  misc_feature (295)..(295): n is a, c, g, or t
  misc_feature (301)..(301): n is a, c, g, or t
  misc_feature (333)..(333): n is a, c, g, or t
  misc_feature (376)..(376): n is a, c, g, or t
  misc_feature (385)..(385): n is a, c, g, or t
  misc_feature (388)..(388): n is a, c, g, or t
  misc_feature (390)..(390): n is a, c, g, or t
  misc_feature (422)..(423): n is a, c, g, or t
  misc_feature (427)..(427): n is a, c, g, or t
  misc_feature (472)..(472): n is a, c, g, or t
  misc_feature (483)..(483): n is a, c, g, or t
  misc_feature (497)..(497): n is a, c, g, or t
  misc_feature (527)..(527): n is a, c, g, or t
agggggggggggggggtnggggagtaaatggaaatgttattgtaagatataaaaaggtagagaagaagaaaataattttgtggatgaaattagaagtgtgtattatattgatgtntgaagattgaaatatattagaaaggaggggtggagagaannatnttgattttgggagaaataagtaaagggggggtgaaggattagaagtagagagaaagggtgatgggaantgtgnagattgtnnnaagtggattgatttnncaggtatattgtggcntgaagnntcaagggtgnagangaaagnagatttgggtgaaaatgggtcggagcaagttnaagtatgggagattttggaaagttttttggaaaaggaaagaanatagtgatnatntnaggagctggtgttagtgaagaaagtggtgttnngacnttgagaggagctggaggttattggagaaaatgggaaggggaggangtggggaatgnggtggggtttgggnagaaggggtggggggtgtgggagttgtagnagtaggggggggaggtgatggggagaaagga

SEQ ID NO: 554734 - DNA, 143 bp, Homo sapiens
aaaccccccgacccacagactctgcaccccgcacgcccgatgatccttgagcgactgctgctgaaagaggctgtccacctagcgaaaccaccggaagcctcgtgaggcttgggggctccgccctgggctggcttccgtctcct

SEQ ID NO: 554735 - DNA, 449 bp, Homo sapiens
  misc_feature (2)..(2): n is a, c, g, or t
  misc_feature (36)..(36): n is a, c, g, or t
  misc_feature (107)..(107): n is a, c, g, or t
  misc_feature (132)..(132): n is a, c, g, or t
tnatttgtgaagcgggataaacaatttccaccacgnggaaaacagcctatgaccatgattaccgaatttaaataccgactcactatagggaaatttggcccctcgangccccaagaattcgggcacgagccntttgaaaaactacctaatcaagaccgggttcaagtggctcgcggctataatccccagtactttgggaggcccaaggtggaaggatcgcttgagtcccaggagtttaagaccagcctaggtaacatagtgagtccctgtatctaaaaaataaaaaaaataaaataatgccaggtgtgatggcatgtacctatagttccagctactcaggaagctgaggtggcaggatcacttgagcctgggagattgaggctgaagtgagccgtgatcatcatgctactgcactccagcctgcgtgacagagtaagaccctgtctcaa

SEQ ID NO: 554736 - DNA, 766 bp, Homo sapiens
ggagagagagaactagtctcgagttttggtttttttttttgggttgagcaacggggtacttaattggatgggtccatgacaaggtgcggcctccctaggcccctccccttcttacaaggggtctacttggcaacggtgaggaggggaaattcagtggtggtggggggactggatgtggtgggcagggactcccacagcagtagagggtctctcttcttcctctggtggctcttgctgggggctggtggtccaggggtctaactccttgggaggccatgtgggccatgaggtccacacaccctgttggctggtagccaaattcggttggtcataccagggaaatggagcttgacaaagtgggtcgttgagggcaatggccagccccagggtcaagaggtgggaggatgtggggttgtcgctggttgaagtcagaaggagaaccaccgtgggtgctcagtggtagcccaggtatgccctgtgaagggggccctcggaacgaccgggtacaccacctttctggaatgtcaccatatctggggcaggtttctctagaagcggcgaggtcaggtccaccactggacactgtggcggcaagtggggagtcacgggaatggccatgccaaaggagagctatcccgtacaggctcaggggactgaccgtggcccaaaagcctgtggacaggggccagaaaaagggcaggggatagatcgtccggggaagaggccccgggggcactacacggccaaaagaatccccggaaggggc

SEQ ID NO: 554737 - DNA, 211 bp, Homo sapiens
cgaaaccacccaagcaacagcaacgaaaaaaaacagttaaaagaaaaagcatctggtacttctactacaatcctcaacctcctaccgattttctcatttaaaacttttttgattcctcatcaaactttcaaaaacacgtttttttttccaccctgtggtgtccacttgcttacctggtataatccttcctcaacccagctagtgtaaataa

SEQ ID NO: 554738 - DNA, 489 bp, Homo sapiens
aagtaggggctaagagagaagaaagcactcttaccttgtttgtgtcttactttgctagttgatgtatcactttgcaaaattggttccagtctcattgttttggtgctgtgtaggttgggagcaaatatgtagcctcattgttttgaattgtcttagattcttaaatctccccctttttttcttagttatcggtcctatcgtccagcattttctttctctgttctaagacaaaatctctttgtctctctcctctttggagaactgcctataaatcctttttggaagaccatttgtgatcaacccaaccctgccaattcagatattctagaaagtactttggctctattttgtattctcagttttatatgttaaatgtatcagaccaattctaagacagtgaatagttcttttgtttaaactgaaagtttaagaggggctcagaaacattgagttataattaattgagttgtaggtgtaagtgatttaaaa

SEQ ID NO: 554739 - DNA, 670 bp, Homo sapiens
  misc_feature (126)..(126): n is a, c, g, or t
  misc_feature (142)..(142): n is a, c, g, or t
  misc_feature (158)..(158): n is a, c, g, or t
  misc_feature (186)..(186): n is a, c, g, or t
  misc_feature (188)..(188): n is a, c, g, or t
  misc_feature (223)..(223): n is a, c, g, or t
  misc_feature (252)..(252): n is a, c, g, or t
  misc_feature (259)..(259): n is a, c, g, or t
  misc_feature (288)..(289): n is a, c, g, or t
  misc_feature (295)..(296): n is a, c, g, or t
  misc_feature (413)..(413): n is a, c, g, or t
  misc_feature (424)..(424): n is a, c, g, or t
  misc_feature (429)..(429): n is a, c, g, or t
  misc_feature (431)..(431): n is a, c, g, or t
  misc_feature (447)..(447): n is a, c, g, or t
  misc_feature (454)..(455): n is a, c, g, or t
  misc_feature (457)..(457): n is a, c, g, or t
gagcggaagtgggtgctgtgaggcggcggcatctttctcgaggagctctcctgggcggctgaagaaggagcttcttctccggagtgcgccggggtggcgctgcggacctaactagctccaggttangccgagctttgcgggnaagcagcggacttganaatactgaaatctgtccggatccaacantnattttgcaagccagatgagtaaccagagggcatgnaaaggttgagaacatttgacttccctgcnaaacctntggtatagatcacttccttttctgtaggnncaggannggcaccaaagagcacaatgagtacaagaacagcgtcgccgtggacgccaatacaattctagacacagctcagacgcgaactcgggaagcaaagctccaaccccgagatctccttggnagcagaacccntagancncgtggaaacgctggancatgaanntngtggacctcacgtgtggaatctttagaagcctgtggtgggttgatctgactcacaatagatctgtgtgtggatttgtggacgaaagaagaacgaccaggaggaatgctaggagggtgacccaggaacatggtgcagcttggtgttgagcaggagatgaggagttgccaggacagagagtatttgtaataccaatactctagacagcaggttag

SEQ ID NO: 554740 - DNA, 138 bp, Homo sapiens
cacgaggaggacccacacggaaccatatgtgctcaaccacaccttctcctcctcctgccatgctgaatcacacaaattaatgtttaaattttgaggacacaatcatctaccaatgccgtgtctgtgtctccaaggaga

SEQ ID NO: 554741 - DNA, 1271 bp, Homo sapiens
  misc_feature (632)..(632): n is a, c, g, or t
gaatttcatatagtctttgcgtaccatttcctgagctaaagtagcttttttttcttggaacacctctctctctacacaagtgttttcctctatacacttctaaataaacactgttgccccccctttttttagcaataccctgtttttccacctctctttgtctttctctttaccttgttataaaccactctcggggggaaacgtaaaaaaagttttctctaaataaactatattgttggttcccacagaaacgcaatagaattttccgccctgttgtttttaagggttataggaaagaagtttgtgtaatatttttggaggtaaaatcttggaaaggacctctgtcaaaaacactggggggaacttaagtaagccccgaattccttttgtaaagagataaaaaatagggggtcacctatttgtaccacgttaataataataaatattattggcctatttatagcctattatttaatgctaacccttaaaattgttttctaaaagattattttttgtgtataagtccacgcctaagcgctgtgttaataagggtcacgtttctctaatgctttttgtaataattaacccgtgtttacaccaaaacaccacacatgtttgtgttcggcgttctngtaacgcacatcttgccttaatataagtgtctataaaggtatttgagtgtccacagccacttttctaaagtgtataacagcgtagaataatggctgggaagttcacagtcacatatatagtcttcgcactaaattcttctgtcttccccttctgttgtgtgttctctttctatatatataagcacacaatcgtggtaacacacacacacacacacaccaccacaaattattatctgaaaaagtctataggcgtataagtttctataaactcgagaatattccacacaaaccccacaagtcacacggacccaaagaaagtgaataattttccaacaccacacaccactggagtttctctgcccgggtgcacgatggctcacagcccgtaaataccacgcctccacactttgggaagttctgaaggtgggagtatttgcttgaggctcaagagttggaggaacacgcctgggcaaacactggtgagacctggtctttaccaaaaatttttttggccggaacgcacgtggctcaacacacctgtaaatcccacgcacactttgggaggccgaggcaggttgatcatgaggtcaagagatcgagaccatcctggcccaccatggtgaaaccccgtctttacca

SEQ ID NO: 554742 - DNA, 155 bp, Homo sapiens
acctaactgaccgtgacacgtccgtggacacgcctgtgtgctaccacacacaactgttgacgccgtacgactcgccgatcggacaactggtgacacggacgacctcgacacgtacctctgacgtgcttgtacgtgacgggtacacacactacgac

SEQ ID NO: 554743 - DNA, 1020 bp, Homo sapiens
cctcgaccagctgctggacatgtctacgagcagctgatgcagctgtacagtgctgcgccagcgtgtggcggctgaaccggggcctgcgtgtgtgaagcagcactccctgctgaagtgcctgcgcaaggcctaagaacggaggcgccgaccatgcgagaagccggaatctggtgaagtacgcattttgctgggactctgatcatcgctacctcgatgatgtgtggcgcagctatggtagggcgatctacaacggcaaggagcttacaaccacggtggagatcaacgcccgagcattgactcggccacgtacgctggtgcgagcttctccatctacctacaagcgccgtaaagcatggccggcccgacaatcggggccacccacttcctcccgcttacatccctctcaagtaatggctcagccttctacaggcgcaccatgaactatctcccaacaccacacccaataactaaaatacacatcctccccccgcccactccaccttaatacaacttctcccatacacatcaacacagtatactacccaacaatctcaccacctaggcaaccacaagcacgtatccccccgctgtagcccgcggtccttccctgtccgttccacaacgatcggtctcatcgcccttacctcggcgcggcacccccgtccatatcagccgccgccccggttatttcctacccaccaccgcaacaaagccccgcggcctacctcccctcgtgtccaattcaccattaattattatcacaatataaccctacataccaattaactaacaaaatactccacccacccatcacactctatcaacacaacctaaggaccatcctcaacccccctcacctcacaaaatcaacccacactatcaaaaaaacaccaacacaacaataacaccccccacatacacctcctcataaactatcatgaccacctaccaccaccacaaacccgcacaaccaattaacatataccccaaacctcaacatccacacaccctaactcccta

SEQ ID NO: 554744 - DNA, 135 bp, Homo sapiens
  misc_feature (87)..(87): n is a, c, g, or t
taacatcacgaatgtgtggttatcttactggtggcgtgcatcttgccagtcgtcacgccgcccggcgtagttaatgcacggtgtgcngtgtcgtcattctgcaggtacagtgctgaccggtacgagctcgaatcg

SEQ ID NO: 554745 - DNA, 223 bp, Homo sapiens
  misc_feature (209)..(209): n is a, c, g, or t
agccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataanagctattacttggc

SEQ ID NO: 554746 - DNA, 147 bp, Homo sapiens
gacgcaagaacagacgttccttcccacttctgtgaacaggtaactaagaactgaaaccaccccacccacattcaatccagttcctaattagtcagtgctttcctgcaatggtgccgcagaagagtcagaagtaaggctccggggttc

SEQ ID NO: 554747 - DNA, 100 bp, Homo sapiens
ggaacgcttatcattcagtggaataggaccggaaagcacccgtatggagagactcaggtaaacctgcccatgaaccacaccatccgatctcgaatcccag

SEQ ID NO: 554748 - DNA, 669 bp, Homo sapiens
  misc_feature (7)..(7): n is a, c, g, or t
  misc_feature (85)..(85): n is a, c, g, or t
  misc_feature (92)..(92): n is a, c, g, or t
  misc_feature (205)..(205): n is a, c, g, or t
  misc_feature (215)..(215): n is a, c, g, or t
  misc_feature (243)..(243): n is a, c, g, or t
  misc_feature (260)..(260): n is a, c, g, or t
  misc_feature (269)..(269): n is a, c, g, or t
  misc_feature (301)..(301): n is a, c, g, or t
  misc_feature (303)..(304): n is a, c, g, or t
  misc_feature (312)..(312): n is a, c, g, or t
  misc_feature (318)..(319): n is a, c, g, or t
  misc_feature (350)..(351): n is a, c, g, or t
  misc_feature (378)..(378): n is a, c, g, or t
  misc_feature (547)..(547): n is a, c, g, or t
  misc_feature (560)..(560): n is a, c, g, or t
  misc_feature (586)..(586): n is a, c, g, or t
  misc_feature (591)..(591): n is a, c, g, or t
  misc_feature (604)..(604): n is a, c, g, or t
  misc_feature (622)..(622): n is a, c, g, or t
gattggnttcacctcttctttcgcgtacttacgggcaaccgaggccatccgaggccctggtcccgaacgaacttgagtggcgagngattcanaataaagaactaagtgtggcctcccaggggctgcgctcgccatccagggactgaaagagacctgcgggatgattttctgttttcctctagcgggaatcagaacaaggggcgtngattcggttnaatttttctgcttcggtcaatgggaagntgaaatagaaaaattcnctttcactngcaacatggagatttagggggttgtttagctngnnggttggcnaactgnnaaagggggggggggggggggagggggggggnngggggctctttgtttggctcttctctnttcccaggactcaggctaggctaaatttctagcgccgtgtgttcttgaaagcagacaggtgggattcttggaaagaacatacacaacacagcttctgagccccagaaggaccttaagacaggagtccctgagccctgaacaagaggctacctagggtaaagcgattganctccgcgcggtgnggctgagaagagaaggcgttgttganctttncggggagtcagtnaataactcagccgagttngatgaagtgacgttctttctgaaaggggtcgtctcctgggccccttt

SEQ ID NO: 554749 - DNA, 554 bp, Homo sapiens
  misc_feature (74)..(74): n is a, c, g, or t
  misc_feature (105)..(105): n is a, c, g, or t
  misc_feature (107)..(107): n is a, c, g, or t
agcgggatggggcgggtggcgcatcaccggcgcggaggcaggaggagcagtctcattgttccgggagccgtcancacagtaggtccctcggctcagtcggccagncncctctcagtcctccccagaccccacacaacacgaccgcggctctgagacagcggcacccggcggacggacggacagcagcatgcagcatcatctccaacactccagccatggaagacctggagcagtctcactctggtctcgatcatcggacagcccagcaccggacgcagacaccgcgttcaagtaccagtgcgtgagggagcccgaggacgaggaggacggaagaggaggaggaagaggaggacggaggacgaagacctggaggagcatggaggtgcaggaagaggagagccagcagaacgacggagcatgtccaggcaggacccaagcaggaccaaacgacacatgaaagaacagagagcggcacgcaaggatggagagtgaacaagagtgacacgatgcaggacggagaaacgaaggaaacacagacagacaaaaaacaaagg

SEQ ID NO: 554750 - DNA, 163 bp, Homo sapiens
gcaaacctggaaattagctatgccaaaggacttcagaaactggggagcgagctgagcaaagcattacagaacacgagaaaaagttgtgttagcagtgcctgggcctgggcctgagagggaatgaaatgcacagggggtctggggccagaaactggggaaaggg

SEQ ID NO: 554751 - DNA, 422 bp, Homo sapiens
attagaggatccttatgctgtctcacaaaacaaaaacacatgcttcggaatactctgaggctgctgagttgtaagtataaatacatgaataacttctgaaatagcataaaaatatagtaaataccataaactagtaacagtcatttattattcattgtcaatgttttatggactatacgtacattgcatgtgctattttttttttttttgggggagggagtctcatttactctgtcgcccaggctggggtgcagcagcgcaatctcggttcatggcagcctccgcctccccagttcaagtgattcgcctgcctcagcctcccgagtaggtgggattacgggcttgcaccaccacacccggctaattttggtattttaaggagagacggggtttcaccatttgggccaggcgggtctcaaacc

SEQ ID NO: 554752 - DNA, 440 bp, Homo sapiens
ctatgtgataacagggtagacataggagcactttcctctcacgataatgtgtgtgttctgtctgtccgtgtgtctgtctgtgtctgtgtgtgtgtttcttgtctgtgtctttgtgtgtgtgtgttctgtctgtctgtgtgtctgtctgtgtgtgtgtgtttcttgtctgtgtctttgtgtgtgtgtgtctgtatgtgtgtttgtgtgtgtatgtctgtctgtgtctgtctgtctgtgtctgtctgtctttgtgtgtctgtgtctatctgtctgtttgcctgtctctatgtaagtctgtgtctatctgtctgtctgtttgcctgtctctgtgtgtgtctctgtctgtgtgtgtgtctgtgtctgagtctatctgtctgtctgtttgcctgtctgtgtgtatgtctgtattgtgtgtggtcgacccccccgcgaatttagta

SEQ ID NO: 554753 - DNA, 260 bp, Homo sapiens
gtctggggcttggctgtgccgctctggtcaccaaggcaggcgccctgcagtgcagccccagtgatgcctacaccaagaaggagctcatagatgtgtgcccgcgagagtctctgatcaaggtctcccacgtcctgagctgcgctccagcgctggcgaatcgtggcacccatgtcctgcaatcacagacagccacgcgctggtgtctggatatcatatgctgtacctcggacaccaccaatcatgcttcgcccactgactgg

SEQ ID NO: 554754 - DNA, 127 bp, Homo sapiens
catgagagacgtgttgagtgtggaacagagaatttgattctcatgaatttaggatttggttgaagtggtatttatattctttctacttgaaatagcctctttgtaagcattgcaacacggtctctca

SEQ ID NO: 554755 - DNA, 327 bp, Homo sapiens
gtaacagtagccttcccaaactcgcactttgccaagttcagggttagagaagcagctgccacccgttcacatactacccttagcgagtcaacatgatctgaccactcagacgaataaatcactaggtcatcaaggtatgcactacaattaggaacgccagctaatacggagttaaccagtcgttggaaggtggctggtgcatttcgcatcccaaaagccatgactgagtactgtaggaagttgtctggggtcacaaagacccgtaacataactcatgcaaattattattgtgacgaagtaaaagtgtgaacgaaataacgtcgacgc

SEQ ID NO: 554756 - DNA, 349 bp, Homo sapiens
ttcgtaccctttctcaggttcgcctttggccaccgccagttcaaccggcggatactcagcctggccctgcccagcctgaggttcctggtacgccgggtcgatcgcgaccagctcaaggcgcaactgatcagcaccttcctcacaggcgtcgaggccgcctggctccagcagcgggcagaagctttctgccagcaggcctggaaccgactgatgcgcccggcgggcctgcaggcggtggcccaggagctgcgctcaggcgccctggtaaccctgtgctctgcctccccggccctggtcctgcaacctttcgccacacgcctggggatcagcttgatcggcaccgaactgg

SEQ ID NO: 554757 - DNA, 2797 bp, Homo sapiens
aaagaactttctttcagtaacagattttttaacataaaggccaaagtttaaatgaaatagaaaacaaaatcaccaccactgttttaatgatcatggaaagtgatttatgaagtacaggatttaccataagcagtacagtgtcatcttgtgatttttcttcttccagaaagtttcatgaaagatttattaaatatataatatcaagagtttgcttttatttgcatattattcctttgttccagagataattctgaaggtactttttaaaagttgcttattctgatatgctatttaaaatttttagggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgc

SEQ ID NO: 554758 - DNA, 873 bp, Homo sapiens
  misc_feature (45)..(45): n is a, c, g, or t
  misc_feature (119)..(119): n is a, c, g, or t
  misc_feature (124)..(124): n is a, c, g, or t
  misc_feature (172)..(172): n is a, c, g, or t
  misc_feature (222)..(222): n is a, c, g, or t
  misc_feature (255)..(255): n is a, c, g, or t
  misc_feature (266)..(266): n is a, c, g, or t
  misc_feature (329)..(329): n is a, c, g, or t
  misc_feature (484)..(484): n is a, c, g, or t
  misc_feature (486)..(486): n is a, c, g, or t
  misc_feature (489)..(489): n is a, c, g, or t
  misc_feature (661)..(661): n is a, c, g, or t
  misc_feature (767)..(767): n is a, c, g, or t
  misc_feature (853)..(853): n is a, c, g, or t
accttctttcttttctctgctcctgctggccgtgccgtccatgcntttcttctttccctaggccatatttccccatcctgctcacagtattatggttaataagatgctggacagatgcntccanaagcctattacataacaacaaaatctcatcaatgatatatcaaatgcnaatttactaagacatcaagagaatatctgtttgtagttacatggctaaanacaagacattattacagtaaccaagtccataanactagaaaaanagcactgtataacaaaaaggccttttagaagctattaaatgaacaaacattatagataaaccnattttatatctgaagccgcttttagcccccccccgttggccggccccgccggggggtggggtctttgggccagggcatctggggcccgggggggctctcggccatcctctcctgccgccccttgttttaccaatgggggcataggggcccagggngntgnggcgccttgtcccgggtcacacagcacgggccggactggggaatgatccagggctatggtccgggcccctgccttccggtaggtgctctattttaacatacgggtatgagattctatttgatttgatgtattttttccccattaacaggtctaccataaaagaaagcaatanaacccataatgtactctggtattgtatttatttcactgagaaatgactggcatgtactacgatcattttgggggcctatatagatcttacatcaaaattcagaggnattagtcagataacactattttagttataaattgagaaggtggcatttgaagagaatatttggcacatcctccactacgtaagctnccctatgcctcaaaattact

SEQ ID NO: 554759 - DNA, 910 bp, Homo sapiens
ttaaactggagattatttgcaagatatgagttactagcttattatactgaattacagtatccaattagtgctgtgtttgtttgtttgtttatttatttatttttgtgatggagtcttgctctgtcacccaggctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgc

SEQ ID NO: 554760 - DNA, 1798 bp, Homo sapiens
  misc_feature (1429)..(1429): n is a, c, g, or t
  misc_feature (1438)..(1438): n is a, c, g, or t
  misc_feature (1468)..(1468): n is a, c, g, or t
  misc_feature (1505)..(1505): n is a, c, g, or t
  misc_feature (1521)..(1521): n is a, c, g, or t
  misc_feature (1597)..(1597): n is a, c, g, or t
  misc_feature (1600)..(1600): n is a, c, g, or t
  misc_feature (1691)..(1691): n is a, c, g, or t
  misc_feature (1705)..(1705): n is a, c, g, or t
  misc_feature (1708)..(1708): n is a, c, g, or t
  misc_feature (1737)..(1737): n is a, c, g, or t
  misc_feature (1761)..(1761): n is a, c, g, or t
  misc_feature (1770)..(1770): n is a, c, g, or t
  misc_feature (1774)..(1774): n is a, c, g, or t
  misc_feature (1777)..(1777): n is a, c, g, or t
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatggtgagtttccatcagtagaaaatctgatttacataaagcaagcagttaaaaattatatagacaangatgaagcntgataatatgcaaccatttgaatatttttngcaactgtgatcctggcttgccaatcaaactgttttnactatttaagtactgncaatatgcagattaaatccaaacagggtaccatttataatctttggatagtctttccaaaggatgtgtatcagganttntttttcttatacggatgacagatttgtattttgctgtcttacattctttattaggtaccttattcatctctgtaaaataactggcaagcantagggggactgagnatnagatcatggccctagaaccacccaaaganaatagtggtgtatatcttaatttnttaaatgtntacnttntatgatttttcagtactgaaa

SEQ ID NO: 554761 - DNA, 890 bp, Homo sapiens
  misc_feature (738)..(738): n is a, c, g, or t
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaaccaaaaaaaaaaaaaaaaaaaaaaaaaatggggggttttttggggggggggggaaaagggggtttgaaggggctgtggtggggttccgggccccttttttggcaaagggggaaaaccgggagggcccccctaggggaggcggaataatttcgaaaagccagggtaccgtagacttgcgccgacagacaacnaaacacggaaaaaaagagagaacgacacactctgcacaaaaccgcgtggacaaacacacaacgcacacaccgtcggcaaaaagaacagcaacaaaaacactcacacagccaacacagaccacaccacaagacaaaaaagaatccgcacctca

SEQ ID NO: 554762 - DNA, 632 bp, Homo sapiens
  misc_feature (539)..(539): n is a, c, g, or t
  misc_feature (586)..(586): n is a, c, g, or t
  misc_feature (614)..(614): n is a, c, g, or t
gcaccgaccggcacgagtgcacgcggacagcagagacggggcgatgctacgggtgcggtgtctgcgcggaggcagccgaggtgccgaggcggtgcactacatcggctctcggcttggaggatccttaacaggatgggtgcagcgaactttccagagcacccaggcagctacagcttcctcccgaaattcctgtgcagctgaagacaaggccacccatcctctgcccaaggactgccctgtctcctcttacaacgaatgggaccctttagaggaagtgatagtgggcagagctgaaaatgcctgtgtgccaccattcacagtggaggtgaaggccaatacatatgaaaagtactggccattttaccaaaaaaatggaggtctttattttcccaaagatcatctgaagaaggctgttgctgaggtcgaagagatgtgcaatattttatcaatggaaggagtgaccgtgaggcggcctgaccccatcgactggtcactcaagtataagactcctgattttgagtctacaggtttgtacagcncaatgcctcgagaccatcctgatggttgtggggaaaccgagattatngaagcacccctggcattgcgctccacgnttcttttgagttaccgag

SEQ ID NO: 554763 - DNA, 165 bp, Homo sapiens
aactggagtttcaacccattccttacatttaagaaggtccattactggtttacaaggcttaatttttttcttagttaaaggtttttctttcaggccgtttttcttaatttaacggttccaacaaaaccaaattaacgtctggggtaaaccgggccttttcggttg

SEQ ID NO: 554764 - DNA, 323 bp, Homo sapiens
gcggccgatggcgaatcgcgcctgcgggagaatgacgatttcaagagacatgaatggctaccaatcctgggcggtccgggttcagaccaaagaagtgtttgcaaaaaaagaaaaagggtagccgaggctaccctttttaatcaatcacgcatgaaacaaaacggcgacgccgcttacttcttgcggatctgctggagagtacgcagctgggctgcggcctcggccagacggactgcagcagcgctgtagtcgaagtctgcgcctttttcgttcagcgccttctcggcagccttgacggcttcctgagcggaggcttcatccag

SEQ ID NO: 554765 - DNA, 578 bp, Homo sapiens
  misc_feature (14)..(14): n is a, c, g, or t
  misc_feature (73)..(73): n is a, c, g, or t
  misc_feature (76)..(76): n is a, c, g, or t
  misc_feature (81)..(81): n is a, c, g, or t
  misc_feature (88)..(88): n is a, c, g, or t
  misc_feature (95)..(96): n is a, c, g, or t
  misc_feature (131)..(131): n is a, c, g, or t
  misc_feature (158)..(158): n is a, c, g, or t
  misc_feature (170)..(170): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (189)..(189): n is a, c, g, or t
  misc_feature (192)..(193): n is a, c, g, or t
  misc_feature (196)..(196): n is a, c, g, or t
  misc_feature (198)..(198): n is a, c, g, or t
  misc_feature (202)..(202): n is a, c, g, or t
  misc_feature (208)..(208): n is a, c, g, or t
  misc_feature (217)..(217): n is a, c, g, or t
  misc_feature (253)..(253): n is a, c, g, or t
  misc_feature (256)..(257): n is a, c, g, or t
  misc_feature (263)..(263): n is a, c, g, or t
  misc_feature (289)..(289): n is a, c, g, or t
  misc_feature (336)..(336): n is a, c, g, or t
  misc_feature (341)..(342): n is a, c, g, or t
  misc_feature (395)..(395): n is a, c, g, or t
  misc_feature (409)..(409): n is a, c, g, or t
  misc_feature (411)..(411): n is a, c, g, or t
  misc_feature (422)..(423): n is a, c, g, or t
  misc_feature (428)..(428): n is a, c, g, or t
  misc_feature (446)..(446): n is a, c, g, or t
  misc_feature (449)..(449): n is a, c, g, or t
  misc_feature (453)..(453): n is a, c, g, or t
  misc_feature (457)..(457): n is a, c, g, or t
  misc_feature (473)..(473): n is a, c, g, or t
  misc_feature (506)..(506): n is a, c, g, or t
  misc_feature (511)..(511): n is a, c, g, or t
  misc_feature (562)..(562): n is a, c, g, or t
caactggtgtgtantgtcttctcctaaacctgtgttacttgtatcctggactttttcggtaaaatccttttcntcntctgnctcttcnctttccnnctcctcttccatatctccatcttcaggcctctccntagcactcttcgtctctttaggcagcngcgatgcctttncaagccnggngcnccgggnagnngcngntggnggggcntgggctggngtgtgaagaagctcactaattgcggggatgtgttangtnnaggggngttgaaaaagaaaaaaaaaaaaaaantcgggtagggtttggtcctgctgttgcctgtgttttccccatatggnattgnntggggttgtggggagtctttcttctgctagctgctgaaaaattgttggtgtgngtttttcttctggngnctttgttctgnntgtcncttttctctgtggttttnttnggtngttncactggggtctctttngccactggtaagcttctgatgtgaaggtttcanggacntctcgtggtacatacactccccactggactttctctctggagatacccttntgaaaatacaatggcc

SEQ ID NO: 554766 - DNA, 1068 bp, Homo sapiens
gttataaaacttagtttaaaaaaaagacaaaaaaaaaaaagccaagccgtgagccgaccagaaggccgtcctcttggatatcttttggcaattggtaccggaaagtgacttactcctctggcccttcctggcttccggtctctggccgggtgccgtggtggtcgtccggtgcctggtgaggttttggtgcagcgggtaaagtgctgggtgcttctgggtgaccttggacctgtgggtgtcacttctggtgtctggttttcccgtgttcgttttttggggttaagttggtgctttggcttctgctggcttgctggacctgggctggggtgccaagtgggcgcctgctggcgtcagagctcaaggaatctgtgcccaccaccagctcctggtccgtaggaggtgagacatggggttctggtcatgcccccctccattgagccttggctacatctggtgtctaagggcttggggctggatctaagtgggcggggtcaggtcgaaatgggggtcccttggggcgacccaagctgattccaaaacccaacaaactctggcctcgaggtgcgtggacattacaagggatgagggagtccactgtggagtggcccacagggctatggccagcgttcccgggcacgcatacctctggacatcagctctggacacaaataaggagaccagcgacagtgagactagcaggatctcaacgaccagactggaaccatgaaatgatgtaccaaggaagacagaaaggtgaatccaaggccaaacatggtggcacccaaacggggaaccgaccagtactcctggtcacgagataaatagaaagccatgagggataacaaaaaggtgaacaacaggggaaacagccacaaggagacacggaaaaggacacaacaaacacaaggaacaaaagggaaaaatcggcatcaaacagtagacatgacccaaggaacaagggaccaaggaacacagagtaatcacagaaaggaaccatagcggcaaagccgcaacgataaccaaagaagaaggcccacagcagacaagagaccactataaggggccacg

SEQ ID NO: 554767 - DNA, 578 bp, Homo sapiens
tgtgcctactaaaaattagctgggtgtggtggtgcatgcctgtaatcccagctactccggaggctgaggcaggagaatcgcttgaacccggaaggcagggttgcagtgagccgagatcaggccactgcactccagcctgggtgacagagcgagactccatttaaaaaaaaaaaaaaaaggaaagggtacaaagtttggtatacacgtttaaaggaggtaggccaggcacgggtggctccgccgtgtaatcctagcactttgagaggccgaggcaggcagatggcttgagctcaggagttcaggaccagcctgggcaacatggcaaaaccccatctctacaaaaaaatacagaaaattagccaggcgtggtgggcgagctcctgtagtgccacctactggggggtctgaagtggggaggatcgctggcacctgagaggtggagaccgcagtgagctaagatggcaccacttcacctgcactccagtctggggcgacagagtgagaccctatctcaaaaacaaaacacacaagggtttcaaaggggcaacaacacaaccaaccagacaaaaaaacagcgg

SEQ ID NO: 554768 - DNA, 1770 bp, Homo sapiens
agcacggccatgaaggactcgagagcatgctacgaagagtacaaggtagtagggtcgcatgccttgcccacccggcataatgccgatgaacgctcgccctcttcctagccgcaatggcagaagtgctgtattggcagcgcatacagtcactgttcgattcggacagaagtcgccgggttcgtgggtagctctagtactactgcaagttacaatgaatgatgaacgaatgtctctacagcggcgaggagttcgttgcgtaacgtagtcgcgtgcagtgatgcttctcgatgacagtctcgccacctaggcgtgggtgagagacacttgcgtggcatactagggcatgcgactactgaagtctccggaggcggtcatccgctacagcgatggttacgcagggggaaataagcggagcgaaccgtggcaaacgacactgcaagggcaggctggggcccacaccgtagttggcctacaccgaggagaacgcattgcgggttagccacatgtggtacacgcggcgtgcacccaggagaccccttacggacgctaatatcgcaggatcccattggagaacgggctcggcgaagagaagaaattcggcaggggcacccaaggccacatggcttggcgccatgcacctaggagcgcactgcgaggctctatgaatccaacattgcacatggctattctcggaactaggaacatattcccacaaaggacattcctagaaagtcttaccccccagggcattggaggaccgcaaacgcaggaggggattcccattggcaggacaccgggagatcacaaggtgcgcaaacgaaaaatgggcaacttaagcagagacagttgttaccgaagggccggaacacccaagaagtaaaggggggcgccacccacagaaggcaagccaccgttgtgccattaatcagcttaaggaagagtatgacaatgtggtgaaccgcactttgcggggtcacccgggggaggcttggctaggcgccacgcaaagacaatttacataaagcctccgaagggcgaaaaaaccggcccgcgtcaacggggggctacagatcacaagataccatgtgcacacacttacaaaaggacaacaaaccacatcggacacagagaagacggcgacgaggggaaccacgccaccacgaccacgagaaggccggtacaaccgcgctacgacacacagtcgggggagcgacaccccgcacaaccggggactcggcgccgcgacacggaaaaatcggcaccaagcagcagtcacactgtcgcgtgtacgcaaacccaacatgcagaggttcaacccatgacacccaggagtggacgacatgagtgcgctatcaagccacaagcgggcaaccggaacgaaactacacagaggcagcacacgagttgcacttaggacgcagcacccactgccccaacgtcgaacagttggatctacaaccaagcgggtcccaactcaacctgacggagggagcacacatcgctgagctaaagcgagcggagcaacacccacacagaacactaagcagtgagcgcggggagcgcacacaaccacaacggcggaggctacgcacaggcacaaccagacacacggcaacagcagcagctagacaaggcgcgccagcaagcagaggacaaacacacagacacccagtaagaaacagtgaagacctaagcagtgactaacacacagcaccagccctcacagtcgtgagtagactagaaacgagatagactaccaccagcacgaat

SEQ ID NO: 554769 - DNA, 406 bp, Homo sapiens
gagagagagagagagagagagagagagagagagagagagagagagagagagagagagagagagagagagagagagagagagagagagagagagagagagagagagagagagagagagagagagactgagtttttttttttcttctctttctttcttctgttattgtttctgaacgcttcttgaaagagctttttttttaattcattggtcttacaccttctataggtttgtgtcatgtcctacgctcttttccatttcttgacgaccttcggccagcggtttcctcgctgctcatgtcgtctctccggtgttctcctttctgtggctctccactcttccgctgctctcttcccgtttatccctaccgtggcaccttctttcggtttccttttttcgtgtcctcgtg

SEQ ID NO: 554770 - DNA, 436 bp, Homo sapiens
cggacggcgtgggttaagttagaagatgtggatatttaaggctatttttaatttctattacagtctccttaaaaaccaaaaaggaatgcattaatccacatttcccttcttcagaggtgtagtgtcctggctctggcaaggaattatgtatttaggtcagtccccagaaatgcagctgctcatacagctgagagaaggctattatgagttcctttacttactttttatactacactgatgctgcttgatagaagtctgtggcttgtcagatatgtcacccaagtaaatgcttgtagatctgattaaaatgaaaagctcacttgagaaacactgcagagttatgtaatgatcttgtgtgagtgtgtgaaagtcaaaggcatgtcagtttattacatttgcaacataaaagtacttaattaaaatagatatttagttt

SEQ ID NO: 554771 - DNA, 194 bp, Homo sapiens
taagaaaaaggtatgacttctggttttcggtcctgggcataatttttattcctttccagtggaaccaaaacctcctgaacccctttcggtgtcatcaaggcttgaacttcttctattctcgtggataaaaaactccgtccgcaaataagctgtgcaatccgatcaccttttttttcctaataactgtggggaac

SEQ ID NO: 554772 - DNA, 419 bp, Homo sapiens
  misc_feature (21)..(21): n is a, c, g, or t
  misc_feature (41)..(41): n is a, c, g, or t
  misc_feature (375)..(375): n is a, c, g, or t
  misc_feature (377)..(377): n is a, c, g, or t
attccctaagaagcccatccntgaaaaaaatagtttccatnatgtgtatgaataaacccttaaaaaaatgttaatatccttttatattgtattaaatgtccatgtctaagtaatcgatccctaaagaaataaccagtcaagccggcacagtggctcacacctgtaatccccagcactttgagagtccgaggcaggcggatcacttgaggcccaggagttcgagaccagcttagccaacatgatgaaaccccatctcttctaaaaatacgaaaattagccaggtgttgtggcacatgcctgtaatcccagctactcgggatgctgaggcagagaatcgcttgaacctgggaggcggaggctgcagtgagctgagantngccactgcactccagcctgggtgacagagtgagactccatct

SEQ ID NO: 554773 - DNA, 1377 bp, Homo sapiens
ctgtgcatcgctttggtgcggcaccctggctacctcctttctgctgacacgcggccagctgaggagagctccgcgccgcatcgccacgtggcccgacgcacacaacgcccacaggcacaggagctcacagacctgagcacacacagcgcactccactactctaactctctgcaaccgcgctgcgcgggcgccagcgcactgcgctctcatgctgcgctgccagcttctacacgcactctaccgcacgcgcactactacccacctctagcctacaacccctacacctgcacacacgcgcatactgtgctgacaccgcacaaggcggcaattggctccaacctgcacgggcacgcactcacgcactctcccgcactctctgcaccgcgcgccaacacccacactccacacccggacacaccgaggcaccacccacccctgccaccgagcctttggccaaaaactgggaagcgcactggacacgcagctagcgcacgctccgcacctcgctgctctcccacacgcacgcccacgtaccgggccgaacgcgctgctccttaccctggcccacacacgcgggcacacccttggccctatccccttatacaccctatccccaaggcacaactcttccgtggcatctaccttctctaaaccacgcagcttcacacgcaactttacccacttgtcctttcaacatctcctacgcacaaaccagcctttggtccccaccctctctgggggctttctccccaagcaccgaaggcaaacatacccttgggcaccccttaacccttaaaccccggcgttcacctcacggtctctcttgtcccatcccttaagcttctccgtagtgtccaagttttccttccccgcccaccattttatcacgcaacaccagagtattccgcgcattatcaagcgtccggcttacccgaccttaagctacccgcgttaacagccctatggggcctacaattatacttggcgtgggccacccacacacacagcgcccactttaccttctggcccaacttcactaaccaaccacaccacgataaaccccaccctaagacacccccacagacccgccatgacgcccccccacatagccggcgcggccaaccagtggctgccccgagcgaagactcggagacaccgacatacacaccgccctccgccgcccgcaaccgccgccgcgcctcgccagccgcaaaccacgaccacccacccgccgggacgcaccctcatggactcgagacaccacaccagtagccccccccccgagtactgcagccacccgcagccactgacgcacacgcgccccacctgtcgctacaagaacgccgacccgccgccctcaccaacgacagcacgtgg

SEQ ID NO: 554774 - DNA, 147 bp, Homo sapiens
gcttgaagtcggcaggacagacatggtatgggaaagaggcgtctctgcaaatttgacttggaaagtaaggtcttgatcttatgatttctttattcttgtcttataaccacagactcatcatcactgatcgaccgaatgttgtcgtgc

SEQ ID NO: 554775 - DNA, 256 bp, Homo sapiens
aaaatctgtccctcgttggtgactctgatcctcaacactgtccaaaagtgtgggaggacctctgttcatatccagcctgggtcattgcagcagtggagttactgtagagggatgtcccaagcttgttttccaatcagtgtacagctgtttgaaactctcctgtgtctgtgtatggtaagtgcgtgtgtgtgagagcacatcagtgtgtgagggctgtgttaccccgatttctctcctcccttacagacccatcatt

SEQ ID NO: 554776 - DNA, 139 bp, Homo sapiens
cacctctaacgactcccgacggacactacctctggtacgaactcgtgtacctgtactaccggacgacaacggaacgacgaacgtaagccgagggcgtctttgcattgtgtagtcaagggtggcaaggtgcatttcatcg

SEQ ID NO: 554777 - DNA, 220 bp, Homo sapiens
  misc_feature (194)..(194): n is a, c, g, or t
gctagataggacttccagtactttgttgaataacagtagtgacagtgggcatgcttgtcatgtttcagatctttgaggagaggctttctagtttttccccattcagtatgatactagctgtgggtctgtcatatatggctttattatgttgggtgtgttcctctatcccagtgttgtgagtatcttaacttctntgcaacataaatattttatttagacc

SEQ ID NO: 554778 - DNA, 524 bp, Homo sapiens
tgatagactattcgcatatgtctagaatgactgtagtctaacaatatcatggtccagacaagagaacgctggatatgcccctgtgtgccgcgacatattaatatgttactaaaatatgaaaactacgtttacagcaatgtcagttttataaaccacagataagatatgtacataggtgagtaagtgcaaaagagtcatcagaattgacatctggggttatacacgtgaccttgataggcagcctaatcctgtatctatcaagaaatctacctttaacaacttaaatattatgctttatggatatgccaaacccaagattatctttaattggaattagaccagcgcttgggtgtgggaagcatgcaatgatcttaacattcagtgtgaaatgcttctgtagaattatagcagaaagcccttgctataacctggcttagtgcagacatgcaaatctgagatagcacaaccagtttggctggactaaaggtgcagatgatcagtctaaacagcagtggtgataagca

SEQ ID NO: 554779 - DNA, 538 bp, Homo sapiens
ggtacgaatgctgttctttgcaatagctgtttagggatgcactctgagagcagcgctacctattcaatgatgtttagaaagctggactacctgttatctgatccaccgaggcacggaatgttccatgcaacaggcttggatctcccggcttgatcttttgtaagaaagggcagcctagttgatctgaaatgatgatcaccaagcctaatgtaggtatcctcgcgagagctcggggaatacctgcctattgcaaaatatagttgataaccgcgggcgagtaatacgtgtttacatctggtcatgctttcagacaatacgcattacgtgtgctcaggagtttgctaggactgagagggctgaaagatacatctcttaccatgtccttcagataggtctatgcttctcagaagatcgaaaatctgactactaggcactatagctctgagagcaagactctgaccgtacacatatattgcacatgcgcatatgacgacctacggttatgcataccatagactgggtgtgcctttctttgcct

SEQ ID NO: 554780 - DNA, 301 bp, Homo sapiens
gtgtcacctcgtcttataactttttttgttattctaagacaccaacttatttgcctcatttagagcaggtcacaatgtcattaacgcttagttgagagttttttctcattccgcggatgtaggaaaaatcgtcactggactgtccacctcttaatcaactcttggcatttctgcccagccttcgtgtgttgtccttatttgctgggatcccttgttgggcaatcactttcccgagctcttagttgttcaaggtctctctgtcttgatcataatattgtacatactggttacaaatttttct

SEQ ID NO: 554781 - DNA, 825 bp, Homo sapiens
  misc_feature (10)..(10): n is a, c, g, or t
  misc_feature (82)..(82): n is a, c, g, or t
  misc_feature (137)..(137): n is a, c, g, or t
  misc_feature (212)..(212): n is a, c, g, or t
  misc_feature (227)..(227): n is a, c, g, or t
  misc_feature (241)..(241): n is a, c, g, or t
  misc_feature (263)..(263): n is a, c, g, or t
  misc_feature (278)..(278): n is a, c, g, or t
  misc_feature (280)..(280): n is a, c, g, or t
  misc_feature (295)..(295): n is a, c, g, or t
  misc_feature (297)..(297): n is a, c, g, or t
  misc_feature (306)..(306): n is a, c, g, or t
  misc_feature (314)..(314): n is a, c, g, or t
  misc_feature (316)..(316): n is a, c, g, or t
  misc_feature (323)..(323): n is a, c, g, or t
  misc_feature (334)..(334): n is a, c, g, or t
  misc_feature (340)..(341): n is a, c, g, or t
  misc_feature (350)..(351): n is a, c, g, or t
  misc_feature (355)..(358): n is a, c, g, or t
  misc_feature (361)..(361): n is a, c, g, or t
  misc_feature (383)..(383): n is a, c, g, or t
  misc_feature (404)..(405): n is a, c, g, or t
  misc_feature (410)..(410): n is a, c, g, or t
  misc_feature (426)..(426): n is a, c, g, or t
  misc_feature (460)..(460): n is a, c, g, or t
  misc_feature (714)..(714): n is a, c, g, or t
  misc_feature (782)..(782): n is a, c, g, or t
cttttaaaanattcaaattcactgatttacatggcatcttctgttggaattcagaacctctcaataggccaaaatgtcctgnttctaactctaaacttcagccttaacaaaaatacgtattaaatgggtggcaaganagacttgaggattcttgattcatcattacaggggacttacccaaaacccaaatgtagtttatctctttgtttganattcaggagaatttnaccctaggaaatgnatcattgtatgaatccattttnatgctgctgataaananatacctgggcaattnanaaaaaaaanaagtttananccgggancagtggcttangcctgnngtcccagcnntttnnnngcncaaggtgggcggttcacaaggncgggggatcgataccaccctnnttttnttggcgaaaccccgtntcttctaaaaatacaaaaaaattaggtgggtgtngtggcaggcgcctgtgacaatgcctgctacacgggaggctgaggcaggagaatggcgtgaacctgggaggcggagctgcagtgagccgagatcgcgccactgcactccaggttcaagtgattctcatgcctcagcctcccaagtagctgggatcacaggtgcccaccaccgtgcctggctaatttttgtatttttagtatagacggggcttcaccatgttggccaggctggcctcaaactcctgatcgcaagtnatctccccttggcctcccaaagtgctgggattacaggcatgagcaaccgcgttcagcccacatgattnaattaccaggtccctcccaagacacatggggtatggggagcta

SEQ ID NO: 554782 - DNA, 604 bp, Homo sapiens
ggagctacaggtcacatggacccttcaatctgcagtctcattgccaagggatgaccagctgaaagttattgaatgcaacgtacgtgtctctcgctccttccccttcgtttccaagacactgggtgtggacctagtagccttgggcacgcgggatcatcatgggggaagaagtggaacctgtggtggactaagtgacgtgggttctggagtctgtgggagtaataggtgcctcatgttctccttctcccggcttggcgtcgtgcatgacgtggtgttgggtgtggtaaatgaccagtactgggagagtgtgggccggctttggggagacgcgctgtgaggcatatctccgaaaggcatgtctaagtcagtggctaaggatccccaaggaaggaataatcctgtcgtgaccattgaaagcttttacgaactttaagcgagttgttcccatggatgtgctggctatcgtggaggagcctgggactacatgactctagtgccaggtctcgagtacaagtcgtgacttctacactgagacatggctgtcgaaggtaaccaagctgtggactgacacattagaggaggctgtggatggtgaaatgaccag

SEQ ID NO: 554783 - DNA, 846 bp, Homo sapiens
agcccaggtcctgttcccagagtgaattgccagccccttccgcccgtttccatcacgagtgccgccagcgatgtctgacaaactgacctacaaagtcgacgacatcggctggctgcctggggacgcaaggccctggccattgctgagaacagagatgccgggcactgatgcgtatgcgggagcggtactcggcatccaatctctgtgaagggcgcccgctatcgctggctgtctgcacctgacctgtggtagacggccgtcctcattgaagaccctcgttcaccctgggtgctgaggtgcccggtggtccagctgctaacatcttctccacccaggacgcatgcctggcgggttgcccatatgcccaaggctggctattctcgagctgtattgcctgagaaaggggcgaaaactggtatcgatgggagataaccctgtgaatgacaatttgaagcaatgaaaccacattgtatatctttcataggaacagggagaccccctccaagctattgacatatcctgggacctgacagagagatgctaagcttacaatccaaaactcatcaatactatcaaagcaaaatgtacaccggcaagactatacatgcaccattgtcgattccgcaaggcctcattcttcatgaagggacagaacctaacagaacttgggatcggtgccaaccaaactcctcccttaccacagcatggaattgagccacaaggtggtcgactcccctcacagggatgcccttgcgcaatacaaacttgttcaacattgaactccccgtcacaccaacagaaggcaaaggtctgaacaaacactcctatgacgtagccagggactca

SEQ ID NO: 554784 - DNA, 482 bp, Homo sapiens
tatctatactgtctgcctgtcactggtgatgcagtggcaacatagctcactgtaccttaactcctgggctcagtggtcctcccactcagctcccacatactgaatacaggttgcacactgttcctgggtaacagttggaacttcttatctctttttagggtcttaacaaagaattttgttttatttttagaccgaggtctataactttttctgtgacaggcaagatagtaaatagacaagactttgcaggccagaccatctctgctgtgatgactccactctacctttgtaaaagaaaagcggccatagacaatatgtaaacaaatgagcaaggctgtgtgccgataaaactattaaaggacactgaaattttcatttcatataattttttcatgaaatgatgtttgtttttccccctatcatttcaaatgataaaaaaaattccttaacttgcagttcagacataagtaggcagtagcctg

SEQ ID NO: 554785 - DNA, 149 bp, Homo sapiens
atcatcctcccacttaccaaactcagcacacgtcactgtgtttgccacaaacatcacacagagtatcgatctgtctgatgtttcagggacccagccatgtcatggagggtacatgggcaggtaccatctcttgcctggtacatcgggca

SEQ ID NO: 554786 - DNA, 330 bp, Homo sapiens
  misc_feature (222)..(222): n is a, c, g, or t
tttcagcacgctggagtggaaacaggaagggtatggtaatcacacacacgcaagggaaaaggagcaagtagcggaatagttgattatgtattagtctcacgctcagtaaatcggcactttgtgtaagctgtgtgtgaacatggtagcagctacctgtgggagatatttaacacttttatctcgtagctgtctgagttaggaacaataaggaaaggcagcttncttgcagtgactcagactttcagcgtgaagctttttttcgttgttggcagaagtgaactgtgggtactccacgcgtgcgtgatacacagggtaccgtagctcgaaatt

SEQ ID NO: 554787 - DNA, 131 bp, Homo sapiens
ggaattcccctaaaaattttaaaaggcccccaaaaggttaaggtttttttttttggggttatttaccaaaatggggccccgcccccctttttgggggtttttggggaaaaaaaggggttgtttttttttta

SEQ ID NO: 554788 - DNA, 1040 bp, Homo sapiens
cggctcatcctcacgtgaacttcaccagagcactcacaagatcttcttactcaggctctggcgctgctgcctcagctgctcttcggccatcagagaacaacttgcacatgacttcctggctttcctggccataaattattcctggatgagacatgtggcttaactcacaggtttcccatcagctttctccctaaaactatgttcatctgcctctctctgaccagcagaacatacagccgagaatactgccgcagctgagactgactactgtgcattaggaaagacctggagtcaggactttggctgggataaggagctccgaggcagtcaataactgaacaagcagccctgtacccctaggctgcacgaacccttgacactgcatcctctcccagaacctgacacacaggaaacctggcgaggctatcgtcaggtcagcccacactgcatgcaccacgcacaccatcctcagacagccaatgttgtcatctcatgaagcaggcaacgaacacgcggcacacccacactgtgaccctgattccggtatggcttgcactacacgtacccctgcaaacctcctagcactgctgtgctaacacccagggcaagcactgctgactgccactccaggcaaccccatgaatgactacgatagcaagcacagtgtatgacaacggagccctatagaactaaatgccccccaaacaaacaaatagactactcgttgctgcgcacatctctcctttccatagaacaaaattcaaaacgacgacaccttaactacctatcccaattttaccctcatgtaattctagaaatacacatcaacaactcatataccttaaagaccattcacaaataccctctctctgtcaaccgtctctcaactaagaacgagcggaacctaaatgaacatatacccaaaatcaccaacagactacagcacaccctggatatacacccctgactgatggtgacaaaccacacacaccttcagaaatcactagagccttacactaacgcgccatctacatctatcc

SEQ ID NO: 554789 - DNA, 1008 bp, Homo sapiens
  misc_feature (3)..(3): n is a, c, g, or t
  misc_feature (197)..(197): n is a, c, g, or t
  misc_feature (201)..(201): n is a, c, g, or t
  misc_feature (206)..(206): n is a, c, g, or t
  misc_feature (211)..(211): n is a, c, g, or t
  misc_feature (215)..(215): n is a, c, g, or t
  misc_feature (241)..(241): n is a, c, g, or t
  misc_feature (309)..(310): n is a, c, g, or t
  misc_feature (339)..(339): n is a, c, g, or t
  misc_feature (345)..(345): n is a, c, g, or t
  misc_feature (393)..(393): n is a, c, g, or t
  misc_feature (417)..(417): n is a, c, g, or t
  misc_feature (536)..(536): n is a, c, g, or t
  misc_feature (610)..(610): n is a, c, g, or t
ctngcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtgcactggacacacccgaggattacatttttcgtcataccngagncctcnccganctcncagactatccaggagggtagcagggnacagccctatcaccctccagatataaaacccctctactgtgtcccagccagcatgaccctgctcttcnnggagtctggccacaagaaggggagctttntggagngcagtgaggtccgaacgatcgtcattaactacgccaagaaaaatgacntggttgatgcagacaacaaaaatnttgtgagattggatcccatcctatgtgactgcatcttagagaaaaatgaacagcatacagtcatgaagcttccatgggacagtcttctgaccaggtgtttggaaaaattacagcctgcntatcaagtgacccttcccggacaagagcccattgtgaagaaagggagaatctgtccaattgacatcaccctagnacaaagagcgtctaataaaaaggtgaccgtggtccggaagttggaggcctatggtctggacccatactcagtggctgccatccttcagcagcgatgccaggctagcaccaccgtgaatcgtgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatct

SEQ ID NO: 554790 - DNA, 421 bp, Homo sapiens
gagctatcctcccatcgcatagttattatctcgccagtgttgctctatatagtacactgggatttatactactggcagttgaatgtgctctagacctatcttctcttcatccccgttgacaacatgctcaacctcaattcggcctattatgctgcctgtgctcgaattcagaacacatcatcattcatcggcccctgtgtgaatattgtttccactaactgcgaatcctagtgtaataagacgtgctttgcttcgcttatgatgttttgggaattccctttgtgtatccggagttcatgtactccagaagaagtgattcccaagagattgcaagagacacagaggtcataacggtaaacagccgtacgcatctcccaggagattgggaaccttatgaaggaaatcgagacccttgtggtag

SEQ ID NO: 554791 - DNA, 383 bp, Homo sapiens
gctctcagtgtgaaaatttcagaaatatacacatcagctgtgaggtgtaggcgtaagtggtcagtcccgaagttgagtttgagctgggtggaatgacattgtgaggcaacgggtactggtgtagggccatccttttatcaatttcatcgtccgctgaggagtgtgtgctttttggattgtagaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatct

SEQ ID NO: 554792 - DNA, 278 bp, Homo sapiens
cagtatgtttgttgaatggcaaaatcttgcacgtccaaatatgcctctttggcacaggattactttaaactgattattttgggaaacagacacaggagaagctctgaaaacagtaaaagttgtatttttgtaagagaaatttattttataaagaatatctacatttgtaagagtgtcttcctttctgtaccaggaagagaaggatgactaaatcactggaaacttttatttatttgtttgagacaggatctggctctgttgcccaggctggagtgcat

SEQ ID NO: 554793 - DNA, 359 bp, Homo sapiens
cgggtgtgtctcgtgtgactgacgggttttatgttgtaaactgtggtgggtgagtgacgccccattgtgttgtggtaaatcatgtagagggagtatagggctgtgactagtatgtatgggtcctgtaagtaggagagtgatatttgatcaggagaacgtggttactagcacagagagttctcccaggtagattaatagtagggggtaaggcgaggttagccgaggcttgctcgcaagtctttcaacccagctatcagtgggagtagagttcgacgccttgcagagaggcatcatgatgcgactgtgagtgcgtacagtagattgagtaatgctcaggccaccaatcgtaatgagggatg

SEQ ID NO: 554794 - DNA, 432 bp, Homo sapiens
  misc_feature (14)..(14): n is a, c, g, or t
  misc_feature (19)..(19): n is a, c, g, or t
  misc_feature (57)..(57): n is a, c, g, or t
  misc_feature (122)..(122): n is a, c, g, or t
  misc_feature (248)..(248): n is a, c, g, or t
  misc_feature (373)..(373): n is a, c, g, or t
  misc_feature (387)..(387): n is a, c, g, or t
  misc_feature (419)..(419): n is a, c, g, or t
taagcccctacccnaaaangttttaaggagtttccttggggggttaaaaaattgganaaagaggaccctgaaggagcctagatcacctcataatccatagggtgtgtatgttttaaaaagtnaggagagacccattcctaaagcttgtgggattagaatttgtctcaagagcccggcgtggtggctcatgcctgtaatcccagcactttgggaggccgaggcgggcagatcacctgaagtcgggagancgagaccatcctggctaacatggtgaaaccccgtctctactaaaaatgcaaaaaattagccgggcatggtagcacatgcctgtaatcccagctacttgggaggctgaggcaggagaatcacttgnacctgggaggcagnggttgcagtgagccaaaattgagccattgcanccccagcctgggc

SEQ ID NO: 554795 - DNA, 618 bp, Homo sapiens
ggaaatacagttgttggcctccggcctcccctcaaaaaaaaaaaaaaaaaagaaaaaaaaaaaaaaaaaaaaagaaaaaaaaaaaaaaaaaaaaaaaaaaaaaaaaaggaaaaaaaaaaaaagaaaagaaaaaaaaaagaagagagagaggagagaaaaaaaaaaaaaaaaaaaagaaagaagaggggggggggggcggcggggccggcacgaagaaaagcagacataggacacaacaaatccatggcgagggcggggcggagcgacgcggacagacacataaagagagagaacagaagacgaagagacgactacaggcacagccttgacaacaagaacagcacgacacaaggagtaaaagaagagggagagggcggcggtgcagccacacaccaaacaagaacaacagagagcgcgcgcggcggagggagggaaaacatagaaagccggtaagggaaagatacaagaaccagacagagaagcggagggggagtagtgttgaggagagtaaaggagggtgcgtgtgagcaattaacgaaaggcaggcgagcgggacggcggagggggaaaagcatagaaaaaacaatgcaccgccccgccgcgcgggggggtgggagc

SEQ ID NO: 554796 - DNA, 165 bp, Homo sapiens
cacatcgtatatagtattattttaagaaattgccacagcactctagccttcagcaagctactaccctcatcggtcagcagacatttacatcaaggcaagaccttccaacagcaaaaacattataatttgcagaaggctacgatacagatgatcatatagcatttt

SEQ ID NO: 554797 - DNA, 166 bp, Homo sapiens
  misc_feature (142)..(142): n is a, c, g, or t
acgcccttccccacagtgaggtgaactttctgcacttgtcctcatcacaccctcagtttcacatcagaacccttacctcactttagttttcattggccatttaattgtctaggcatcttgcagaaaggggtccatgtctctncttgctcaactgtggggagaaggg

SEQ ID NO: 554798 - DNA, 189 bp, Homo sapiens
ggtctggggttggcttgaacttggtctccttaaatcctcatgtcactgccacgaaactggccctctctatttgtctcagttttacacctggtggacatggtggggttagtatttgaacctcatccaaccccatactccagttgggacccctggctgggtctctggccagtgctgggaaagagggaggca

SEQ ID NO: 554799 - DNA, 874 bp, Homo sapiens
gtaactgctgctatgggacctcgatgtggaggtctggcaatgcgttcgcctgtctgtatcccgtgaggatgcattcgaggggggagtgccattatcaacgcagacgatggtgttgcccgtggatcgtggcgatgcacaggcacttgtgcagagcggtaaggtgagccggaaacagtacaggtgctataggggccgtttcgctagcgtataggtaagtcctgactcgctatccgattaaccatgggttgagtattgaaagcgtggaatatgaaattgctgtccagagaggtacacagaggcaagtacgatgtacacatctcactacatattatgtctttaccactctctaccaatggagattcaacacggtggctggtttccattccacgctacgtcgtgcaataatatcttcccactagcacagaaaaacacccgtttatcgtaactatttccacggcagctgaatgcggcgatccaccactacagcgttttccaatcatagaccgagctagaagcgggaaagttaaccaccaaaggcgagtcactacggtctcgcgtggaggaatccatgtgcggtgggttgggtgactctcggccccttcccaaggtacactcgtcttacggtcaaccattgagcgattgctcttatcgctgagttggtgtccacaaggcagagacgcaccaagtcccttggaacatacgataccagcgcaggaggagcgccacgtccccagctcagtgtataagctcacgccacgacgtcaggctgggaagggaacaatctgtcatcacatcgcaatttggagcgtttgactacccccatgcctttgtagtttcacaaggtgtccaaacagagattcgctcaggggtggac

SEQ ID NO: 554800 - DNA, 126 bp, Homo sapiens
agcaacaaacacaaacaccatattgagaggtgaagccggctggtgcctctggggtcaggtggtggacttggatgcaactttatctaggtctagcctaaaggtttgtcaaaggtagacaatcagtcg

SEQ ID NO: 554801 - DNA, 201 bp, Homo sapiens
  misc_feature (3)..(3): n is a, c, g, or t
  misc_feature (33)..(33): n is a, c, g, or t
ccnaaaaatgcttccctgtagggtttttagatnctcctggagaggagttaaaaccactcatctcccctgtctcggattctaatgcattgttccactgagggacagggacaagtagtgattaaaattcattgaccatgattcttagatttggaatatagaaattttgtttttgggctggagagatggcttagcagttaagaa

SEQ ID NO: 554802 - DNA, 200 bp, Homo sapiens
tttaggaaggttaaatatatcattttattggggatgagatcatagtctttacacaaatgctatgtaaacaaggttacggaatatttttcacctcgtgggagttggtacacaacctttaatatagaccacccacgggttctcgatgctgttgaggtgtagaagggcctgaggatgtgcaggagcgcaagagtgcgagcaaa

SEQ ID NO: 554803 - DNA, 789 bp, Homo sapiens
agcgggcggaagggccctggccttgtgggtggaggtgaagagttaatggctccgcgcgcaggcactgccctctgaactggaacaaaatgcaacttccggttggagtcactcggccaggcgccggcgaactgaggggagagggagcgcagctgaaagcgtgaaactgtgcctgtcatttactcccatcctttatagtgatgctacaggacgaagagggatgggtttaaacattggggagcaactctataaagcgtatgaaaccctttcgggaagcatgcgtgggtagagattctgcagtaaaagaatttcagccgaaagactgtgaactatgagcacgagaataccgtgtacaacacgggacaagctgtcgacttcttacagactattttttgagaaagctaaaaatctccacgttacttcttgtgaattccactctcgatatcaattatgggcggtgttccctctcgcgttgaaagacacgtgagacccagaaagaatattttgactcttgggtcacgcccacaaagataaaggtgagttcacggggaaatatgcgcgagaagaaaactatcccaaggtgtgaaagaccccgagggtgtctttctcctatgaaaaaaagaaaactttcacgcccagggagtctttgtgcacgtcctttgctcccatgaaagggggtgacatataggacgaaaagacattttcctgggagtctgaaagaaagaattttctaaaatattgcgtggctagcccaaaaagcgcagaaaagacactttagcaacttatatatca

SEQ ID NO: 554804 - DNA, 1210 bp, Homo sapiens
gctcccttccaagtcacagatgctgctgttctcaacaatgtagcacacagcattgggcctaatggacacagtcaagaaggttgtagacaacgagaaggaaccaagtagaggcatgggagaagaacagttgtctctatactctgacagacattggaacgccagttggaggagcagaagaagcaaggcacaggatcacaggctgaatatctcgagacgagttcaaaagtgtggtactgatgcctgtgagcactccgtaagcctccaagataaggccccggcgtcctagcggcacagtcgctccactcgactgtcttgagactccttctcctcctgtcacagccagccgtcagttctacatggcatctcaccgcatcaccatcaaccccagatgggatcagtcattttccatgggcaatattccagtggacaacctcagccagggctccaggtcctggtgaactggttcccaaaagaatgagcttcatgggcctacagactccttcccggtatagtgcacaaagtggtgcttctctcgtgcacagagagacaagactacacccactagtaaccaacaggtgacactatcaaccacaccttcactcatacgcattgagccagctgcgatgacgctctaacgtggccagtgctacggcatggcgcagctcaccactgggggccaaccgatggaaccacccagtgggctaaagaccctgagtgacaattggcgccgcgaccatagggaagctccaggcctcaaaccgttcggccacatccacgggctagacggaaaaggcacccccaagcaggggattcggggccacgcaccccaatccatctgacgacagttggaacaccaagaggaccccgagaacaccccagaacgcactgacacagaactacctcggaagggcggccaccaccgccccacgcaccaccccgcctggggcagacacccaggacggccctcgaccggcgaccctcgacagaggcagccaaaacagcaatcgccggacctcaccgagcacacacccgcaacgcccacccgcaccaccgaccaacgccacagcagctaaacgcaaagcgcgcgcaccactcacgtcgccgccccactgcagccacgacaacacaacagcaggcacaagcatagcgcacgagggacacgcaccgcccaccgcaccagcgcaccgcccgacacgcacccaaccccgac

SEQ ID NO: 554805 - DNA, 615 bp, Homo sapiens
atgctattctctgtgccataccagagtacaggatcagctgagctgaccttactctgacgactaactcttttgctggaagcggcttctgattcacagctcttgtgtactaccagacatgttggcggtagagattatggcttttaaggggttgtacgatggcgtcaattctgtcacgttcccgctgcaggtttaactaaaagggagtgacacaatgacctctgttcagtgatcaaactatacaatctatgttcatatccaatccctggctctggagtccaatgagctagatacatttgctctaacgcctgatgctgctcaacttgccaaaagtgtgactacgctctgacatactgtaccatgctcacagtgctgctcgccatataggtgcatatttggcaaaaccatttgcggagtacctgcaggctgaactgcagaagctataccacataggctgaatgggcacaccacaaggggactgacttgcctggatagctggttggacgttgacatggtgtgtcacgttagcctatctatcattaactacatggtacagagttatgctaagcgaatccagcagcagctagactcagaggaggacttaactcctaggttccg

SEQ ID NO: 554806 - DNA, 539 bp, Homo sapiens
actatgctgtacaactgcctggacttcctgcagtggttggtgcctgctcaccacggtgactgcttaggacgaggcccagaggtaacattacagggtctactttggggatatctgggacaagatgctgcagtaagggcatgtagaagagttgtgtgcttccggtgtccttgcagttttgtgctctgccctggcaagaagagttgtgtctgcggttcatgcgggaggtggatcgactgatgacccctgaaaagcagtcttcctgatggctctggtctccagaggactctgagacttacatttctgcatgcccagcctagtttgggcactgctgccctgccgcctcagcaaggaaatgtcctgcatggggcagaggcttctgtgtcctctccccctatccctttatgatagcgccgtactctctgtagtctggacttctatcccttctctggtttccctctcttcgtcctgattcctctcattcccattttgctgcccatgggtatgacattgctcaaggtccaactaacagtttagaaact

SEQ ID NO: 554807 - DNA, 220 bp, Homo sapiens
aagtagtagctgtgttcgtgtgtgctgggtacgcgtgtgtgtgtgtatagtagtagtatatatatgtatagtagggaagaaagtaataatggctgagacatcacctacatagtagtttgcgattgggatgggtgactaacactccaaggtagagtgaaggcagaggagggaaacaagatcacataaactcgtcatcagtactaggtttctgcctacagga

SEQ ID NO: 554808 - DNA, 601 bp, Homo sapiens
taagtccatactctttcatcatctggaccatgctttaccatgtcccaggtgtcctgtccttgaagtaagtttataccgtttgaattgcatgcctgccatcatttatccctccatccacctccgtctactttagaacactgtatcatgggatctgatgttaccaagccgtcattgtctcccatcatctgagatgctccatccatgagggcattaccgactgtgcctctatacttgttcactaagatctggtatttgttggcttcattctgtacagtgattcctccatagtgagcctttactttgtctccattccagtcctccatttctatcaaaagttctgtgggtcccatcctggtaagctgtctacttgtatcatttgcaatgccaatattcacctggtagtcctcagtaattcgtgccatctgtgttgtctgcaatcatttcctgatcactgtttatatggatcccatttcctgccaaagtcatcactaccgtcttgctcggttatgaatcactgtccatcctacatcttctgtaatcatgtcccagtatactctatacggtttgacagctctgtcaggttgaatgacatacatctcag

SEQ ID NO: 554809 - DNA, 948 bp, Homo sapiens
agactgtggccgcgatactttgtgggaagctcgcgcgatagttcgttgtgccgaccctatcagtgttcctctgtgccggtctccgcatatcctctcgggtttctcgccttctgctcccgggatttttttacgccccgcgggtgggcgggatcaccccacggcaccggggggtctctggagcacaacccctggggcgacgagtagtggggaacccctgggtctggtcgctacaagcgtggcaatcttgtcgggccatctgtgcgcggccgcctgttactcccccgctccttctcttgcacgctctgctgttccggcaatctatcctttgcgccccccgagggggtaggggcctgcccccgtggtcggacaatgtcctccccctcttgttccctcctccggaggcccacgagtcgttgtttctgccgacgcccagcatcgctcaccccccgttagatctcccgcgcgcctcctctgggttctccgccgccgcgctgtggcccgccccacccgctttggcggccacacagtggggacgtcccgcctttctccggcgggaatcccgctgcattgacggggacgcctctctctctcgcggggttaacactcggttggtgtaaacacgcgctgttgtggctgattaataagcagcggcaaaagatcaccgcggcttctgagctgcgcagaggccaccacccgctcagcttgcccccagctgatttctcggtagagttggtacgggcgcgacaggacattggtgaagacaccctgggagcagcagccctcccgctccagtgccactggagtgcagctccaccctctgtaccaactccccacctctcggacgagcaaagagtggcaagtaccccttgtcccccaacaaataaacgaagaaaatgccccccccaagttaacccctttcgcaaaaaaaaattttcgtcccacaaaaca

SEQ ID NO: 554810 - DNA, 169 bp, Homo sapiens
taagatctctgtgtcgctcactccaagtctggatcaggtacgagccacagtcagcgagacccatcactttgactctgtcttcatatatattgccaatctaactaccttttatatcttctaattttatccttctagtatatgatggcattaatcacttggcccagattat

SEQ ID NO: 554811 - DNA, 262 bp, Homo sapiens
ccagtcttctcccatcagcagtagatcagataaagaaaattggtacatatacaccatggaatactatgcagccataaaaaagaacaagactgtgtcctttacagcaacatagatggagctgaggctcttatcctaagtgaattaatgcaggaacagaaaatgaaatatcccatgttctcacttataagtgggagctaaacattgattacacatggactcaaagaagggaacagtagacacgggctgatgggagcaagatgcg

SEQ ID NO: 554812 - DNA, 210 bp, Homo sapiens
gataaggtttgtataagacatcagctgtaatcattcctgtgctgtgtaatatattacccttggtaggtattagacttgcacttaaattaaaaaaaggtttctgcatcgtggaagcattaagaaccagagtggaacgcgtggcctatgcaggtggataccttcaggtctttcctttggttctatgagcatctttgctttcattcgtctccc

SEQ ID NO: 554813 - DNA, 203 bp, Homo sapiens
  misc_feature (103)..(103): n is a, c, g, or t
tttgagactagcctgagtaacacacagaaaccctatctctacaaaaattagaaaaattagttgggtgtggtagcatgtgcctgtgttcccagcttcttagtgnagtgagggtgaggatcacttgagcctcccaggctcaagtgatcctcacacctcagcctgggaggttgaggttgcagtgagccatgttcgtgccactgcac

SEQ ID NO: 554814 - DNA, 676 bp, Homo sapiens
ctgcttgaatacttctcccacagataccctagttcatcactttcaagtttgctcttccacaaagccctcagacatggacacagttcaaccaagttggttttttttttttctaatttataaaaaggatagcctttactctaggttccaagagagttccatttgagaccttgtcagaatggccttcattgtccaaatttctgtcagtattctggtcatgatcacttaaacaatctctagtgagttccaaactttccttagtcgtcttgtcgtctaagcctttaccagaatgaattgaaggctttttctggccttggcctgctcctccaaatgcttctggcctctgcccttactttcacgttttcaggtattcattattagcaacagccccacttctgataccaattttcttagtccattttctattgcttataacagaatacctgaaactggataatttataaagaaaagaagtttatatatattgatgataattgctttccagaaagatcgtgagggccttcttgctggtggggactctttgcagggtcccaaggtggtgcagggcatcacatggcaagcggtctgagtgtgctagttcaggtctctcttgctgttcttatgaagccaccagtgccactcctgtgataacccattaatcacttaactcattaatcca

SEQ ID NO: 554815 - DNA, 384 bp, Homo sapiens
agattcctaccatacgtttggcaaatgatattcacagtagcaatcagatttagaagcttttcaaaaagaatctggaggccaggtgtggtggctcacgcctgtaatcccagctacttgggaggctgaggcaggagaatcgcttgaacccgcaaggcggaggttgcggtgagccgagatcacgccattgcactccagcctgggcaacagagctagactctgtctcaaaaaaaaaaaaaaaattaaggaaggaaggaaaggagatcctggggtccctcctctctttctggctaaattcgattggagattgtccccatttggaagggggaggtggcacttccttggttccgggaatagctgtggtataatttccatcctggtcacacg

SEQ ID NO: 554816 - DNA, 356 bp, Homo sapiens
  misc_feature (90)..(90): n is a, c, g, or t
  misc_feature (97)..(98): n is a, c, g, or t
ctgtgttggccaggctggtctcgaacctttgacctcagttgatccacctgcctcaggcttccaaagtgctgggattacaggcgtgacagncacgcgnngcctcatcctgtattttttaatgttctgttgtactttataatggagggagcatctcttctggtttacatgctctggagtcagtcaatagactgaaatgctcattctactagctgcacgaccttgagtagattaacttctctggcttcagtttcttaccctgtaaagtaggcttatactgtgtcatggagctgctatgaggtcgtttttattgttgttgttcttcttcctttttttgtttagagacagggccgtcgacg

SEQ ID NO: 554817 - DNA, 288 bp, Homo sapiens
gatccccgcgacatgcgctgtagccatactaccaatcaatactcatcattaattatcatacttgctatagctataaaacttggaatagccccctttcacttctagcattcccataggttacccatggcacccctcttacatccggcctgcttcttctcacatgacaaaaactagcccccatctctatcatataccccatctctccctcactagacgtaagccttctcctcactctctcaattcttatccttcatatgccggcagttgaggtggattaatccatatcca

SEQ ID NO: 554818 - DNA, 447 bp, Homo sapiens
ttacccgctcactccattcgccgcattagtgtctgagtaccttcactacaggcgctgcaccatgcccggtaatttttttttaattttcggtagagacggggttttaccgtgttagccaggatggtctcaatctcctgacctcgtgatcagcctgcctctgcctcccaaagtgctgggattacaggtgttagccaccacagccggccctcttttttttggagatggagtctcgctttgttgcccaggctggagtgcagtggcgcaatcttggctcactgcagcctctgcctcccagatacaagtgattctcctgcctcggcctccagagtggcttggagattgcgggcacgtgccaccacgcctggctaatttttaaatttttagtagagacagggttcaccatgttgtacaggctggtctcgaactcctgacctcatgatccggctg

SEQ ID NO: 554819 - DNA, 1212 bp, Homo sapiens
catagaataggatgaaagccgagacgtgagcgatggagaatggacacgcgaggaggactatcgtgcgagttctccagaatggaggaagatgttacgatcgcaagtagcgtcgtgtgagagacattatccaatgtgtaaagccctgcactagtgagtcatgcgacgtggagaccacgggccatcatcatgatcccagctcgatctactacctatattgccgaggcacaatatcacagagcatctcgcgcgaacgtccccggacaggaccctgcacgacattcactccgcagtgagcctaagcatgcgcatgatgtgcgagcctcgggactaagatcgacggcccgaagccagcagaggaagcatagacgaaggccaccgacatgactgatatggcgaagacctagggcagcaacggccaccgtcgttctgtgacaagatttcgaattgaacacacagtcgggtgagcgcagtgaccatctatcgtcctcaacttattacacttccaaacgttgaccatcggccgcagattggaaacaccgcggaagagggtctccctaggacacacctagatttcctgtccctttacccggtggggccgtggcctcactcgccaccaaaacgacaagaccttatcattcgatcctcggatgagcatggtcaccgaaaaaccgagcgtggatccccaattccactaatggcgagatgtggcctataagttagcgaaaaccggtaccgtaacgttacacgccacagaaggtggtatccggtaccccggtttggtgagacgcgcgtaatactagatgcgcatcagaggagtttgccccacagtgatgcgagtcggttcgctgtcgacgccccaatacccctatgattaacacttaggaggcgttgtaggtcaagaggacctcccaaattacgcgaccagatacacggacagcgaagagagagcaccagacacgagtaactcacccgatggtgggcccgcaaatagagagccactcgaggcatcgggtccgaggaaagaccagaagcataggggtaccacataaacgatgggcgagagctgacgagtagcaggagcccgcacacacagggccacccactcaaagcaacggacgtgtcacactcctcccccttgccggctataacctccgctgaacatgccacgcaatgacaaccacatgccgtgggaggtgcacaacaaaggaagcc

SEQ ID NO: 554820 - DNA, 179 bp, Homo sapiens
ggttttattttttttccgggggttccccggttgggggaaaaaatatttttgaccccgaaatttttaaccccccggggggggccccccccccaaaaaattttaaaaaaaaaggaaaagctttttttccgttttttttttttttggggggggggggttacccccccggggtcttgttttta

SEQ ID NO: 554821 - DNA, 116 bp, Homo sapiens
taaggtcgatcagaggatcccctttttttttttgggacagtcttactattattcacataataacacaggagaagaaaagaaacactctaagaacacatcgaagcgcagaggaaagg

SEQ ID NO: 554822 - DNA, 86 bp, Homo sapiens
aggttgttttgggatccccccccagcccctggtcagtttgcccttgtccctggtttgaggtcattaaaattacattgaggttccta

SEQ ID NO: 554823 - DNA, 265 bp, Homo sapiens
aatcagtatctcttagaaaataactccccattcttcctccccccagccccggtactttattctactcccgtctctgtaaattgcctattccaggtagctcatgtaaatgggaataatatatttgtccttctgtgcctggcttatttcacttagcataatgttttcaaggtccatcatgttgtagcatatatcaaaatttcattcctttttatggctgaataatattccactgtatgtatatacgcattttgtttgtccatgcatc

SEQ ID NO: 554824 - DNA, 222 bp, Homo sapiens
tgacactggccagattctgctgccactgaggcactggtggcacgagcaggctcgcctgtgtgggccggcggagcgatgatggtggtcactgggtaaggcggccctgcttgaggccgcaccgctgcagcagaagctggaagtcttgttggtctgcgtgtgggttgtgtaagtagacagtgtagttgtaccccaggtggggcaagtccacgagctggttgcccc

SEQ ID NO: 554825 - DNA, 299 bp, Homo sapiens
actgttccgagagtatcagggacggctagagttaacagactggtgattataacaggaaggcagagtgaaccaggatgcgtcagtcttactagaacaccgagtagtggctgtcatgctgatctcatacaaatactcaagtaaaaaaagatgttagatttaattcttatctgagtgccaaataagatcagagcaaaataaaaagttagtatacagctctataagaaagctaccgtctatacgatgtacatgtaagagatacgtatctctaacattacacatagatagcactttatcagtat

SEQ ID NO: 554826 - DNA, 1397 bp, Homo sapiens
  misc_feature (361)..(361): n is a, c, g, or t
  misc_feature (379)..(379): n is a, c, g, or t
  misc_feature (408)..(408): n is a, c, g, or t
  misc_feature (425)..(425): n is a, c, g, or t
  misc_feature (444)..(444): n is a, c, g, or t
  misc_feature (458)..(458): n is a, c, g, or t
agcggagagattcctcgaaggctgcacagcagttcaggacaagatgactcactccgtgtgcctctaggctggtgctcgctcctactctctctctgtgcttggcctctgagcaagcgctaatcccaggcgatatcatcgcagacgtattaaagtgtgtatatcttccatctgctcactctccacgccatgtacgtatagtggaaaaatgtcaatatgtattccttgcaatttgacctattgttgctcgtgttgtgttgcataccatccgaccaattgaaagctatcgaactgtgacctaggacagacagttggacgcaagaagaaaattacgaagaatacccgtccggcatgccatttcgangcatcctctcgtgctgtntatttacgctatagggacataatgcgtcntatatcatctacttctncgtttggttcacataacanacattcgtagtatncgtacgcgcacgcgcactatgcatatatatacgataagcatgtatattggccattgaccctgtgtgtggcacatccgcatacgttagacttaattgatcaggccacgtccccgactgtaatcaaggttatcacagttagtggcgtatatcgtaggacaacaagtagataataaggccacggcgatcctagtcgtggatgagtcctatgggaaaggaacgtggactcgggccaatatatagtggcactttgtgcccattggggacactatgtcgctataatatttatccattgactttttgaaccttcttgggcgtcctttgtctaagaaaataactctagaaaatagttggcaatttcaccgtaacgagacaattataacgaccattggtttggttgcacaaccacagacatcctgttgtacagagcgcgtgtaattcacactgtatacctgcgtttatacccaatctgtgtaacctgaatgcaatttcgttatcctttatttagaatacattttttccataaccgtgtgtgaacgtatgtccatgtgtcacttccccagatgtgtttaccgcaaggtggtaactcccctaaggaacgaccaaggtggttttagcccttccccccattccacgtggctcatgccctttcattatggggcatgccggggccgtcgtgggctaaaagttggtgcaccgcatgccgctaagggagcggaattgcccagagcagggtaagatttttccctacgtgtaaattacccaaatttaatatccagaaaccaagttgcgttgtcgaggcaccaagtagttgttttgtaacacccttcctctcttccaaagaaccgctttcgtgtaggcccaagctgtccagagagaatgtcctttgcgctataaaagaggacataagagtaataaagggtgcggattggcccagtgtga

SEQ ID NO: 554827 - DNA, 177 bp, Homo sapiens
agaatctagaggatcccgaccattgtgtactcagtggtagggtgggaagctgaggagctgaggtagtggcagctattagatatctactactggtaagagccgaggaaacgcatcgcaggacagagagtggggagacagcaggtcactgaatgagcctagcagtcctgagcagatggg

SEQ ID NO: 554828 - DNA, 580 bp, Homo sapiens
  misc_feature (551)..(551): n is a, c, g, or t
agaaagacatcgaacgattaaaacaaagaatccgccggtgaacagaaggcctccatctcttctctcgacggcagcacccgattaaagccttccttggcgatgcttgtgatctcagtgatgggctttctgtgcagcgagcagccggacctagacctgaaccctggtgtttcagtaacagttccagccgatggcggtcattcaaacatggagtgacttttcatgggtaacatatgttaatcacaggcagctgcatggccacgaaaggtttccaactgttcagaatttcatagcttctacgtctgtgtccggcttggatacatcggatgaattcttgagacccccttcacaaagaagagacatgcatctatctacacatagatttacatgtaccggatagggtatcgtcattctccctagctcctcaggcccattgtggaaccctctaagtatcctggaagctcggttgaagaatctctacacaatatgaaagtaatgtatataattctatagatgcttatatggccatgtatattggtttcttatccagtgtntctggagaaaacagagataatactttgag

SEQ ID NO: 554829 - DNA, 1085 bp, Homo sapiens
ttcgcttctgttcttccttcttgtgatgttatttcttgcgctcgcgtttctgtgcataccggtcccttgttgtgtccgttgatcttttcccctcctttccctgcttttgggcccttacggctgttcacaaagcggtgtccgtcgcttcccggtttctcccccccggtcaagtcccgtggccgtggtccggcgggctcgggccccgtttacgccctttcttcgccccggttccggcctcgcttgtcccggggacactgtgtcaacatcgaggcctcccattgcgttttgcccatcaggacccatgttcgggccccggaagacccccagaggattcttcgcgccagaacccgagggccctgaccgtgcccatctgggacttggaccccggacgcccacgtacttgtggacccacggagtagtaatctcttgcagacctttagaagatggccacacacagcccagatggatgctgttcgcatcatggccaaagacttggtgcccccccggcgctatgtgccccagtttgtattgatccgggcccacatcccggctgtgtccccccagatcccagaccactccagtcccaccactcgatggccccagccctgaagggtgtccacccaggccctgggccacccatggaccagaccagctgaagttgcccccagatcccagaagatccatgatggagtttgacccgcgccgcgccagagatcctggatatgaaggaggagatgatgaatgatcgcccttgatgatcccctgggtgatgaggaagatgaagaggagagtgatgctgttggtgtccccaggttcttggatgagctgggacttagccttcaccagatgagctttctgacaccctccccctccaactgggggctccccttagtgtggctgctggtgggaaaaaacccgaggcccccagcctctagcccttagctgatagctgatcgccagacctggaggaaccggcttaagaacctcgcggagggactgagtgcccctgcccctccgagattaacccgtggatgccccggatcttttacccccacccctctgtaataaaagagatttgaccacta

SEQ ID NO: 554830 - DNA, 285 bp, Homo sapiens
tacaactacctaagaggcaggtgcttgtgtctttgtccctgaacatataaaaaccagtggtttccacttaacttttcctggttatttagttactaacttgactttaaaatcttagaatatgaaaagaattctagttcaccataagctaatctccaaaagcataattactggtcctattgcttttcatggaataagcattgaaatgatggcttctatcagacattctccagtactcagctgatatgcccataccactagtgtggaggatacactcctgtctttttc

SEQ ID NO: 554831 - DNA, 154 bp, Homo sapiens
ccaccttctcatacactagcggagacatacgcaaacatacgacaaataacacagacataaacacaacacacgagcagacacagacacacatacacatgcacatagacacacaagcacacacacgcgaacacagcacacacgaacacagcacaca

SEQ ID NO: 554832 - DNA, 774 bp, Homo sapiens
  misc_feature (520)..(520): n is a, c, g, or t
aagatggcggacattcagactgagcgtgcctaccaacaagcagccgaccagtcgtttcaggaaatcgagaagaggtgtcctgctgggagaaactggcatggagaagctcccgaggtactacaatgaacatctgcgtctggcgcttacagtgactacccaagagaggctattgatgggcaccttatattgagaatgaaatgccccttcatctggctaatgtgtccattacgaggcgcaggatcctctctgcgcgtggtgaccatagatgaagtatgtcatgacggtaccatgtgtcatccgaccgagatctactctgacactaccatctcggcaagtacaagcggattcgacgaagcgccactaagaatatgtctgtagcactcatgtccaccctgcttcatgggtactgtctcagatcgggtgactatcagtctactagttgggacgagttgcctggtccatctgatgcaacgacgagttgcgctatcgaacgtgcgtcacaggtcagcaagggctgtcnggcgctcagagaagcacgttccatgaaagttctgagtgctggatcatcggtgccgctccaccactagtgaaataaagttagtattctgattctctaaaaatctagacaacacaaggaaggaatcgaatttggcaaaagctgggctcaggaaaagctcatggaactccatgactggggcaggggccccaaggggtagggaacaggggcacaggggggaccccaggagaaccccgggcctggcaaaggcgcagggg

SEQ ID NO: 554833 - DNA, 159 bp, Homo sapiens
cgatggtcctcagcttctcaggaggatggcttgagtccaggagtttgtgagcaggccttggcaacatagtgagacctagtctctacaaaaaaattttaaaaattagtggggcatagtggcgcactccgggagtcccttcctcttgagaagctgaggtga

SEQ ID NO: 554834 - DNA, 135 bp, Homo sapiens
gatacaccactgagcaggaaggaccctcgcctctcacttcagcatcaagtggcctctgacctctggtgcctggctttagggtgaagcccctctgctcagaagcagccccctccacagcccacccatcccttaagc

SEQ ID NO: 554835 - DNA, 1052 bp, Homo sapiens
gcttctctctcagactgcggccaactggtgtccggcgtctctccacggtcgagagtctactccaatccaggatactgcacactgcgtgacatgctgctcgactctacggtgaacgtgcggttgcgcgtccgaatgcgtcagcagcgcctcgattctgtcatgtaactctggtgttctgcccgggtgccagttgccgtttttcatcattcgttgaccattcgggtagcgcgtggcgtggcgtgatcttcgatcctggctgtgcttctggtctgagcctgagcggtaggtgcccttcagggtcctggggcctcctggttgcctcttcgcggtcatccggacggggactctgtgtgccggttgcctatcgccagtttgcatgattgccttccaagccctgggatgagtcgtgtaaggtcactctggcccgtcattttgacactcctacactgtgtgcgtgatcgctgccgaaggacacctgtgggggaccttcgtcgctgtcggggaatccttgggggggtaagctatgaattctcgtgggtcttgctggacacatgatccccgcgcatcgttgaatccaatgcagaaccccagaacttgacaggttccaggctcaccgccaatcaatagggtcaaaccttccgaggttgcactactgggaaacatgttgcgctaatggagaaagtattgtagtgacttcagtatgaccgtgtgggtagctaggaagatgcttgtgctgttatgacgtgctaccagggtcgcctgacgataggtcccggggaactcttggctctgtgtcacggatattacgcggccagacccctctgttgtgaggatgccgttgtctgagaagaattgtgggtgcccgcgacgcagggatccataccaggttctccacgttcatgattttgttggcccgctgtgaccctgggtctgggggaggtggggaaacgggccatgaaggcggctgccgtgagggtaggttgaccgggcttgttggtgggcccctgcctcaaccctttgggcgcgcgcggccagtggcggcccacagtggg

SEQ ID NO: 554836 - DNA, 254 bp, Homo sapiens
  misc_feature (7)..(7): n is a, c, g, or t
  misc_feature (89)..(89): n is a, c, g, or t
  misc_feature (95)..(95): n is a, c, g, or t
  misc_feature (134)..(134): n is a, c, g, or t
  misc_feature (156)..(156): n is a, c, g, or t
  misc_feature (179)..(179): n is a, c, g, or t
  misc_feature (184)..(184): n is a, c, g, or t
  misc_feature (202)..(202): n is a, c, g, or t
ttttttnttagtccggccgtcaatttgtatagtaccaatttctgtaaattctctcaattcattgaagatcgtagggttaaacttttttntgtgtnatttacacttacaaacaagtgaagaagctatcgtttatntcagacgaggctgtagtttaantaacaaaagagggaaaataaaanagaanctttgtaaaatatatctnaaactaatggtttgtacaactggagaatcgttctagattagttaacaattaa

SEQ ID NO: 554837 - DNA, 93 bp, Homo sapiens
ttttttttttcttcccagccctctttccttccccagttgctgcagcactccatttggcagcacatcacccagactccacctcaactgtgtttc

SEQ ID NO: 554838 - DNA, 170 bp, Homo sapiens
ctaagctgcagaactgccactgagctaaagatggtggggccacatgtctgaccaagcccacattcacattctgtgtagaatgtagctccagggagcttgcgtggacggcctatgcttgctgtagcagttgtacggggccccgcactgcactgcagattgtccacggctca

SEQ ID NO: 554839 - DNA, 325 bp, Homo sapiens
tcataggttcgcaggataggacaagatgttcattcactcataaaaatgctaattgaaatcactgaaatatcatctcaccccagttaaaatggcttgtacccaaaagacaggcagttaacaaatgctggcaaagagatggaaaaaaagggagcccttatacactgttggtgggaatctaaattagtacaaccactatggagaacagtttggaggctcctcaaaaaattgaaaattgagctaccataggatccagcaattttcctgctgggtatttacccaaaagaaaggaaatcactatattgaagggatacctgcgaacctatga

SEQ ID NO: 554840 - DNA, 756 bp, Homo sapiens
gacactcatttatactcagcattcctggagggcaagagggcaattcctaagggcctgtctatggcggtgcagctaatgggaaaacaggagaggagcctgccactctagcaaagagaatttccagctcgtgcgtctccagggagtaagaaaagagaaagtggaaaatagaaaacgaagctggctgcttcaaggagtaactcagtgctctccataacagaagtcccatgcatggttgctccagaggtacatctcagttccctctttgcaatacccaaagcaattttcctgagagatgggaaaatcaggaggaggcaagccgatgacatttgtgatgggcagggcccactcggagaggcatggtggaactttctggttaacaaagttaaaagcaaaacaaagtaaatgacgaagtccaccagctcaatgctgcatggtacttgtgtttttaaagaaaatggtaacaactttgtgctggtgtttagtgagtgagattttcaggagtggatggaagaacctgtattatcagtctgttggcaggtaagaaaccttgttgtgagatggggtagtgcttattaataatacgtgctttccacttcagcctcatttgtagggccgtgaactagtgctactgggtcttcaactaactttagacttctactgctggagtcttccccatctcactgggatggtcctttttctcggccagcacttggagttcctcctaggtctagggagactacttctgtcaatggtgcg

SEQ ID NO: 554841 - DNA, 196 bp, Homo sapiens
agttggcgaaggtgtcacaggaggatatttcttgctggcactgctgaggctgggcagggctgtggacactttggtgatggccaggctcagcgcacttctgggtgtggccatggctctgggcactttggcgtgaggcacacaggcagtggctgtcagggctgcttccattgttgctgttgataagacatcctgctgg

SEQ ID NO: 554842 - DNA, 871 bp, Homo sapiens
  misc_feature (417)..(418): n is a, c, g, or t
  misc_feature (828)..(828): n is a, c, g, or t
  misc_feature (862)..(862): n is a, c, g, or t
  misc_feature (867)..(867): n is a, c, g, or t
gccactcgcatccgtatagcactttaaagtttctgcagtcctttgacacttgtcataaaggagggtgtaatagaaattgtcttgactctcttgtaaatcctgtgaagtctgtacaacatctggaaacagttttctctagcaggaatttactgctttgggcctgatggctttcacaactttttccataacaacaatggcgtcttcaatggtataagtcttccagactttcatgatgatctctgtattgggtttctcttccatagcattggcaaatcttttccataggatgctgtatataatgagccttaaaggtccctatgacccagaccaagaggctgaattagagacgttgtgtttgagggtaagtagaccaatttgatatcttctgtgttgaactcgtggtgttctgcgaggtgnngggcattgtccaatatcaaaacagctttaaaaacagtcctttactgacaaggtacttcctgacatcagggaaaaagcataaactgaaccaatccagaaaaagggttcttgttgtccaggccttcttgttttaaaaccaaaagcctggcaattggtgtttatcttttcccttcaaggctcaggggttagcagctttacagataacggcagtcctgttcctaaatccaactgcatttacaaaaaatggtagaattagcctatttcttcttgccttaaatcctggtacttgcttctcttacttactaatgaaagtcctatgtggcaatttttcccccttagaataaggcactctcttctgcattaaaaacccgttcagccagatattcctttttcctcaatgattttaatggnatcggggaactcatcttcttgcctcttgggcagnagagnttct

SEQ ID NO: 554843 - DNA, 147 bp, Homo sapiens
actgtacaggtcatagagggtatgagaatctccgtcactactatacacaccagactccttggacatcttcatgatggatgcatacccgtactttcccaaagtggttcagagtcatattcaaagtgtcaagctgggtcactccccatt

SEQ ID NO: 554844 - DNA, 742 bp, Homo sapiens
  misc_feature (6)..(6): n is a, c, g, or t
  misc_feature (66)..(66): n is a, c, g, or t
  misc_feature (92)..(92): n is a, c, g, or t
  misc_feature (108)..(108): n is a, c, g, or t
  misc_feature (154)..(154): n is a, c, g, or t
  misc_feature (171)..(171): n is a, c, g, or t
  misc_feature (176)..(176): n is a, c, g, or t
  misc_feature (202)..(203): n is a, c, g, or t
  misc_feature (206)..(206): n is a, c, g, or t
  misc_feature (281)..(281): n is a, c, g, or t
  misc_feature (286)..(286): n is a, c, g, or t
  misc_feature (302)..(302): n is a, c, g, or t
  misc_feature (334)..(334): n is a, c, g, or t
  misc_feature (338)..(338): n is a, c, g, or t
  misc_feature (355)..(355): n is a, c, g, or t
  misc_feature (363)..(363): n is a, c, g, or t
  misc_feature (365)..(365): n is a, c, g, or t
  misc_feature (394)..(394): n is a, c, g, or t
  misc_feature (398)..(398): n is a, c, g, or t
  misc_feature (415)..(415): n is a, c, g, or t
  misc_feature (470)..(470): n is a, c, g, or t
  misc_feature (493)..(494): n is a, c, g, or t
  misc_feature (528)..(528): n is a, c, g, or t
  misc_feature (606)..(606): n is a, c, g, or t
  misc_feature (675)..(675): n is a, c, g, or t
  misc_feature (682)..(682): n is a, c, g, or t
  misc_feature (739)..(739): n is a, c, g, or t
attaancacagaactttgcatttacccagttctatgcaccaaacatgaacaaatacattaacaggnagaaacaggctaggtaaaaggcatanatatatagtaaatttntttacaaaagtttcttagttcaaaaagtgataaagtaatacctacncaaaactgtcacaaccnacttncatacgaaaatataagtgtcaaattnngtnatgtatcagcgtcatactaaagtatacaggcagtctaagactcagtacagtacataacacacattaacaatatanttgtntacaaaacacgccccncaaacattgaggcattattacagtcctcaggnatcnccccccagtctaacacnggccgccnancccacccctcattacccaggatgtatacnaaangcggatgtctcaatggnattcacagacatctcccccaggcgtatcaaatggcaaacccctcacgtcgcaccncccggaactcaagccccactctnnaaagaaggcatgactttctgtcgtctggcaactnggcacacacaaggcgactccaacagcgccagaggctcccaaccgtcaccaacgtttagcgctgtcatggaggtgaggnggaggaggctgcagggccacccagcatcctgggatgcagggtctccaaggtcccagcagaaccccacantggtggncctactgcccacccagagccgaactcgacaggggagcgatttgaaagtaaccaacantct

SEQ ID NO: 554845 - DNA, 410 bp, Homo sapiens
atcccgcggggtttctcctcttgtgtctttgggaaccaggggctttctcaggggctttagggtctgccaggttgtttcagccaggagggcccaaatcaagggttagatgtagaaagttgtaaaatagaaaaagtggagttggtgaaccggttgttctttccccccattgggatgattgtcataaggtttttggcatgttcctcctttttttcccccccccctttttttttttattaatcaagagaaccttcaaagttaatgggggggggggttttcccggggtgagaactggttcccctccaagcatttcatgaaaaaggggctttttattattcatccaaactctccccatgatgggaagggtttcccaaatctttccaaataaaaagtaatgacttagaaacggccca

SEQ ID NO: 554846 - DNA, 236 bp, Homo sapiens
aggaaagttgagccaatcaatgacgtgtaagtccgtggaagcctgtggctacataacaatgttgacgccgtgagatgccgtctgacacatggtgaacgggagactcgacagtactctgagagcttgtagtgagggtaaagatagagacccaggtaaaattgttatatagcagctgcttggaattattctggtttcgggttgtctttctaatttagcactcattaagactttcggga

SEQ ID NO: 554847 - DNA, 138 bp, Homo sapiens
gctggttggggtcacgtatgtatcctacgcacttcgacgacggcgaggccggtgatcacgacggtccggagtttgagacttacgcctgggccaagactggtgaacgcgctgtctctacctacaaataaaacaaaaact

SEQ ID NO: 554848 - DNA, 146 bp, Homo sapiens
tggcgtgtggcagtttaaagttataagtttttaaaaactcagtacttttctacagtggaaacaacttgcaccaaaaattgtgctcacagaaattttgtgagacccatttaaaaagtcttaacagtgagaaaaaaaaaaacacaaag

SEQ ID NO: 554849 - DNA, 137 bp, Homo sapiens
gagtagccgcctacgccccgccactacgaggcggttaggggaacaggtagaagtaccgccgctagccactagggtacgaggaaggtggtaagcccatactatggacatagtaagccatagcctagatagcagtacct

SEQ ID NO: 554850 - DNA, 957 bp, Homo sapiens
tccctcctccctcagacccagaagtccaggccccagcccctccttcctcagacccaggagtccaggccccagctcctcctccctcagacccaggagtccagaccccagcccctcctccctcagacccaggagtccaggcccccaggccctcgttcctcagacccaggagtccaggccccagcgtcctccgtctctcacatcccaggaggtccagaccccagacgtccatccgtctctcacagcgcaggagatccagacaccaggagatccaggaacacagagaacaacaacagtccacatcaaaacgaccagagaggtcctagggacaagacacgacgatcacactgaggcgcacacccagcgacccgacgggggcctcaaacactcatcaagggacacagtaaagcgccagcacacaaggaatgagcggaacaccagccagacgccagggaaaaagtgacggagaggaggcaagaccgggaacgcaaaggacaagaaggagaggaaagaagagcaagaagagcaagcagagcccgaaagaaggcacgacgcacaccccgagaggggccgaagcgggcaagaacgggcaaagaccgcgaagacgagacagcaggaacccacggaagagagcaagaaagtgagacaacacacgaacaacaagcagggcaaggaaaaagacgaaaccaggagccgagaaagaacgacaagacaaatccacggcacgaagcaccccgagacaacaagagcaaaccggcaggaaacaccagaaaaacaaaaacgacgacacaaaccaaacaaaaaagaaaggcgagccacaggaaaaagagagcaagaaggaagacgagaatggccgggagcacagcggcgacggcaagatgggacacagaaacagcgaaagaaaccgaaccccacgaacagcacacccccagaagacgagccaaaaggcacaggcaaaat

SEQ ID NO: 554851 - DNA, 534 bp, Homo sapiens
  misc_feature (203)..(203): n is a, c, g, or t
ggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtgngatctctccgtaatggaagaccactcccacttccttttgcataatcaaaggcccccttcaacgttacctggttttggaacgtttctttccaaggggccaattttcttactccacattacgaagaccattccattcacaagaacagatccaaggttgggggttggcacgaatttacaaggtatgacctgaaacttcaagagtaccaaagtgcagatcaaaaaggtgggcaggcctgcaatctccagccttattattctgagaagactcagctctacaatatagccttcactgaaaaggaagccttccaaactccctcatggccaattgaact

SEQ ID NO: 554852 - DNA, 149 bp, Homo sapiens
ctatatttgcttttgaggagtcagggtgttcctggatcacggtcgcatgtagtacacgaatgcggtctaggtagttggtcacctttgtgtacacacccggaacatcctatctgtccacaggcccaatgccccagcctgatgatgcccac

SEQ ID NO: 554853 - DNA, 311 bp, Homo sapiens
tatagacgatccctggagtagtccaaactcctggtcttccggttatttgaaaatatacaatacattattattaactgtagtcaccctacagtgctgtagaacactagaacttattcctcctgtctagctgtagttctgtatccattaaccaacctctccttctcccccacttccctctatccttcccagcctctaataactactatgctactctctacttttatgagattgactttttcagcctccacatgtgagtgagaacatgtggtatttgtctttcatgcttggcttgttttacttaacataatgtt

SEQ ID NO: 554854 - DNA, 695 bp, Homo sapiens
cagtaggctgaggtgaaaggattcctttaacctgggagactgaagctgcagtgagccatgatcgtgccactgcactccagtctgggggacaaagtgggaccctatctcaaaaaaaaaaaaaaaaagtctcactcctctcctctccaacttacgtgattgtgacattattggatctcatctcagttcagaaccctctcacgtgccattacagggactcccttagaagggttctctattttaattagcttgtgaagcagagggagaacttataaagggacgttgttgttgagtgtgaaattagggattattagcccattatacccaccggtgtgcccagggaccctgtgaccaggcgttctccaatttcctttttgtgccagccatgtggcggaactctcaaagggtgtggcattgcccaaggttctcaaccttcagggcctgagggttatctccaccattgtgtcccaccattcagcggcaaaggccctctgtgcacctgtgaccgggtgtgtgaggccctctcatgtggtagagaggagagccgatgtgtgtgtctgtggccacagaggagaatctcccttgtgtgtttacacgtggtttgtgcggtggggtgttctcctcttttcaattggcaactttaggagccctcattgcccccctttttcgtggcctttggccgggtggaatttggggat

SEQ ID NO: 554855 - DNA, 460 bp, Homo sapiens
tcactctatgacacagttacacatgctttctgatctcagtatttaccataatgaatctgctcctataattgaggcataccacactcaaaaacctatttgtaaacagaattggacctggccagaaataatgaaattacttgtttgggaagattgcattgcagaataggccaaggtgctgtgcaacaattcctatggaatcattattgattggtcccctaaggggatgtttagcttaaactgcacccctcagtctgcacgccatggccacactatgttcagctggtctgaacaaaatggtcagatggtagaaatggtaagaaatatgacaagagttccgattatctggaaacatggtggtatagtggcacctcaacctcaaatgatatggcccactctaggagctaaacataaggatttgtggaaaatattaatggctcttaataagatcaaaatttaggaa

SEQ ID NO: 554856 - DNA, 123 bp, Homo sapiens
accagctgtgtctcgtacagtgaccactcgatacttcacagaaactcctgcaggtaggtggaccacattatcgagggatcccaccttggactgggccttctccttgaatgttcaacttctgac

SEQ ID NO: 554857 - DNA, 786 bp, Homo sapiens
agcggggggtgagcagcggccagaggctcccggagcatcgcgctgggagaagacttcgccgctcggggccgcagcctgttgggcaaggcgagcatcatggcctcggattgcgagccagctctgaaccaggcagagggccgaaaccccgaccctggaagcgctaccgtgggagcccgtccgtgaggccaagaatgacagcgagcgagtgttgcagcccatgcggcgtagtgaccaaggcagtgcaaagcaggtgacatagatgccaaaacgtcgtgcggcggagtcttcgaatgcatgtcggacttcagccttccccaagtcgtctcctgatccaccaagggatggcgccgtgactggtctgccctgactcatgttctgcggtgctttgggatgtggccctgcgtggccatgcgttctgtcagtgaccctgaaactgggcggccatcctccaagtccttgaacaatgattcccatttcttagctaccttcctctacagcccggtggggacccgagacgatgcttgcacagcgctccattgattgatgacacctaccagtgcctgactggctgtagcaggcacacccagagggcctcaggacctcattgctggtggcaccgtgtctgcacctatgccaggcatacctgggggcacggctatggctttgaccaaggccctggcactcctggtgggtgctgctggctgctgcggagacacagtgcttggaaaggaaggcggagcccgacctgcttggccgagttgcggggctcagtgaggattccagaaa

SEQ ID NO: 554858 - DNA, 134 bp, Homo sapiens
cctttttagggtctgctgaagggtgctacgtgtggagaggtcattgtgcccgcaggttgtttgtgattagctgtctctaacaattgttcatacaataattgttcattattgttctcaacttggggctctcccca

SEQ ID NO: 554859 - DNA, 1096 bp, Homo sapiens
gtcgatccgtgatcggcaggagctcctgctgcgtttcaacctcgctcccctttgcgtccgggagcctgcgagcacccggacgaaggtgcagccgattcttgcgggagtcgccccgaaagcgtcgggtttgtgtggggttagcgggggcctgcgtgccatctgtacttcgacccgccgaactgcctcggggaaatgccctgacagaggcaggcggaccaaggagaagacgcaaagaacagcagtccgtctggatttagtttgcccaggactggcgccgcgcacgcggattcgccgaggggagttgcggtcggaagtcaccgagcccccgattccccgcccggacagcttgaggccgagagatgggagcggctgaccacgtgattacagtccccgaaacgcccgacgtctccgcacaggttcattgaagcagctgggaccttgggtgaagccccacttaactgtggcccttgaggggcccggaagccccggaccgaacgagcaagacgggaagccaggaacacaacattgcgaacggacagaaagttatgacacgaaatatacaaccaccgatcccagaaagacagctagtaatgattgtgtttggaccaaagtaagacagaaatcacacccaagcttccagagcattgtggaaaatatacacggacattaaacagtcactaccaatcgaagaggagaaaattttaacaccgtttagcgggaaaaaacttagcgaaccccggacaagcaaaacttatggaaaccttatggcccagagtgcgaaaacccacgaaacagccaacacaggaacacggacccaacacaccatcgaaaggagaaaatgagatattaccccgagataaagataacagacactgtgtcaccaaccccccaggaaaccggtaccacgagaagaacacacaaagtgggctcattgtacacaacgccgcgccaaaaagcccgctcaatatcacaaaagagatttaacaaaatataaactcacccccgtgagtaagcaccaacccacaagtatgaaaacgccggggggaatttttaaaatcacgaaggacacaaaatggtccgaaaggagtttcaacct

SEQ ID NO: 554860 - DNA, 663 bp, Homo sapiens
  misc_feature (547)..(547): n is a, c, g, or t
agcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaagaaagaaagaaaagaaaatgggagttctgagagctaggaaactggggaggttgagccaggagcaggggaactggggctttggaggcggagacctaattcttaggggggctctatgaggacatgggtggtggggcaaagtgacagccggccctgagccccttcttgcctggtcccctttggcccccaggatgaatacgacgacattgtgggttcacagcagccgcagccaaaacccggggtggctcccaccccaagcctcaaaacctcttcctgagacccccgncccgttgtgattgtcttcatcgtcacatataatttccagtttaataaacaaaaccctagtttctgacaaccagaaaaatacctcactctcaaaaccacgatctataaaaaaggggg

SEQ ID NO: 554861 - DNA, 192 bp, Homo sapiens
gtagggcacggccttctcatgagtctctctctctctctctctctctctctctctctctctctgtctctctgtgtgtgtgtgtgtgtgtgtgtgtgtgtgtgtgtgtgtgtgtgtgtgtgtgtgtgtgtgttctcttttttttttgtgtgatatcgccccccactctctctctagaacccagtgtctcactac

SEQ ID NO: 554862 - DNA, 390 bp, Homo sapiens
actgaattagatactgtttttttaaagtacacagatagagcccagcagatctaaggggccatctagaagctgcacatacattttaggtgattcaaacataatttttaaattcatcattttcacagtgaatatgtttccatgagggtaattttacctagagtgggtccatgtttaacggtgaattaaggaattacttattggaggtatatgttgataaggacaaagagagccctaaagtaaagatagttggcagtttaattggttttaaggacatccaggtcaggaaattatagcccttatagtaatggggaatattctggcacaaatcccttactcaagttaggcacctttggaatttcaccatcctaaattggacagtagcttgtgccg

SEQ ID NO: 554863 - DNA, 231 bp, Homo sapiens
cgaatcgctatctgcaggattctctagagacgaccaggctccagataaacgatatttggagggcagcacgatactcacgtgcggacggaacttgtacagggaggcatgcaccgcagtgttgaatacacgtcgacctggctgcatgtatacgatctttggtggtgagcgcggttcttatgtagcgacggtacttgtatagagagtcatgcaccgcagtggtgaatacacgtg

SEQ ID NO: 554864 - DNA, 517 bp, Homo sapiens
gtgtcttcctccccgatcgagctcctcctctgcctactcgatgtgccgccctgcgcctgccgccttttatgttgacccacttccatttaatgactcgtacctatattttctctttcttatgatttactacataacattttctctagcttactttattgtaggaatctcgtgtataatacatataacacgcaaaatctgtgttaatttactgtatatgttatcagaaaggaatatggtcaatagtaagctattcggtagtcacgatttagcggacccaagaattgtcagctcccctaaaccccatgttcaagggtcagctgtagatatcatagatgggcccacaagttcatttcaaaatataatctaatcattagttaatatttggagagagaattcatatatttataaaaaatacttgagataatatatatttccgtcactggaaatctttaattttccatacctgcataggatgttaggctggcatggaaagacaaacttaaacatcattctgaaa

SEQ ID NO: 554865 - DNA, 357 bp, Homo sapiens
  misc_feature (311)..(311): n is a, c, g, or t
  misc_feature (328)..(328): n is a, c, g, or t
gttgtttgtttgttttggacagcgtctcgctctgtcgccaggctgttgtgcagtggcacaatctcagcttactgcaacctctgcctcccgggttcaagcgattctcctgcctccgcctcccaagtaactgggactacaggcacgcgccaccacgtccagctgatttttgtatttttggtagagacggtgtttcaccatgttggccaggatggtcttgatctcttaacctcgtgatccgccagcctcggcctctcaaagtgctgggattacaggtgtgagccactgagcccggccaattacccactattctnaaaggtcagcagtactncccaaaggacaggaatgcaccccaaacag

SEQ ID NO: 554866 - DNA, 244 bp, Homo sapiens
atactactgtagtggcaattattaaactatacttatcctcttaaataaatacttgctcaatcagttaatcagcagtgaatcatcttgcagctatgcacctgataaagaaatatacgtgattaccaatatcaagatgctgctagctgatatatctgttttaacgggtatcttttgtatgttctatccacttaattattacattcgtggctattgcatttccaggctgtactttcatattgtggcg

SEQ ID NO: 554867 - DNA, 83 bp, Homo sapiens
gcggccgcctactactactactactgctcgaattcaagcttctaacgatgtacggggacatgttcaataaaaagctgaacttt

SEQ ID NO: 554868 - DNA, 481 bp, Homo sapiens
ttcaaaagaaatacttaaaataaaacattgtagaagtataactttagaaagccagagtcccatgaaaatcactggtagctgtttgtttctgttcaagaaaaggtttctgacagttttccagcaatggaaaggggtaccccagagacatataggaatcagggattactgcatcaggtaaaggattaatgtagagtaacttccaagtttcctggtatgtttaagatttatcttctaaaatgctaaagtcagagccttgcccaaaacctttaggcattttcccagattgactgcttgtgtggttaggttgtttgatacaataggaagagcactgaatttggagccagtttgttcatctgttccctaatttgtgaagcccttggaatgcagaaaagaattcagtgcaggctctatcttagggaatttgccatcagtgaggttacagacccatcaacatgtacttaataaaaataagttattacta

SEQ ID NO: 554869 - DNA, 423 bp, Homo sapiens
tgaaataatttcaaaaagagccagaaattattattgagatctatactattctgaaagctgagatagagaagaaagttgaatacatgtccactaccctcttgcagatagtgaaaaatgtgtgaataaatttataattatgacataataaataaaaaaggtactatgaaagtatagaagttgaagaaaagaagttgaagtctttcttatataatattttgcttagcagggttggcatgtactatcatctttatttgccagatgaagaaatttgagttgaaagaggttaagtatcttgctcagttacacagaataagtggtatagtagtacattcttaatgtataagtgatcagaggctggggaaatgatttctaacaagggtaataatttttataatactgcctgatatttttacactttgaatc

SEQ ID NO: 554870 - DNA, 208 bp, Homo sapiens
  misc_feature (1)..(1): n is a, c, g, or t
naggcgttgaatggccgatctgctagaagatgctgctgctccctgtgatcccagcaggcctcccttcaccgtgacccctgtacctttgtcaggaaggtgcagtttttcttctcaatctatatgcctttcaggtgggccgcttccttggctacctcgttccagggggctgttttgtaatgagatgctgcttgcaggccattcaacgcct

SEQ ID NO: 554871 - DNA, 338 bp, Homo sapiens
gaattaaatggtcccgtctttttcatttttaatttattgtcacacatgggtttcatatttataacggcatcatgagctcattgcccttaatacctgcaatgtttgctactgtaccccaattgattttcaatactttattccgaaggatgaaactgtaatgttttattaccaatgcttctggaaatgaatgccttttaaagcaaataaatctttttgatagcccttttccaaaatccctttgccctaatgaatgctttcttatggcaaataacttaatatttgttcctggggcccccgctgttttggaatgttcaaaaataaagactctatttccccca

SEQ ID NO: 554872 - DNA, 101 bp, Homo sapiens
acaatggcagattaacagtatatggccactttcaagccaccatcacaattgtagagggactcttagaggtaaacatcatccagatgacagacgtcctgatg

SEQ ID NO: 554873 - DNA, 236 bp, Homo sapiens
aagacatgatctctgctcagtggaaactccacctcaggctcaggcgatactcccgcctcaccctcccgagttgctgggattacaggtgtgagccaccacacttgggctaaatttttttgtagagatggaatccttgtatgtttcccagggtgctctccaacccctggcctcaagtgattctctagcctcggtctcccaaagtgttgggattacaaacatgagccattgcactccgg

SEQ ID NO: 554874 - DNA, 363 bp, Homo sapiens
  misc_feature (85)..(85): n is a, c, g, or t
  misc_feature (263)..(263): n is a, c, g, or t
  misc_feature (298)..(298): n is a, c, g, or t
  misc_feature (319)..(319): n is a, c, g, or t
  misc_feature (327)..(327): n is a, c, g, or t
gatttaggggtggagtttccagacaacgacacatggctcgccaggtggagcgcaacatgggaaatctccagacgtaataggctgnccgcacaataaatcgcgcactgaaagttagcagtgtgtcccccgcatcgcaatttgtgaatcttcccgagcactcactttcgcgagaatgggcaaaaaacgctcggccggggcgtcaacggcaggaactgtttgccgcgctgtggggccgtccgtgcaattttgaaacgtcacctcanacacccggaatgataagcgcgatagctccttcatnactggaccgctcatcctatcntgagcctnaccgcgccctcgccagcttcgtaagcagaggtggcc

SEQ ID NO: 554875 - DNA, 166 bp, Homo sapiens
cgtctgatagtcaaacagcttttctttgagaatcgaggaaggaaattatttatttcctaagatgtttaaaactctttaaacatttggctatctgggaaatatagcaaaatgctaacctgagttcaatctttttttttttttttttttggaaatggattttggctct

SEQ ID NO: 554876 - DNA, 472 bp, Homo sapiens
gtctgccacggaagagcaattcaagagtgttgccagtctaaaacagtaatatgattcatacacattcctgtgttcacgtcattttatatggaaaggcttacaaatcaatattgtaagcattcattatataagaatgtacaatgtattagtgtaatctcatagcacagtcaaccatctcagatgttgcagcactgttaggtctcaatcagcatgtggatacagtttattttcacttgcaacatttagttgtctacttagtgtgttaaacgtaactatatgtcagcagtttcgaatctgcctgcagttgtgcaccaagaaagcttacgtgatgcagttattggcaagattgccatgcttatggaaaaatagaaagcgaatactcagtttaagccaaggaacatatagtggcatttaatatttgatcacaactgattttgtttaacaggaaatttaaagcattcagtcatataat

SEQ ID NO: 554877 - DNA, 145 bp, Homo sapiens
  misc_feature (11)..(11): n is a, c, g, or t
gactgatggangctgctcaatgaaaaagtcccccctcctcccaggagactcatgacagtcccttcttgccttgagggagcagagccattgacaattcggaatcttccccagctttattgttcaagttgagccccagcaaggaggt

SEQ ID NO: 554878 - DNA, 1117 bp, Homo sapiens
  misc_feature (595)..(595): n is a, c, g, or t
  misc_feature (598)..(598): n is a, c, g, or t
gtcctgtggctactgcatatgcccttttagattgggactggaatggacaccaccagaagcaccacagttatttttgtagagattggaaacaaggagcttattgccctgcttgtcaaggctcaggacagacaggaggaagaatcacgtataaagggtttaggctgtggacagaacgtgggctccttcgagattttgttgaccctttacagctgagggccgtccctcagacgacaccgcctccctccgtgccgacaggggggacggacccccctgtccacaccactgacctcgctacaattaaacatgcgctccaccaacactctcgccgggccgtgacgtaagatacgcgactctgtcgggtgtgtctcgacctacttagggaggcgcgcgatgtggtcaccttgctccttgtgcgcctctcgcgcgctctcagtgatcgccccataccttgccgcttactccgcctcttgctcccccctgccaccctctatccatactcctacatcgcgcctgcgcatcgggcccgtcgccctgcacggctcgacttgagacacatgcgtaccccgcctcgtctccggtcgcgcgcgcgacggantcnctctctcagcaccgtagcgtctgcgatacgacagcggagcgcagtaaggcgagcgcgacaatgtcgagccacttcgtgtactctgtagcggcgtgactgcagccggaaggattcgtggcgtggtgcgccgtctaccgcagcgccgtcgcttgctccacctccctgctgctccacgctcacgcgatcacacctcactcgcgctcacactcagcgtctcgtctgccctcagcgtcacccctctcctatcgtctcgtagtgtgacgggtaggttagcagacgtatgagacaattctcctcacttctatttctctacctctctgtagttatcaacatgctgtgtgagtgacgtcggcagacgcacggcgagtcgagcgtgagatatagatcggttcgtttccgtcgactcgtgacgaatgttcctcagctgttgtacactcttgaggatgcgttgctctactacgctctgtgctgcccgcgcgcctgcccgcctcgccatcctactctgccgcacttcgtctc

SEQ ID NO: 554879 - DNA, 890 bp, Homo sapiens
ggccccccaagggtgcgcgtgcccccgaagcaagtcgcaccgcggcgtggaaggccccccgccccacggggggggccctctgtaacaactacgagggcgggggtgacatatagagtaaaaccggggcagtggaaaaaatttatcaccgcgggcacaacgccacaccgctggtcaggccgccgcacgaaggatgccccccctcggtgtagtgagactcctagtcacaacggcctcgcttcacagccacccaggggtcatggagacatatacgggtcccgccaagtataataaatgtcgccgcccccaactctaatggcccacacgtgaggtaagtcatagttggcggcgcgttattactaaaagggttcttgtctctttacttactttcctggagagagcgctccatgatgggggcggagtacatcatgtgaaaataatttacaagagggattgttatcgaccgccgcgggtgcctcgctcgtctttacaacattctcaatatcaagggggacgcacctcacgtctcgtcaagtaaagaatgcgccgcacgctttaggtatgctgcccgcgttctgtgttattgtatgttacacacccactgtggatcccgcaccactgtacgccgactcagggaggatgcttggagaccccgccccatgtggacgcgcacgcggtgagcaccgggcacctgttaggaggcggcaggggagccaccttttcacccaacacttaaaaacggggcggtgcaatttctcggcgagacaacaccacacacattatgttacagaatataatgaggtgggccgcccaacccagaccgaaacaagagacagacgctacacggaagacacgccccccccacaactactaaaaaacaaacaaacaaaaca

SEQ ID NO: 554880 - DNA, 152 bp, Homo sapiens
attaaaaacctgctggagctcccaaggggggagttccaaagaaaggacaaagtttttaattcccgggcccctaagggggatttggttcggctcctgtcggaaaagaaagaagggctcatggtggggcagggttgtggcctcccctcccaaaa

SEQ ID NO: 554881 - DNA, 998 bp, Homo sapiens
gcctgtagtgataccgtactgcgccgcgcggtactctggatgcacccgttgctgaaatactgtcgtccgcactttctctcctaactaagtgcgtgccgtcaaccacgatggaaagattccgatggacatgggacattgagcccctcgtggggcccccatgaactatctttcctggttggtgaagcaaaacgtgccgatcaagatgactataatcagttgttaaaggtgtaataagtgatcgcaataaatgaagcaccatagtatattcgtgaacacgacacagtgtgcagaagaagcggggctcggtgcaaaaagagatagacgctcggatccggttgatagaaagcccatggcacgtgaaattaccgaaaggccaggataccaactttcacaggtaatacctgggcgatgtttgccaatgactgtgacagccaccagtgaagccgcgtatggagaggctatggagcaatatagcagcatcagtgtgcatttaacgagtgtgagaggtgtggttgcattagccagtgcatagtaatgtggaaagcactttagtacctgaggagaaaaggatgcccgagtacagaaaatgacgaaggaggaggatgtgacactctaaagtatatctggaaagcggtctgccctggaggggctagccaggtccccacagaagagaagtcaaacttgctgctgtgaagatgatgacgactaagatgaacaggcttagtgatgacaatgatgctgatgactgctttgaagattaggaaggtaaagagacggcacagttgagaacttatagaaaaatatcaggccaaatgagaaagtgtacatcaaggggaagactgaacacgtcttaacccgtaaagggaacaattcaaaggaaatctaaaacaaggcatgtgtgaacaatagaatgtgggataaaggggccccagaacacacaagtaaaggggggagaggaaatactagggacacaaaaaaggagagaataaaggttagaa

SEQ ID NO: 554882 - DNA, 683 bp, Homo sapiens
cttaatggggtgcagtgttgcagtcccacgactgctggtttgagggtataagaccgcttcagaaattagttagggggcctagagcgcagaaacctgttgtacattttcacaaagagattatactatgtcgcatgtgggaggggctaaattctctgccctccaaggagtttcttttgtggtttccccaatgagtactgtaatggtgtctacataaggttagagggtgtgtctctggtatccgctctaatggtgtgggaggcgggtaataaccagggatgattcgtttgcgttcgctttcccgagcccggccaggaaccggtggccaggggattttgggcgcttgggcctgggaagtgtgggattgtccgaagacccggcccccccgcgcagcgtcgagagatatttgtctcgagagagcagaacaattgtgtaaggtatacttgggggcttctgcgagaggcgctgggccacggtgtactaccacacatggacttctagtctgttgcacacaatgaacacgtgtctgtactgttaacctcttttttgtgtccccttaaagacccctacctgatattgggcgcataaacttcagcccctttagagttggtccaggacatattttgcaagatttagtgcctagggttgcttttttgatgtaataaaaggtggtctggccgcaccta

SEQ ID NO: 554883 - DNA, 410 bp, Homo sapiens
caacgtcacactgttagttattgtagagctagaacttaacctagtctaactccaaaccttatgagcggaatgaacacgtggtgcttggtaggctaaaataataattaccacgtattgcgtccctgtggtctgttgaacatttatcttcattctgtataatccttagagtaactctgaggtatacttagtccgtttatagatgacgacactaagagtcgggtcacacaaactagtgagggagccaggatttgaatcaatgtccatttggttccaaaatctgttctcttcctactgcagtatgtactacattgaggctcacctctgtgtactttgagcttcttccaccctcagagtttctgggccatgatgcccaacttcactttttatctttgttaaaatttattttactt

SEQ ID NO: 554884 - DNA, 168 bp, Homo sapiens
gagattgcaccactgcactccagcctgagcgactgagtttttttcggaactctgtctcaaaaacaaagaggtaaattttagatcatcagctatagtaaggagtaagtgtatgttcatgtgtggctccaggacaactaatgcttcatattaaatataggcagggaagtc

SEQ ID NO: 554885 - DNA, 1812 bp, Homo sapiens
  misc_feature (150)..(150): n is a, c, g, or t
ggcgccctgtacccgtcgccttctggtcgtgtgggcctggctctttcatgagcgatccctgtcatgcgggggagatggtccttgcagcagtgatgcatctacgctgtgtgaggtctgggccgtcctagagaatgcacccgaataactttntgtggaggtcgtcgagtagagatggtaaggcccgctcggattcgtacgaggggggttctgggcgtgcggcgtggcttagcacctggagtccactctgcgcagccatccgtgatgctcgaacggccacaaggccagagaaacgatcgtgccattgaggctcgtgccccccacgaagctttcccctctatacgcctcgcccaacttcgctcgtcgcgttagttttggttgcgttgccttgggtgtgtgggaggcgctatttagggctttgtgtccaaccgtggaccctcgaaacacggctatacaggaggcactccgtgcgtgaaccactatgtggtaccccctgtctgcgcgtgcattaccaagccctcggggtgccacgaggacaattgcgtcgagcccttcctgtgccaacctgggagcgccacgtgtcgggtggtcatctcgctccttcacctgttcctggtgcaagggactccccctttgccgccccgttgcgcctgggaggggatttactgtccctgggttggaaaccctcattcggaagactttagaacggctttccacccctagtggtccctcagtctgtcagtcactagacataggacactgtattccacatacaccaagaaaccttcgctgagcgaatgtctccttcattccacgttatatctaccccacatatattgggggaaagcttgggcccttccccttgtctctacttttcgcccgccagttggggtttgtttacacccttggtgtcaggggcgccgttcattggattcatcccccgtggtgtgggcccccatgctatgctggcgcgcttgggcgcccctggtccactagcggtgggccccaacatccgtcggggctctccctccgcgcggcgatggcacccattaagacgcgccgtgtcttgtccaccccctagcgggggcgagcccacgcgcgggaatcttggccccccttttcgcgtcttcgacacaaggagacattccggcgttgcccgcagggacaacgccgcacgcgggatccaacgccctaagttgcgcagacgcgccccatatcgttgcgctcagtctcgtggcccctatcgcgcccggagatccgagaccccccttgtgtaatagcactcgcaacctctgctgtgtcgccccactcccctctactccgggcgcgcactaccaaaagcggtgtcaaccttgcccccgtatattgttatcccccagcttttcgatctggggacgctcccccatgagcaacgtgaggcggcacgcagaagcgcctcgtgacaccactatcgtggagagcgctatccttatagtcatcccacccccacgtgtgtttttgctctttgtgtgttcgccgcccatgagtcctccgctccctgtgtgtgtcgcgcgcggtcaccctggcgtggattctcctgcccccccgcgtggcagcgcgcctggatgacgcgacgcacaacgcatcgtcctgcgctcagtcaccctccggtcgcgtacacgcagcgcccctcgccgtgccatctctctacgcatcggtgcgcgtcggctccacccagcgctgcacctgtgctgcgccgccaactactcgttggccggtggcggcgcgccacgcgcgcggccgcgctgccgaccccctcaccgctgcgtgcgagca

SEQ ID NO: 554886 - DNA, 634 bp, Homo sapiens
  misc_feature (27)..(27): n is a, c, g, or t
aagttgcagctttggagacccgtgggngtccacagcactcaggaaacctggggggcttgggctttggatttgatggagcgggaacaacaagtggcctgccatttgcccaaaggttgaagcaatgaataaaagactgggctccttggtggatgagtttaaggagcttgtttacccccagattccaatcctgaagggaaagttcccaagagaaaaccgataatgaaggttttggaagcaaaaggcccaaggtggagtattcaaaagaggagctgaagccccccatcagcaagggtacgctgggcaagttccctgtgcccattctaaaaaaggcctcccgggcttccgggttaaaaagtggtttaaaaaagcaggagctgttggaagccctccccaagcccttccaggattgaccaaaggccgggggtccagttgcccttccccagtgtggccaggctgctggcccttgtccccacccagttaaaatgtgtttttcctgagctaggaagagtctacccgccataagtcgagggcctttatgtttttgaggctttctgttcccatggtgatggggtagccctccccctttgctgttccttactttactgcctgaataaaaagccctaagtttgtccta

SEQ ID NO: 554887 - DNA, 407 bp, Homo sapiens
gtaaaaatccagattattagtaatgtgtttgacttgtgttaattttaccttaaaaattacattaaccttatgtttttctaataagtatttttagaggagtcaaagtttaaagtgagctttgaatgaaacaaaggaggtgatttcatagatgggaattgctagacattgtaaatatggcagtagactggggagtttgttagtgatctccacagttctccatctgcggattcgttctctaccccactcttcactcatggggtacagaccccatggtaagtcatgaccagtgggctctgggtacttctttgccccagggttgtcaagtgaagtgaatctctggggtcttagtttttattacctacaaaataataatggacagcattagctccaaagtctcttcctgttgt

SEQ ID NO: 554888 - DNA, 377 bp, Homo sapiens
ggtcgatctctagcaggatcccccatttggtccgagagaaattaggatgggccgaagtccatataatgtatttcacattgccagcctaaataactttaacggtctaactaactaagcataaccagttcccactaatctttcagaagataaacattatgaatgaggaaaaagtttacagagtaaatgatagcttttgcttatatgtacaattatggaacttgctcatttcgctctatgcatttcactttaacctctgctgtaagtcctgtttcctctgcagcgtcatgaatgcagcccagtttatgttcatgaagctactagattaatggctcttttgttatatactggtgatgcatctcatttctctcggaccaatg

SEQ ID NO: 554889 - DNA, 371 bp, Homo sapiens
cagatactggaagacccaggactgacacatcctggaaagcagcactgctgcacaggtaaagccaacccatgagaggaagcggtcagacgcagcaggcatgcgacaggaaggactgctggcccctcccactgtggcccacaccggcgagttcaggccagtcttggaatgtgaagatggtggagggcagctgcaggctggcagggtgagccgccaggctatactgcttccccttcctcaaggagagcctccatcccgcagccagggcacaggatgcagagctccagagcttcacccggctgctgtagttgccggtacccaggagggctggctctggagggctgcgcttggcaggctgtggagagcaacgaggt

SEQ ID NO: 554890 - DNA, 317 bp, Homo sapiens
gattgatatgagtggaggagaatcactacgatggcagtctgacatcaggtatcagagcctagggtgtgagggaaagatgcactgagaggctggttacatgtacacgtgtcagatttctgtcatagaaatggtagaagttttacaaatatagaaagaattagaacaaccccttgagtgttggatcagaattggaggtatcagtgtaaactccttgatatcaaactacatagtaagatgtaaaaataaatatgtgtttttatgcatgtgtattacctatggtgagtgtccaagtatattcatacatacattcaagtatt

SEQ ID NO: 554891 - DNA, 362 bp, Homo sapiens
agagtctttcattatcatcatctggaattgtcacctgaatgatgtttctggaagggctcttagagaaggtgctctccttaatcgccgtctcaacacatttcgggctttttaatgatgaacttaattttggctttgtttctaagtatcttctccagcctcggaatgccaaaagtcaatggtcttcggaatggcacaccctcagtgtaagccttccacataaaatgtcttccgggaaagactcaaataacgcgagcggcaccttcacagcttgtttaagcccaagagcttccccacatttctcattgaagagattttcaactctctgttataggtccgtgattttggcattacaggcctcaaag

SEQ ID NO: 554892 - DNA, 100 bp, Homo sapiens
aggcgctccctgtagggacggtgacacctgctgcctgagctcactgttggcattgagacatgagtactgtggtggggctagtgcgtggtgcaggtgcagg

SEQ ID NO: 554893 - DNA, 215 bp, Homo sapiens
cggaaccaacaggactggttaaccacgtgtgcatgatgaactccattaaggacagagcacgttctgtcttacgtcacatttcagaccaggctcgtgaattcatacctcagtttgtgggaagttgatcgaccatttaaatcaatagcacaaacaagtggatcaaacaaatctgaaattcacaatgtcaccaacgagcctatcccttgccaagggtc

SEQ ID NO: 554894 - DNA, 696 bp, Homo sapiens
aacatgatttagattgagcagtagaacctctctttgctagaaactgcaaatggacatttggagcgcttagaggtctaatgtggaaaaggaaatatcttcacagtaaaaactagacagaagaattctgagaaacttcttggtgatgtatgtgttcatctcacagatttgaaactttcttttgattgagcagtttggagacactctttttgtagaatctgcaagtggacatttcgagtgcttggtggcctgtggtagaaaacgaaatatcttcacataaaatctagacagaagcaatctgagaaacttcttggtgatgtgcgcattcatctcccagagttgaacctttcttttgttggaccagctttaaaatactctttttgtagaatctgcaagtggacatttcgagcgtcttgagtctatggtggaaaatgaaatatcttcacataaaaactagacagaagcattctgagaaacttgtttgtgatgtgtttgttcatctcacagatttgaacctttcctttgattgagcagtttagaaacactctatttgtagaatctgcaagtggatatttggagcacgttgtggcctacagtagacaggaaatatcttcaataaatctaccagaagcatctggaaactctttggatgtgtgctcctccccgagttaacctcctttgattgagagttggactccc

SEQ ID NO: 554895 - DNA, 430 bp, Homo sapiens
ctcttcacgtcttcagagggatttactgaagagggcctgtaagccccaaatggaaaactattttttagaaattgttataatttttgattgcttttgtattttatcttgcaatactggacaagtcctggaaaataaatttctgtaactgaaaaaaaacggcacgagaaattactttccctgcaagacgttgaaacccttacagtttacactcgattaggctatccagtagagacgatgaaaccacagtcaaatgatgtccagatttcacaaggcacattctttcactattttggtcagcactgctgcaattagcactctttttcctttgtcaatctcatccgtgcattccttcacttgcaatttcgcctcaacagcttctggaggtgcatcgtatattgctagtttttgtcgataaacaggtttcggctcg

SEQ ID NO: 554896 - DNA, 338 bp, Homo sapiens
gagaaaggacacctcagtagcagtgagtatacataggactcaggccttggttgctaaataccagtctcctctaaaataagccaatgctctttggagaaatggagattccagggctgggcatgggaagtataagaggggtctggaacatattctcatgacagaaaataaagaagtggtcaaagaatgataggagctggatatggtggctcacgccagtaatcccagcactttaggaggctgaggcaagagaatcccttaaacctgggaggtggatgttgcagcgagctgagatcatgccactgcacttcagcctgggttacagagaaagaagctgtctc

SEQ ID NO: 554897 - DNA, 288 bp, Homo sapiens
  misc_feature (201)..(202): n is a, c, g, or t
  misc_feature (211)..(212): n is a, c, g, or t
  misc_feature (215)..(215): n is a, c, g, or t
  misc_feature (217)..(218): n is a, c, g, or t
  misc_feature (221)..(221): n is a, c, g, or t
  misc_feature (225)..(226): n is a, c, g, or t
atgagcggaccctcgttgtttggatgtgtgtagatatgggtattaaaattaggattaggatggaggctactagggccaacactccacctagtttattgggaattgaacgtagaatagcgtaggcgaataagaaatatcattctggtttaatatggggtggggtgtttagtgggtttgctggggtgtagttgtctgggtctnntagtagtcnngtnannatngacnnaatagcaccttgtactattctcaccagacctactaggagacccagacaactacaccccagca

SEQ ID NO: 554898 - DNA, 91 bp, Homo sapiens
aaataaatgggttcttgttccgccctttttaaatcaaggtttttgttaacggggccttcccttttcccttaataaagtttccccttcccca

SEQ ID NO: 554899 - DNA, 109 bp, Homo sapiens
ccacagatgtgcctgaccgtgccctgctgtgtgacctgctgtggtctgaccctgacaaggactgtgcagggctggcgcgcgagaactgacctgtgtgcgtactctttta

SEQ ID NO: 554900 - DNA, 368 bp, Homo sapiens
aaaatggggttttcttttctacaacatggtcaggctgcaaattttccaaacctttatgttctgcttcacttctaaacctaagttccaatttcagaccatatcttcgtgaatgcacatgactgaacgctttcagaatcagccaagtcaccactaggatgctttgctgcttagaaattttcttctgccaaataccctaaatcatctcaaagttcatcagttctctagggcaggggtaaaatgctgccagtctttttgctaaagcatagcaaaaataacctttgctccagttcccaataagttcctcatctctgggaccatttcagctggattcatgtccacgtcacatcagcttttggtcaaaagtatca

SEQ ID NO: 554901 - DNA, 249 bp, Homo sapiens
tactgggattacaggcgtgagccaccacacctggacacgttactgaatatttctgtgcctaggtttcttcatgtgcactgggattgttgtgagaacacatagggattcccagggtcagttcctcagtgcatagtcatggctgcctttgtgtgtgctgtgtgtgtgtgtgtgtgtgcgcgcagtgtgtgagtgtgtttaatatagcagacagggtctcactctgtcgcctaggctcgtttcaaactcctg

SEQ ID NO: 554902 - DNA, 241 bp, Homo sapiens
cgtagtatatgaaaatatatgtattaccatgttctgtgaattagtacttttatcatttgaaatgttgttttcatttctgcggaccgttctaaccggggtatctattttgactggtttttaatgtaactactaacatctttttatgttctgacccacctccggggacagtgccaggtggggagtttgactcttatgttctgacccacctccggggacagtgccaggtggggagtttgactgg

SEQ ID NO: 554903 - DNA, 289 bp, Homo sapiens
ataggcttagcgtggtgcctcacgctttgtgatctccacagttgggaggccgaggcaggcggatccttgaggctaagagtttgagaccaacctggccaacatgacaaaaccccattctactaaaaatttaaaaaagtaaccaggtgtggtggtgcgcacctgtggtctcagctacttgggaggctgaggcacgagaatcacttgaacccagcaggcggaggttgcattgagctgagatcacgccattgtactccagcctgagcgacagagcaaatctctgtttcaaaaa

SEQ ID NO: 554904 - DNA, 690 bp, Homo sapiens
atccacaatgagccatctgcttaattctccagcttaatcaccttgtcgcctgagaatcattgacttccagggtggcaatcaccaagattatactcgccctaataactttcaaatttgttaaaagctgctcatgtcgaaactggagcgctttccgctatggttaatgcttcgtaatgctagcacttcatcttgagagatcagttagcctgatcccaactcatccagtcctaatgttagccctctcctcgcaaatcctagcttagatagtcctgaacgtatagtaattatattgatcgatagatgggagggtctgtgtcgtctttcaggagaacagctagtaacagtgcaacaagtttgggggagaccacaaggaatgtggagacgaaagcagccagtaatccagagaaagagcaacgaggacagagaaaagttgcgtcaggtaaggcatgaagtaaggaagagacaagtgacagtctatggacaagtagagggcgcccaagaaaaacgatccgcgtaggaatatatcacgaagggcatgaggatatgacggtaagaagtgttacacgagagatcctgggtgggagaaggagaattgtaggtgaaggacacataatgcgggaataaacgcatgaatagcaacacgcgctttatatcggggcgcacgggacaacgcacgtctcgcccccaacc

SEQ ID NO: 554905 - DNA, 409 bp, Homo sapiens
ccgtacactggcatcgtgatgactccggtacgggtcacccacactgtgcccatctacgatgggtatgccctcccccatgccatccttcgtctggactggctggccgggacctaactgactacctcatgatgatcctcaccgagtgcggatacagcttcaccaccacggacgagacaaaaaatcgtgcgtgacattaattagaagctgtaatacatagacctaaacttcgagcaaaagatggccacgtgattgcttcaagctcctccctgaaaaaaaactaaaaaattgacttgacggccaggtcatcaccattggaaatgagaagataccagatacactgagacaatcttcaagtattcctataataataataaaatcatatgaaatcaagaaaaaaacattaaactcc

SEQ ID NO: 554906 - DNA, 1380 bp, Homo sapiens
gctggaagctggccgactgcgactgcgacggcatgcttgatgaggaggagttcagagctggccaagcacctcatcaagatcaagctcgacggactacgagctgcccagacagcctgcccccaccacctatgtgaccccacactcgcacaggaagtccctgacccaaggccgactgaggggtgggctgcagaactggggtgtggaacttgggaggacctgggtactcagtgcctagctccagccactgactcaccgaatgaccttgggcaagagcactagccctcatctgtagcacttgagttaaccccatactgtaagaatgcgggcagcggtggcacacatgcgcaaacctcacactgcacgttactctaacacccatccacaacattcccctataagatcatcctcatgaacaacatacatctgcggagcgctagagcggcggtaggactcaacagaacaataacgacacggcatccgcacgcaagacccaagcacacacctcgagcaccaaaagaaggtccatccaaaaaacactgcacctgggcagcacaatggagacactggagagcatatggccgcaagagacaaggatccccaaacggacgccactagcggcacgagcaccctccgggatcacgacacgagaacacaacgccctgagacaatgctcccgaagggcctgaccatagcagaacacaaagcatgacacgcaaccatcagagacccaatcttcgctcggaagcccagagactgggtacatggaaccacgcatgaacgtagccgcactccacatatgggactggcacatgcacaaaagagtatatacctgacataacgagacacgatcaaattattctgttgcgtaacattgacacagatgatagcagaaggtgcacactacaaataatgcgtcgaaggatcgagcatacgatatactagcaagaccaaggagaggatagcatacacagacaaacagagccacaggacaaatcactacatggactacagtaagatcggtagatcctcacgttcgactgtacagcgatccaattctgtccagacgtccctaggtcaccacggacgacaatgaaccaagaagtgcagatcgcgagccccatagacaaccagggacagacacacacacagctagaccagggaggaaactcgcgacgatgtcgacacgctcggcaggcagcaagaagaaagcaggcagcaagcacgacgcaaacacacaaaaagcgagggaggacacaagaacagaggaaaaacgaggcagacgcccaacgcgaagacgaagcggcgcgcacacgtcagaggaacaacaaacttgagtgatagcgcatattgatcagcagaatgtgaggcacactgacgaag

SEQ ID NO: 554907 - DNA, 359 bp, Homo sapiens
ctcccaggatcccccagagccaaacagtgcccttgtctttcattctttctctacccacaacccacagtcccaatggcatttgtccccgtcattgacctaccctgacttggcggctgtatgttccggtccgcctcccagccaccaccaccacagccaccgcccggctccccaccggcatctgagggcggttgctggacaaggctgtcattttccctgctggggattacaggtttggggctgtatgagtctgaactgtaggaggatgaggagccatgactttcccagcgccaagctggagagagacaatagacactctcacaggacagattggcttgttccctgtcactattcggattctg

SEQ ID NO: 554908 - DNA, 107 bp, Homo sapiens
aacgacatggtttatatatgtggtgtctggtattcggcatagatgccgccggtgtagtgagccagtctgtctgtgccatttattccacgagctgatgggagaagatg

SEQ ID NO: 554909 - DNA, 702 bp, Homo sapiens
  misc_feature (28)..(28): n is a, c, g, or t
  misc_feature (40)..(40): n is a, c, g, or t
  misc_feature (54)..(54): n is a, c, g, or t
  misc_feature (69)..(69): n is a, c, g, or t
  misc_feature (94)..(94): n is a, c, g, or t
  misc_feature (108)..(108): n is a, c, g, or t
  misc_feature (110)..(110): n is a, c, g, or t
  misc_feature (124)..(124): n is a, c, g, or t
  misc_feature (126)..(126): n is a, c, g, or t
  misc_feature (130)..(130): n is a, c, g, or t
  misc_feature (139)..(139): n is a, c, g, or t
  misc_feature (147)..(147): n is a, c, g, or t
  misc_feature (154)..(154): n is a, c, g, or t
  misc_feature (159)..(159): n is a, c, g, or t
  misc_feature (163)..(163): n is a, c, g, or t
  misc_feature (168)..(168): n is a, c, g, or t
  misc_feature (171)..(171): n is a, c, g, or t
  misc_feature (173)..(173): n is a, c, g, or t
  misc_feature (185)..(185): n is a, c, g, or t
  misc_feature (189)..(189): n is a, c, g, or t
  misc_feature (195)..(195): n is a, c, g, or t
  misc_feature (200)..(201): n is a, c, g, or t
  misc_feature (206)..(206): n is a, c, g, or t
  misc_feature (208)..(208): n is a, c, g, or t
  misc_feature (212)..(212): n is a, c, g, or t
  misc_feature (231)..(231): n is a, c, g, or t
  misc_feature (234)..(235): n is a, c, g, or t
  misc_feature (271)..(272): n is a, c, g, or t
  misc_feature (277)..(277): n is a, c, g, or t
  misc_feature (282)..(283): n is a, c, g, or t
  misc_feature (288)..(288): n is a, c, g, or t
  misc_feature (308)..(308): n is a, c, g, or t
  misc_feature (329)..(329): n is a, c, g, or t
  misc_feature (335)..(335): n is a, c, g, or t
  misc_feature (338)..(338): n is a, c, g, or t
  misc_feature (358)..(359): n is a, c, g, or t
  misc_feature (363)..(363): n is a, c, g, or t
  misc_feature (368)..(368): n is a, c, g, or t
  misc_feature (373)..(373): n is a, c, g, or t
  misc_feature (375)..(375): n is a, c, g, or t
  misc_feature (387)..(387): n is a, c, g, or t
  misc_feature (405)..(405): n is a, c, g, or t
  misc_feature (412)..(412): n is a, c, g, or t
  misc_feature (415)..(415): n is a, c, g, or t
  misc_feature (417)..(417): n is a, c, g, or t
  misc_feature (421)..(421): n is a, c, g, or t
  misc_feature (424)..(424): n is a, c, g, or t
  misc_feature (442)..(442): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (454)..(454): n is a, c, g, or t
  misc_feature (475)..(475): n is a, c, g, or t
  misc_feature (486)..(486): n is a, c, g, or t
  misc_feature (506)..(506): n is a, c, g, or t
  misc_feature (693)..(693): n is a, c, g, or t
aaaataaagggaaaaaagggttggagcnttctcagagcantgctgctaaggtgnccaaaaaaagcgaanatatggattcctgaagttcatgatnagaaagcagatgtntnagcttggaaggacntntttnttcccaggncggttctncgagcantcagntttntaggnttntntgcacccacacnaatncaagcnctgannttggnanctgntatttgtgataaattgganatnnttggggttgttgagacaggaagtgggaaaattcttnnttttntcatnncaatnatttatgtagtgttgtagtngtagaagaggaatgttgttcntttttnaantaatattgaagtaccatttnnaganattanaattnangttggagttganattagattattaggtaangttgaanttnantttnatntattgcttgatgatattntaattnanantnaagtactgcccagtgatattntagctgaggcnagagctaagattggaggtantgttttagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgncccctgctt

SEQ ID NO: 554910 - DNA, 160 bp, Homo sapiens
agaccccttgggcagtcagcaaagggccccgagaccaaaacaatcacgggatgtgacacagccggccaatcaagacgtctcccgcaggatgggaaaggcgggcagagaaaggggacgggaaggcgtgtaccgagcgtcgaatttcgataggtcggtgggt

SEQ ID NO: 554911 - DNA, 394 bp, Homo sapiens
  misc_feature (34)..(34): n is a, c, g, or t
  misc_feature (39)..(40): n is a, c, g, or t
  misc_feature (89)..(89): n is a, c, g, or t
  misc_feature (173)..(173): n is a, c, g, or t
  misc_feature (186)..(186): n is a, c, g, or t
  misc_feature (220)..(220): n is a, c, g, or t
  misc_feature (266)..(267): n is a, c, g, or t
  misc_feature (314)..(314): n is a, c, g, or t
  misc_feature (331)..(331): n is a, c, g, or t
ccggtaccatatcctctccgcagccctgtaatanataanncacaaataaatgaaaacttatgtaggcaatgttactgaatcagaaaganaagtggctctttagatgaactgttgatttataactgtgatgaggaaggctcagggataaatccatggagtaataggaaacatgnggagagccaccanaaactcttacaagaccccactcatagcgcaccanggtaaagatgcagcactttggctcgctttatataaacccctatctnnattattctcctcttgtgtactgatagcacatagcaactggacatcanacagcgctgcatgacantctcagagagaggaaaagctcttgtagaatagattgtctatatactgaaaaggccaaacacac

SEQ ID NO: 554912 - DNA, 110 bp, Homo sapiens
cgtccttctggccacgtctccttctggccacgctgactcaatgaacagtgtctgctgcaccagctggctaaacaagtctcttcctgtagacccagtctctcgacaaatgc

SEQ ID NO: 554913 - DNA, 245 bp, Homo sapiens
ttttttgatgattcagtaattaaacccctttggatagagttcaagatggacctgccttatgctgaatttcgctttggagcaaattgttagtcacaggtgccagtgaatgtatgaaggagaatgagaaatctctaactgatttttgaaaattggtcatctctcagagttttctttgaccttaggtccacttttcttcagaggtgagtaaggtgaaaatgtgctcagaattgccctctgggtcgacg

SEQ ID NO: 554914 - DNA, 83 bp, Homo sapiens
  misc_feature (17)..(17): n is a, c, g, or t
  misc_feature (54)..(54): n is a, c, g, or t
aatttgtagttgtccantgttgtgcttagtaaatgtgtgtcattaatgctgtantctcctagctattatggaaacttgtttaa

SEQ ID NO: 554915 - DNA, 105 bp, Homo sapiens
gcggccgcctactactactactactgctcgaattcaagcttctaacgatgtacggggacatgccactgtactccaacctgggtgacagagtgagattctgtctcc

SEQ ID NO: 554916 - DNA, 603 bp, Homo sapiens
  misc_feature (581)..(581): n is a, c, g, or t
cctagactggatacttactatgttgatacgaagaaattgagctgatacttatagctgctggcgtcacgtcccttccacgacctctgtcgtttctggttctgtaccacctgggacgttgtctgcccggtgccacgcctcaggtgtcaccctccggtcaacctgagggggtgctgttctttggggaatgctacgggttttgccatttgcttcctgaatcacatacagctataacaaactttacattaaacactgttctgtcctgagttgggggaaagcccattgaggaggggccgagttcactgggactcttccctccttggcgtggcgtcatacgtggccctcaggtttctcttcttccattgcttgactgtctgttcctttttcattagtgaccccttctgaagtcttcttgcccattgctttattggcctcttccttggcatcctgctctgcaaacttcttgaacatgttggcgtatatcctgcggtcccgctcgttgtgctccttggcctttttctggcacatggagatctgcagtcttgcagccttattctgggggtttacttccagcactttctcanagtcacccttggctgactcaaa

SEQ ID NO: 554917 - DNA, 153 bp, Homo sapiens
agtgctgggcctctgtcttaattcccagctcttcagtcaccgtcagtcagtgtgaggaacgcttccatgtccacctcttgtccctcaaaaatgggctgatattgctcaagtgataatttcttaaggattccagtcagttcatcctcatctgtg

SEQ ID NO: 554918 - DNA, 885 bp, Homo sapiens
tacctccgccacctagtcctcccgctggtattcggccaaattaggcgaattgcccccgctcccgttgcgtagccactttctccgccgtgggcgcatttacttaccataagccctttcgtgctccccctgttctccccgagaaaatggtttgtttcgcgcagttgaaatgtaatgttcacaagatctctaatagaaccttcttcatggtaaatatagagtgcgctatctccaacctgcgaagggcagcactgctttcactatgcggttcgcacgttttacgtttgcactccccgcgcgccacacagtgtgtctcacgacgacacaccaattcatcactgtgttgggtaagaaatcccacctccttggagggtttggccacacgcgagggaccatttctcgccaagaaaatgtctacagagagagaagtcttgctcccgctgtacaccccacagtcgcgagtatatttaccactttctatcttataaatagcgcgcggccctcaatcatttgtggcaggcacaactttataacgagtgtcctcggtagaagagtacccccatctttcagtcactgagaaacaacatgatgataatagcacggacattgggacccgtaaccacaccagtgtgacatacagtagcaccgggcgccccaacacacgcgggctccgagaagttagaggtgtgagaacaccaaaggagggcacgaatgaagactgcccaaaagaataaggggatcttttgtcacccccccccacgggtcaatacctacgctgagccagtccactcgggtacagccaattctgagtacaagacccatgtgaccctttttattaaccctttaaaaaaacggcgctccgaatcaaaaccagcccgtccacatgac

SEQ ID NO: 554919 - DNA, 174 bp, Homo sapiens
  misc_feature (33)..(33): n is a, c, g, or t
gagaaggtgtcacagtcttaagggctcacaggnaatcaagggactgcagctgtgctggctcaggtaggcaggtttcaaagtggcacaaagatgggtgtttgaatagttctctgtgggtgcctggcacccctctcttccatgacacagtgatggtcttttctgcaaatataccaa

SEQ ID NO: 554920 - DNA, 750 bp, Homo sapiens
  misc_feature (223)..(223): n is a, c, g, or t
caaacgttttatcgaacaggtacattggccccattgcgccctggctacgccgggatagactgagggttttcatccaccctgtggggtctacacacgcctccgtaggcacatagagatgtaaacatgccatggtggaagttttactcgggagccctcgtgtggtgaacaatattcctacccgggtcttttaaacaatgtctgcgtgcaaattacattattgggngcggatgacgaaagggcaccagcctttattgagtgattataattaaagagcgaaaacacaaccgttggccgacacaacaccaagcgcggacggccccgcacaccctgccaaagtgtccgccctggtgggttaagcacccagctagccacaggttcaccagcaactgccccaattgttcttcacccaaagtgcgagaaagcaccaccgggtgctccccacgagcccgggttcaccgccaccggagggggtcacaccaacggcctctccgcctctcgcaccggtgtgtgtcatgaacaccaattccccactacaacatcgccttttcgataccattgctccccttcttcgcacccccccacaccaaggcaaaactcgagtatacaatggtctttccctgacgcgctgcggtatattacgtgtgtatgatgtaagtaatgtggtgttgtacaaacaaatttcgaaaaacaaaagtttccgtagacatcacaccatcttcatcaagggcttcttaaacataacaccctgac

SEQ ID NO: 554921 - DNA, 102 bp, Homo sapiens
acttttctaggagatctgatgagcgtcggcatcgagtgcgcctaaagccggcgtacggttcatcccgacagcgcacagattctgcattaccaccaagtggcc

SEQ ID NO: 554922 - DNA, 329 bp, Homo sapiens
  misc_feature (97)..(97): n is a, c, g, or t
  misc_feature (128)..(128): n is a, c, g, or t
  misc_feature (245)..(245): n is a, c, g, or t
  misc_feature (284)..(284): n is a, c, g, or t
  misc_feature (295)..(295): n is a, c, g, or t
taaggcagtagcttgctgatgctcccagctgaataagtcccttctttctacaactcggtgtcttgagttttgtctgcagctcctcctgttacatttnttggctccctgactgggaagcaacgtgactnacagacagctgaggcagccccttaggcaacttaagcctgccttgtggagtgcccctgtgggggactccagccagcctgagtgacatgatccaaagagccctcctgggtaggaaattnccccggtggaatccctcaccagagaagcaggtagcaggncctcgcagggntttaacacagtggctgaacaccaggaaggaactg

SEQ ID NO: 554923 - DNA, 146 bp, Homo sapiens
  misc_feature (78)..(78): n is a, c, g, or t
ttttacggatgagtccatgtgagtaacagttcatggacgaattttgtgctgcgtcagaaaagattattggatctgtgnaaaagaagaggaagaggaatatagaagaggaagaggaagaggaagatgaagaggaagactatgatgtt

SEQ ID NO: 554924 - DNA, 111 bp, Homo sapiens
ctagttttagaagttcaatagcacatgctgcctggggtagtaaaatgggcaggtcagggtgtgattccattgctgcctgggggttcttttgtaggtgctatgaaacttcta

SEQ ID NO: 554925 - DNA, 210 bp, Homo sapiens
  misc_feature (24)..(24): n is a, c, g, or t
  misc_feature (27)..(27): n is a, c, g, or t
gcccagggttttggaccccttttntcntcttgactcagttgtgtaaagtatttctttctcgaacccagtcaacacaataaaaaaaagtcactgttcaacaacagggtttaaaaaaaatttcttcactttaattcaaaacttcaattttcgtttttcttccttttttttggaaattattgtcctgaccttttgttttaccgtatattttaa

SEQ ID NO: 554926 - DNA, 619 bp, Homo sapiens
tgagagtattctgagggtgtgtctggttccatgtgatctatttcggtttgggtacaataccatgctgtttgggttactggtagcctgtagtatagttggaagtcaggtagtatgatgcctccagctcggttctttgggcttaagatggacttggcgtggcaggctctttttgggttccatatgaactttaaagtagttttttccaattctgtgaagaaagtcatgggtagctggagggggatggcatggaatctataaattacctggggcagtatggccattttcacaatatggattcttcctacccatgagcatggaatgttcttccattggttggtatcctcttttatttcatggagcaggggttggtagttctccttgaagaggtccttcacatcccttgtaagtgggattcctaggtatttaattctcttggaagcaattgtgaaggggagttctctcatgctttggctctctgttggtcggtcatgggtgtataagaaggcttgtgatttgtgtacatggattttgtatcctgagaatttgctgaagttgcttatcagcttagggagactttgggctgagacagtggggtttctagataccaatcatgtctctg

SEQ ID NO: 554927 - DNA, 843 bp, Homo sapiens
  misc_feature (265)..(265): n is a, c, g, or t
ggtcagggctaagctgtgcgccctagaggagggaggaggacatcgcagagtcttggtcgagaagaatgaagaaggatttatgagtttggctggaacgagccattgtggagggtttacccgcactccacgttgtcccgttgcaccgatattcacgtgcctaccaagctcactccttcgcatactagctgcggaacctatgagtccacagccttcacctggatggccgtcaaagactactgcttcagggagttgatctggggacgangatgggaggccagcttgaagtttgcgcgcgatctagagacgtctctacgctgcttgcgccaggttgaacccacgcgtcgagacgaagggcgaaccagggtgaagcccataaacatgaacgtgtcgcctaattcttccgaatctcctaaaacttgctacacatctactaattacaatttcttaaaaatctcgttacttcttctccgacaaactttcaatagacacaggacagatgacgccgtggagcggattaggaatacaagaacctcgtaaactgttgtgaaatcgggctcagtggactcctgggaccaaaccttctgctagatcatctaagaacaagtgggagccaagagatggatgagaacctggagtcgaaaaagaacatgctttcagtccgccgctgtaccgccatgtcctagacatgtgggagcaggcagggcgcactgaggagcctgcgttttactggaccgttccatgggactcatccctaccttcatcagggctgttgtgaggtattgtgtgaactgcgtgtcctgcaaacgcccagctcggtgcccataacaggcgggggcacccaaa

SEQ ID NO: 554928 - DNA, 529 bp, Homo sapiens
gatttccaaagccaactgtttcctgtagtgagtggatctctgcaagcagagcctcatctttcaatttcagctacatgaaagaggaagaaagggaaagatatatgtcatacgtgatatactttatgtggctttgaagacccctcttttgtggggctacggctaaagaacatacttccctgtgatggaattggctcttcctatttccctacttcatgaaaacctccagtcgaagaccctagaaccttgccctgttacatggatatgtttactttgggaaaattcattaagccctatgcaccgtcctgatttgcacatttttttgtaagatcactccatttacaacttccttcttttaattttaaaaaacacaaaccttcggccggaatccttggccctccgcgggcccactccccttatcgggtccgctttaaacttccactcacgcatcgctctttcccggttgaaactttactcccttcccattctttcaccctccctcccctcgcaaccctatatctcaacccgcggc

SEQ ID NO: 554929 - DNA, 190 bp, Homo sapiens
caactggtattccagtcagtaggcaactacaggggttcgccactgactgcaggcactggaggttcgcagaaggggggtatggggctgttttctgcttcgtctggcaaaatctttttgacgcacctcttagcaattccatttctgtgccacgcagagttaccttcggttccgagttagcagctcgtctagc

SEQ ID NO: 554930 - DNA, 450 bp, Homo sapiens
cctttcggccttattgccgtcttttttgatgcctatgcgccattggagccacgacgaggctgacttgaatgccctgactgaagcgcacgagaacatcgatgaggcccgggtccacgtcacccggttgcttgttgcaccgagcaggccccagtggcattgacacggaatgccaaacgctgtcactgctcgctacaagctgcgcaactgcgagctactagctagagtcttgctgactgcagctctaacttgatagccctctgatcgtcctgcacctgtgtgacccactttggtcatatgcaaatagcccatgttggtcctatgacctggacctgtgacattctgaactattactgtgcttatttgacgacgactgaaacgcgcatcaaccttattagctattccgtagtttgagctgaagacatgatgagattggcatggctctatttgctc

SEQ ID NO: 554931 - DNA, 906 bp, Homo sapiens
agccacgtcttacacgcgggtgcaccgactagtgcctccggtctgggattccattcgatacctcaatggttctatacagaatgctgttgtacctttaaaatgatgcttttcattgaacaaattcacaaaattcacagtggtgcttgttctgtgtaataaccactatgggaaaatatcccgtaaacctgcctgtggccatgccaatggagtgactgacactggtgacatctgtttcgagcatgctttgtgtggctggtagattgccgaccgttgtgcatacactttgtccctcaggggtgacagggagggttactagatcatggggggagggtaaaattggatggtttgttgaacctttttcgaggggtgcgggggatatagtactcagctttatggcctaaaataacatgtataaaaagcccctgaagtatggtgtgggtgtgtacgtgtgagtgtgtgtagtatacgtctggcaattaaagctgtgtcttctggaacttagtgaaattcttttctctttttcctccagaagtattctgtgacaagatcggtaaataagagctctacttagttgtttaccatgaacatgtgccgcaaagctatgcatctaatcctacaaggttaaagaagctctaagacgtggcaggtaagcaacagccaggtcctcagtattgttgcctggattatcttagacttcatttgccagtctaagactcccagctctgatttacgctacttatatgtctgcgcggaggtaaccacagaccgttccgttaaccagtcctggcgcgcgcggctctttccgcacaaaacaactgtgtgtggggccgggtttccgcttaagtcgtgttggaacaaaacgcgggggggcactcgagagattttgtgataccagaaacccgcgtg

SEQ ID NO: 554932 - DNA, 473 bp, Homo sapiens
gatggcctcaaggatgcaagaacaagctggaagggctggaggatgcccttgagaaggccaagcaggacctggcctggttgctgaaggagtaccaggagctgatgaatgtaagctggccctggaggtggagatcgccacctacggcaagctgctggagggtgaggagtgcaggctgaatggcgaaggcgttggacaagtcaacatctctgtggtgcagtccaccgtctccagtggctatggcggtgccagtggttgtcggcagtggcttaggcctgggtggaggaagcagctactcctatggcagttggtcttggcgtaggaggtggcttcagttccagcagtggcagagccattgggggttggctcagctctgtgggaggcggcaagttccaccatcaagtacaccaccacctcctcctccagcaggaagagctataagcactaaagtgcgtctgctagctctcggtccaaca

SEQ ID NO: 554933 - DNA, 299 bp, Homo sapiens
cggctagatctttgctccaggcgaggattcgataaactttgaagcagcacactgggttatctcaggcaaaggatggagaggaagtccacacaaagaatcaatcagatttccatagtagtcgatccctggtcgcacagctgacacaagatccggcgcaatagaatctccgccttgacgcacgtgaaattctccccatacaatttttttctcaggtgtgacccaaaattcaccatgcagatttccacactcaattccaagcgcatttacacagctttgaagctgttcttcaaattcacgtt

SEQ ID NO: 554934 - DNA, 528 bp, Homo sapiens
  misc_feature (23)..(23): n is a, c, g, or t
  misc_feature (30)..(30): n is a, c, g, or t
  misc_feature (89)..(89): n is a, c, g, or t
  misc_feature (101)..(101): n is a, c, g, or t
  misc_feature (103)..(103): n is a, c, g, or t
  misc_feature (178)..(178): n is a, c, g, or t
  misc_feature (255)..(255): n is a, c, g, or t
  misc_feature (291)..(291): n is a, c, g, or t
  misc_feature (441)..(441): n is a, c, g, or t
  misc_feature (460)..(461): n is a, c, g, or t
  misc_feature (482)..(482): n is a, c, g, or t
  misc_feature (485)..(485): n is a, c, g, or t
gcattaaggcttactaccgctgnctaaggnttcatattccaccgggtgaaatagtcgtccatagaattacgtcctcgagtcccgcgagnagtcaaccgagnanaccaattatatcaataattattagcgttgtgggagcggcgtttccccctatgcgtctccccggaatatcaaaagnagggagtccatcgccaattactccagcaataataatcgtacatttagcaatcagtaaggtcaatcaaacgtcggggnagcggggtaggccgcggtttcgtaatcataccaatngccccccattcaccccatggtgtttttatccgtgaggggggggaacaacagccccaggccccaccgttgccgcccccggcccagtcgtccaacggcggaacctcaagatgtacgcgtgtcggtgggtgggatggcgtgtgagaaagtttnagtggtgttatagtacccnngcccgtgtcttcgttggccgngcnggggcccgttgacttgacggagttattatttccatgattttcc

SEQ ID NO: 554935 - DNA, 112 bp, Homo sapiens
taggctgactctagaggaccccgagtgtctcaagaatgtggctgcaggcaaggggctagaaggttcacctctgacagtattatgaatactatgcaaggtatggaatagggag

SEQ ID NO: 554936 - DNA, 420 bp, Homo sapiens
acggattaatccagaatcaatctcagctgctggagatgtttggattttcccaccggcgggaatgtgcctttgactgttgtttgtatatttgacttggacacaacatcacgtgcgagtattacaaaacaaaaacatgacacaaacgcttcacacagtctctctataatgactctgaaatcagccaatcagcaggactgttttgatgcatctgattggaggattgattgtggaggcggggtgttctggatgctcattagcataaactccgcccttttctggtatatttttttatgtgtgttttctttcagtattttgatggatattatgagtattgtttgtattgcatatttattaattatgatgagtaaacaataaagtctgtatgtttatgttgtcataaagaagtatttgtccatttta

SEQ ID NO: 554937 - DNA, 1360 bp, Homo sapiens
aaaaaaaaaaaaaaaaaaaagggcttttttacacccagaagccctttaagatgataaagggacccaattgcaggtaatcctgtatttgggactcacgtaatggtaaaatggcaaaagtttaagtggatttatttaaatctggggcctaaagctaagtggagcagttatggcacacaatgggccctataaaggcactcctaaagcgcgccgaagccaaagggagcctccttcccattcctgtggtgtcacaccccggcccaagggaacctgtgcccccaaattcctgtggtggccctgtggggcccaggtttccaatatagtgtgctcagaaagcaacttgtggtggcatatggccatggagtgtgctgaaaattggggtacattctccaaaaggggagcgcagcgccttgggggtgaatggtgggcaagcgctcaaggccaaagccccttgtggagggcctacaaaacgccacgcttggggccccagaggctctccaggacacgtgcgccctctacagagtgtgagaaacagcccccagtaagccgcccctctcaagacatacgagatcccttgtgagtcccaagtgtgtctcaaccgcgcaaaagacaccacaagaaagggggaggtgatgtgatcaccggagcgtatatacgtgggtgaaaacgtccaatctatttccccgtgtgaagctggccccaatatcccgctctgtggaaccacttcgtagacaagtgtgcccccaaacgcttttgggggacccgagaacattgggcaggggctccaaccagagagtgaggcactatgaagaggaagaaacccccgtgaccttaaaagaggcaaatttttcccccaacagtggtggggctccccacaaactttctagtgggcatctataggaggaaacttggcgtcatcacccaccgtgtgatgagtggaccccccttactaatcccttgtacctatttacaaggcggggatatatgggggccaaaagcgcaacgtgcggaatagccccagatatgcactaccccaaaggggctcccaggcggggggtaatttacggctaacatttgcacgaacaaaagtactaagaggggataatccgagtcaaaagggccattaacaaggcttattaacgccccagttaatgggagtcaccaacagtgtgcaacccgtggtgaccacaacgggtgttactggcacagaaaacattagttcgccctaaattatgagatgcccacctacattgtgttgtgaccactcacataaccactgtttaccccctattataatcaggttggtgctcaaaaaggatgcgagtgctatggacagacaacaattcgagcaatactagtagct

SEQ ID NO: 554938 - DNA, 195 bp, Homo sapiens
gataccgtgatgttatcccccaacacctgaaaacaggatgaaagccctgtttactgcaattccttttacccagtgtatcatgtctacctatcaacagaaaattacaagcatacttaaaaggcagaaaatgcagtttgaagagactgaacaagcattagaaccagagtcagtcgtggcaggagtgttgggcgataa

SEQ ID NO: 554939 - DNA, 397 bp, Homo sapiens
atggtatagctgattcttgagggtccacagcgggcgagcttttcttgctcctgggataggctggttaggaaggaggctatgtccaggagcaaagaaagggcctggagtggaggggggtggggcggggcatggtggctcacacctgtaatcccagcgtttgggaggccaaggccagagaatgccaggagtttgagaccagcctgggcaacgtaatgagacctccatctctacaaaaaaaaaaaaaaaaaattttgtgggccttggggccccgcccctatggcccaattttttaagggggatgtgggggggggaattattggaccccaggggggggggaaagaagggacctttttttgtccttctgccctcaacccggggggacagagggggccttctt

SEQ ID NO: 554940 - DNA, 164 bp, Homo sapiens
acgatctagccgtcggtcactgcgttacttattcctctgtccttgttcacgtctttcaacatgttgcagcaaacgagagtcagccccagcgcagatcagcgcttgttggcgagcaggtacagccccacagccagaccaacggcgcacaagcctgccacatagta

SEQ ID NO: 554941 - DNA, 160 bp, Homo sapiens
gttataacagcagcacggggagggtggagctatgttttgaacacaagtgactcattttggtatcccagtcgtttggcagagaaggcaagcccacatgacataccatgcttctgggtttctcagtctggcagtagtctggcagggctgctcactgtgcttg

SEQ ID NO: 554942 - DNA, 513 bp, Homo sapiens
gagtcttccttataaacctgatgagcagatctcaactatctagcttgtgtgtcatcagaaaggtttatccctttgagagtatcaagtcctccgttaatgattcttgctttcatccctccccgtatttgctgtgggagctcgttttattctttaatttggaaatcacgtaatttttcttctttattgacgaattcctcccctcacccaaactgttctttcccaccctctttccacatatcttaaatgtccctgaatttcttgttaatttttaaagtcactaaaatgtacccacgctcactaaaataccactaaaatgttaaccctctcgcggttcgcacaccctctgtgtcttcttgccacgctttataaggtaaatggatatttgtagcccactttgaattttcttcacctcttatttctcgtaatttctggagttttttcagattgtggtgtattttattgtgctcctatgtaagatgaagaattaactattaaaattacattttcaacata

SEQ ID NO: 554943 - DNA, 188 bp, Homo sapiens
actctgtccatactacgcacatgaccgtaaattcggcattgcagtacgacttgcaatacaggcatatgcccgtcgatagataacagccattctcatccaataccccctgaagctacaccggcgcagtcgttctcataatcgcccacggggcttacagtcctccagtcatgtgggggtggtacctgagc

SEQ ID NO: 554944 - DNA, 105 bp, Homo sapiens
tactgaatgccctgacacttgccctgatgctgtccatgaaattgtgctcaccatgcttccagctaacagtgtctagaaaaccagctagctgaataacatgtgtgt

SEQ ID NO: 554945 - DNA, 130 bp, Homo sapiens
tcatagacaagaggcattgctgtgagcgatgagacaggtgactctgagttcttgaggggcgccgtgccctgactgtggatgtgagcaggagagaccagagaaggaagtgataattgccaaattggataag

SEQ ID NO: 554946 - DNA, 1213 bp, Homo sapiens
  misc_feature (328)..(328): n is a, c, g, or t
  misc_feature (974)..(974): n is a, c, g, or t
agcggattgtcggcggcgggagcggtgcggggggcgcgagcgggactggccgggtcggctgaggctgctggctgcgaggagccgcggggcctgtgcgtcggtggccgacaggggagcaggcgcgtggtgctggcgcgaaggtagtgcctgcggggcgcggtagacgtcgcgcgcggcctcctcgtcgtgggtgagcgtgcctgcggcgcgctgccgtcgacatcgaggccgcagcgcgcgcgtcgtcggccgcacacggtcgcgtgcgtccggcgcatcggcagcgccgcgcgggcggcttccaggctgcatgactacgtcagctagnagaggccgcgggcctctcaggtgaagccaaagggtcggcacatgtactgatcaatacattgttccaccttactggcttgttatcagtactacgggagatgagcacaggtttggaatgaaaaggcgtataacatccagggcattgacaactcttattttttcgtagagtcacccatagaggacctaagccttccagtgtccaacgtgggggcccttgcgtaaaggccctttttggcaggggcataattggacaggcaactaaactttccccctaatttctatttagccaaccataagcgtgttatgggccttgggggataagggagaccaaccgtggcacaaaggttgaggatactccttggacaggggtacacataacggaacttagcatacgtgggatacaccacttgggtcacagacggtccctcgcgggggtttgggcggaaacgcccggaaacggcaaatttaaacttctaagaccaccccaattggggacttcccccggggtccaacaatggcgtcccacttgtgggcgcaatgcaaatttcggttatagcggggaaacggccgttcccgggcggcccctgtttgtgtaaagatttgggaaacgcggcccaacgcaaggggcttatggaatttggccaatncgggcggcgctcccttcgcaggcgtcccaacatttgagtttcctacacccccatctggggcaatagtgcgggcttttggggtgcggcggcaaagagcttcccccaaggttacgccatcaagtccggcagcgcgatatattacctgtgggctcggctatggccgggccccgaggggattttgcctgggggtccgagatcacagttggggttcggactcgaaggctgcggaagccacacca

SEQ ID NO: 554947 - DNA, 360 bp, Homo sapiens
tggtgagtgtaacaggagacggagtcttgctcggtcaccgagggctggagtggcagtggtggtcgatacttgggctcaccggtaatctccgcctcctgggttccagcgattctcctgcctcagcctcttgagtagttgggactacaggtgcccaccaccacacctggctaatttttgtattttcagtagagacgaggtttcacatgttggccaggatggtctcgaactcctgacctcgtgatccacctgcctcggcctcccaaagtgctgagattacaggtgtgagccactgcgcccggccaacatggtgatttttatttattttttatttttttattttttaggttaatgttagagata

SEQ ID NO: 554948 - DNA, 772 bp, Homo sapiens
  misc_feature (201)..(201): n is a, c, g, or t
tctgggtgcccggaggtcagctgtgttctgcggagttcgcccgtctggcccccgatcaccatgtcggtctttcgacatccaatccccttcgcggatcccagtggatgtaaaccccttccaggatccctctgtgacccagctgaccaacgcccctgcagggtcggtctggctggaacttcaacgccctttctcagagacaanatgcaggcagacatactagttcctgtcatcgccaacatccctggagtcctcacagccagcgggttctccagccatcagtggaaccaatccagccgaccccccaggccgtggtgtctgcagacccaggctacggcctgctccgtgctagacagggaagaaactggtagcaggaacagctgtccgtacgactggaaacgcaatggagcgggagctgcagaagcacctgctatgcacaagcttgctctgctgagacagaaccaagctggcctccccgtctgctcctcgtggtgcccgtgttgcaggccctgcttgctagtctaggatttctccacagagatccctggcgactaccagcggatatgcaagatgctctactactcggtggatgttgcattcgagtgactcgtgtttcttgaacctgcttgccctgctggcctggttctcgggcaaacagctccaggtgagtggactttggcctctccatcctgtggtttctgatcttcactccctgtgccgttccttttgtttgttgcggccatctttaaggctttaggtcgacatctttcagtct

SEQ ID NO: 554949 - DNA, 1331 bp, Homo sapiens
gcattctgtattctgaattcctcctgggacattagtgatgtgtttttttgtaacttaggaattgtacctaatttattttttaaccaaatagcatatcttcttgagatggctagctgagaaagagtatgacacatgtgtgatcaaggatcagcaaaattaactacccatgcaaagattaaacctgttacctttacttccctaatgtggtattttaactagctgagctaaccaccaatggagtgatggtatggcctttcctgtactcaattcagtaattgaacagttatttatcgaaccctctccagatgccaggcaccctgcagaaagtaacattctgaaaaggaacagccatgcctgtagcccaaaagtgagtagttgtattaatggtccattccttattaacaaattaatttcctcaggagtttattggaccagatatcaaagtcccactggaatgtcttaagtgagagagaggataaatcaaagttttccttatccaggctttttggatgtcttttacctgagcctcctcttccaagcctgttttgctctcagtcaggatttaccagcactctgcatgtgtaggcacgctcgcctgcttccttctgtagtggtaatgacaacctacatttgtattctgcagttgataaagcctgttcgtggtacaatacctcatttgaccctcccaacaactgtagggtagatgttatctacatgaaattgagtctcagagagggtaagtaactcacccaggttacacagtaagtaacagagatgacacacgagttcagcttttctggagctaagttctcctcttcctccacccatgcccagccactcatatcctaggtgtagatcagaaggttcttaaaaatattgttagactgagctttaaaagcagtttggatcagagattttcattgtctgttttgtgttcacatggcagtcgaaagtctctaggttccattgcattatacccttcttagaggctccagaataaatttttttatagtggtggggaaaagcccttattcttagaataagaatatagatcattggtaatagtaatcagttccatttcttatgagatagttgtcaggattaaatgacataatgaatttaaagtatattgcctgtcatagcaagcactctgttactgttagctattatcatttatgactattgctctatgttgttttttgtttgtttgaagaatgggctcttaaccttgtatgagaaagaaaagggtgaggaagaaaatggattgaaggaattgtaggagactaaatgttaaaagtcattaaactaccttctggtttaaaaaaaaaaaa

SEQ ID NO: 554950 - DNA, 697 bp, Homo sapiens
tgtagtcgctcctgtactcctgtatccacttcaggagcctccctctctgcaaatggctgaacttccagagttcagaactgagtgtgctgccctgggatgtccatatctagcttcctacccaggactcccacggtgactgtggagtactccgtgaaagcccgttttcggctggcaagcggagggagtcttggtggagactagagtggaaagtcgtgcaggctgttgcaatgccgagcagagccgtgcatctcagcccccgtatcccctagcacgtcctgaggtcactcgagagcatggatgtccggccccccgtgcatactgaaatttctgttcctcccattccccttcgttcatacacataagtcaagctgaatccaatggtgcgaccttctcgtcgtttcagctcaaggcctatgacgtggtgcgcatgtgaggtccctgaactctctgaagcctcgctggtgtctggggccgttggagaatgcactgtggtgctgctctggaattccctcgtgcagcaagaaaaattccgggaccttgttggtggaagataccctaatagtacccttttgatggctacgtcttgctcatttctaacctgtgtcctttggaatcaaggctaagtattgccacacgagacctgctgttcttgtacagcattccttgcaaaccggttgacgattctcatcccgaggag

SEQ ID NO: 554951 - DNA, 593 bp, Homo sapiens
cgaatcataccttaagtcaattgggtaccgcctatgtagtacaaatattcgattacactgattagctcagagtgttaagataaagcctggcctgaataaggtccagtaggacagtaaagaagctttcacgcatctgtggagcatttgtctgtcatgatggcgcttacagacataacaccgatagactagtgtcgccatctgcagatgcataatgtaaggagtgcagctgctggtctagctgtcggcatgggcacatctgccagactctagccccggtggatgttgatgtccgaattgcattactggttagcatagtggtctatacaccatcatctgctgtatcagagggtctctgagctgtgagttcatgagccagattgaagctgtcatgaatacctttgtcacgtgtagactagccaataggcagatacacagggtatgtctcggctccacagatagccgtttcccctgcataatatcaagtagcattgacttatacaggctcgtatacatgatctatgaaggcatttgaaccagaagtaagctttctcagctaccccgcaaatgagacagcgatgggacctgcatcaagg

SEQ ID NO: 554952 - DNA, 360 bp, Homo sapiens
  misc_feature (40)..(40): n is a, c, g, or t
acagacttcgagaggtaaccctagcactgtccttcgtganaatctctctctctctcaacagccacagttacacatttccggtagtcccaagtacacattacttaggtcatgtacacagcttggtatttctcatgtcgaaagccgggtatttctcatgtcggaaccttgtcacccacatgccagaatttgggattgtgcgcacacaccacttcttgtggtccgtgtaatcttccccaccagcctagcaattcactatcagcatatacggacccacacagctttagtggtaagaccctacacagcacagtcagcgatcacagcacgagggttttctcagacacacttgtgctagcaaaccct

SEQ ID NO: 554953 - DNA, 600 bp, Homo sapiens
agagacatagtcgaggatagagtggagatagtagaatagatgagaatgtgagtatagagaacttgatgtgagtagaagatgtaatcgtcgtgagagtcacggtgtatgtgacggtggagagaagatgagaagcgaagggagatagagagatatgaagagtgagtgagacgtatgtaacgacattcgagggtagagtagatagagagtagagaggcatcgagtgatagatgagacgtggaggacgagttggaagctgagacgaggatatgatggaggagcagagagggagagtggcgtagtgatggagatgcatgtgtagtgagagtacggagagagaagatagatggtgtgtaaaaggatatgtaagctgtggaagtatgaggggaagtgcaagtgctagtgctagagggaatgataagagggaagaagggcatatggagtagggggagagcgtggtggagggaagagagaggaggatagggcaggatcagcgggagaggtgcgaaggtaggacgaggaaggagcgaaccaccaccacaaatccttaggaaaacaaaatagattcactacaataaagtatctgccattccatttttcaac

SEQ ID NO: 554954 - DNA, 205 bp, Homo sapiens
  misc_feature (1)..(1): n is a, c, g, or t
ntctagaggatccctccagtctgaggcgggtgcggtggtcacgcttgtacagatggaggcaaggtggcggatcactgaggcgggagttcatgaccagcctgaccaacatggagaaaccccatctctactaaaaatacaaaattagcccagcatggtggcgcatgcctgtaatcccagctactctgggaggccgaggcgggtggat

SEQ ID NO: 554955 - DNA, 1127 bp, Homo sapiens
  misc_feature (356)..(356): n is a, c, g, or t
  misc_feature (474)..(474): n is a, c, g, or t
gtgccccaacgatcccccaggctttggatgaagatcctgcagctgatagggagagccgccaggacagcagatgaattctcagcaggaggaagaggaaatggaaacagtatgctcgcgtcgttcccgtggtgcctagttcatgcgtcgaagtaggactgaggtaggtactagcagtgtccggtactctacatgaaggcagaaaaaccggagagcgtaggagaccgtaaagaagaagaaaaagccccagcgtggtgcggatggggttgtccatctgatgagctctgcgggaccgggacgcaaatgactcaacccggtcccggtggcttgctgattccccaaggcaggcgtgagtgttngaggatgtgagtatcgtggacgtgaaggaacctggaatatttacgaggcccaacgtcttatctgtcttctacagaggcatcctttggagcgcttcttaagtcgtcactgagtgcatgntgcaagtaagggagcacaagcaggaagaggagcccagagtaaacttgtacaatacgtggagtaactctgcagtccccgcgaagaacgaatcggatttgagagaggcagcacaaggacagtgaatgagtgacagcagtgaatgacgagcaggaatagaggaagcccagaagcccccaaggctgtccaaggaagaagttgctgccgaaatgaatccgtttcacttgtggctgaactcaagcaggctggtggctcgggccgatgtcgtggagatgcacgatggtagacagcgcagggaccctaagctcttggttcaacctcaagggcactcggaactcttgtgcctgtggcaagccacttggtggtttaagccgaataactgtcagggcaaccgggccttgagaaagcccccgcttcgggctggccgacattcacaagaggcacagggatccaggagagtcgaaaggccttgaaggagaaagggagaccaagaacccggaggtcccacgtgtgaagacaatttgcgccagaggggccacagtgacccagataccacaagcggtgagcgcctaaagaggacacgcacaatgataccgggggcgacaaatggagagatgcacaggacgagaaaaccatcttcatcagaaccatggtga

SEQ ID NO: 554956 - DNA, 224 bp, Homo sapiens
  misc_feature (185)..(185): n is a, c, g, or t
cgccgccaccaggagtcaggagccgccgcttccactcatccggctggctggccagtgctaagccgtcacacagagagagtacgaacggctggttcagagacagggggctggactctattgactcgcggactgagactggagcccgtgagggagacttgggcagggtgctgcgcggccgaatcgtntgcgaggcggaacccccctccgctactgggttaccgagc

SEQ ID NO: 554957 - DNA, 357 bp, Homo sapiens
cattgctcccggaagtgtgaagacctcccctcttgtcacgttattgagttaaaataattaaaacaaactcagcctggcgctgttgctcacgtctgtaatcccagcactttgggaggctgaggtgggtggatcacgaggtcaggagatcgagaccatcctggctaacaaggtgaaacccgtctctactaaaaaatacaaaaaattagccaagcgtggtggcaggcacctgtagtcccagctactcggaggctgaggcaggagaatggcgtgaacccgagaggcggagctggcagtgagccgagatcgcgccactgcacctccccctgggcgacagaggcggatccgtctcaaaaaaaa

SEQ ID NO: 554958 - DNA, 246 bp, Homo sapiens
cccccaaaaaacccccccgctttttttggggggggggatggaatttaaagggggccttttttagcccccctttggggggggtttttttaaaagcctttgtgcctcccctctttgccccccttgccgtctttttttagggggccggggggttccggggttccattttgggaaaaaggacctttcttgggccgggcccctctttccgtttttttcttggggcttccaaaaaagtttttttttggggga

SEQ ID NO: 554959 - DNA, 1101 bp, Homo sapiens
ggacctttctctcgctgactgatgatgaccccgtgtcatcgtgcaggccgatcacggaaatctgactgtgtgcttcacatgtgttcaacactacagtatgtcacggcttcagcgaggaacatacctttgcccgttgctggctacttattgatcctaactgagagctgagtgacctgtgccagatgaccaggttagatctttctttgtctattaccgcaagaccaggatagcaagaaattccgtgcgcgttatctaatagtagttgcgtggagtagttgcgtgaacgcttgtgaaatggacgctcatcatagttgaggcaagggccgtgggggagatggctaaatgttactctcagtagttagtagcctcgtgatgggcagtcttgcagtctaatcacgttgctttccgaagatagatggactacttcagcgcagcgttgagagggtagtgttgctcacaatctctagtttcgtacgattatacgcaacatacataccatggacccgagtctatcaagtcgctacaccggaatggacggacagaatggacttaggtgccccattactggaataaatcgtatgaccaaaggtgggctgatgagcagtgaggaggatggaacagaactaaaatacctgtaagtcttgatcatacatgtgcagatacgttgacaacacctccgtgggtgatacgaatcaaacggagacctgtacgccttctttcctgcactgggccattgcccaaagaacatttgacggttgtgttgaacctaaaccatgttatttattggaagcttcccaaatacccagagtggtcttactggggtgaaattctatctggagatagaggactccttgtcgcaaacgtggatgcctaatgggtcggttgccaaattacccgaaggtgtgattgcaacaaagtattgaacccaaaggtggcataggctcaacgccgttaatgaagaggggcgcccttggcgcagtgccaagattggaaagaaattgaggcttgcatgaggaaagaaccacaaagactcttgggaggaaaccgtttcaacagagggcttgcccaaggaattcttacgctggttggacctccataaat

SEQ ID NO: 554960 - DNA, 124 bp, Homo sapiens
agtcttcagatgcttctagctcctttaattatatcaagtcctcctatgagctctccagaaacatagagctgaggataggtaggccaacgggatggggcttggagacccgggggaaaagtagggt

SEQ ID NO: 554961 - DNA, 650 bp, Homo sapiens
taatgggggggggggggagggggggaagggggggggggaccaacccccccccgcggggcccccaaaaaccttttcccaaggggccccctaaaacccgcgcgcactattcttccactaccacccctctctataatttcacccgcccccgaccttattactctcccaccaaatgcgtctctcttcttatctattatagaacacccccctccccaatacaccaaccccctgtgtgacacactctcaccacataggcgcctcctcattatttatctctcatcgacaccaccctctcctacgcccaacacgggcgatacacccccacaccccctccggtgcacatgaggggggaggagccctcaaacactcacaaacaaatacaccccggtggagcgcggcgcgccccggcggagaaagagagaccccaaaacacaaacactctcactaatgtgtagagagtccaccgcgctcagaaccctacaccattcttcttatatctaccaaatcttacacatataagagggggggcgcccttatcacctcccttccccccccttttttctaaaaaccaagaaaacaaccctcgtggttatacctcgcgggcgaacgagagtcacccggggggcacaaatagaaggttattgactcttctc

SEQ ID NO: 554962 - DNA, 536 bp, Homo sapiens
ggcacgagaccaggtcctgcttgccaagacagaagctagaacctggaaaaacttggggaccagactcttcctacctctttcctgggcatacttactctgtctcagaagacagatctctgggcctctcgcaggagtctcagctgcactcaggccagttctggagaaggcccaagagtctggaaggagcagagcagccttgagccaggagtactgtatatagaaggacctgcttatccaagagctggagaaagttggtgttttgtgtcttgttcaaagctgcccatcaccatccgatgacgctaggaccttgagtggtatcagaggccagaagccacacactgccttccacatctgtccctccactctgcaacaggctgaaggatgtgtgtctctgcacacactgaaggatgtgtctttgtagtttgtgctgtaaataattgcttttggggccccagggtcatagctcagtggtagagtgtgtgtggtcaccctgagctctctacaccgaaccacaagctacattaaattacaaatta

SEQ ID NO: 554963 - DNA, 924 bp, Homo sapiens
  misc_feature (77)..(77): n is a, c, g, or t
atgatgttgttagttgtctcgctggtcgtggctccctcggtgttggggtgcgacgtgtgcaggtgggcggagagatncgccatggaggcccgccccctctgggttcccccgaatggtcctacccgccccattggggcgtctcctccttctcagcggtcgtcccagtccttttgcgggagtcccccccggatttgctgtgtgcagcccaatgttgggatccggtgtccccggcccgagcacttcccctggttcttgccctttcctccgggcggcttttgcctcttctcgcaactaaacatccccgtggccgcctccataagttcagggtatcctccccctgggttcctcctcggaccagcactctctcccaagcccgactttgaacagagccctcccccccctttcggagatcttttttcttcttccctcttctctcctcagaagccctgggtcaatgaacacctcaactgggggtcctatgccctcaccctcgacaagtatgtttccaattactccccgttctcgcgggcacgcaccgattcaaaaggcgtcacgcaccaacaatagcgccaaatcatttgccgacacccgtggaccaggggagcaattttgatgacccattatacgcggccacgcgcggacatggactttcagtgcacccccatcggcaccggcagtcggatccgccaccccgcacggtcgggtactcaagctacggttggaaagtagggcgcagacactcctccatcaattccctactgtgcgggagaacgccacttgttacgcccactttgcgaattcgttaaatgtgcggctcaaaacactcagcaaagcacccctttagggatcaacgccgggagaataaacgattctgatagaaagcaaccgcgttggggttaaaaagggaacacacaacatgacaca

SEQ ID NO: 554964 - DNA, 262 bp, Homo sapiens
acagagtacacggactcagctttaagacctcactgacatgttggataatcaatgggaaacaatcgtaaagccttctgctagggcataaattggattccgtctatgtaactcaagaaattactttgcctcctgatctaaatgcttgcctctagtctagggcttagaataaggtcctggttatttgaactggttgtcaatcaaggtccccttcattttcgctttcttggcttccaattcagccagctcttgcagtcgcctcttg

SEQ ID NO: 554965 - DNA, 263 bp, Homo sapiens
ttcattattgcggtagaggcagcagaggttgtagaactgctccttgtaggcagatgccacaccccaatttcatggagtgatttgcgtctgcagcaggcagcaaggctctgagcatgttgtcctagacctgggcaaaggacaattcagagctcgggggaataggggtgtgctcagcacgactgggtggacaggccgtttgttgtgaatcgtacaggcttccaggagcgggtgccgatcaatagcgaggtgccgatgaatagcga

SEQ ID NO: 554966 - DNA, 195 bp, Homo sapiens
agagctggatagaggtctgggactttggcaccagccccaaactccagagaggggagaggggctgaaggttgagccagtcaccaatggccagtgatttaatcaatcatacccatttaacgaagtctccatacaaactcaaagggacagggtttggatgaacttttgcggtcggggttcttggagggtggtgttcca

SEQ ID NO: 554967 - DNA, 1479 bp, Homo sapiens
caccctacagtggggccagtgcggcaatcagattgggtacggagtatctggaaacgagctgtgcgccgagcgatggtatcagcccctgagggcgtcgtggaggagtacgccaccggagtgcactgaccgcacagcacagtctaaaatctaccaggcagacgatggagcactaagatagccccggggcggtgctgctaggactgtggaaacccggggtggatccattacgatccctcaagtcgcccctaatgccaagggtctagcaacccagagaacatcctaaccattgatcgggaaccattggcacgtgaacggacgctggggcagagcaaacattggggcgcatgtgcgaatttcctcccacaggggaacggacaacgatgattccacatttgaacggaccataactcgtggagcatacataagaacccgtggaaagcgacaggacctagggcaacgtaggacctaggtcgataggacggcgccctatctggtcgcctcgttagtccagacgttccccaaaggcgcccagggcgcggggcaccaggggccatccctggaacctggggggataccacgaaaccattcgtaaacgagaaacccgggtgcttggaagctgtgccctggcgcataattcccttaaagacaagggctgtggatggccaggaacatttaagcttcaagaagggactaaacccaccaaaacctcatgtgtcacgagaagcaattgcacgccggaaactcagctggctactggatccccaaggcgcctattcagcacaagattcccacccttcccatttccaacgtaactattctaatatgacaggtgcgtagtaatcgccagataaaaatttgtggacgaagccatgtgtctggccagcaacaggcgctctgtgcctatggacagacaaaagtcaaccaacgggaccccgctgtagaatcccgaggaacattaggagccccaaaagagatactgcggtgaccttgtgcacacatattccactgggaagccccacagtaccgcacatcaccatcgcccgaggcaaaatacaaaaacacccagacaacatggagtaaggatactgaacccacaatccaccggcgtcagcaaggccgcaggcacagcccgacaggacgaaaaaacccagtggtcagaacgagatcaccccagggaggacaaccacaattgagagacaccccactatggtacccgcactcacaaactgcgggagggccgcctgcacaatcggcgacgacagacgacgtaccaacataaacaccaacgacagcccaaaggggcgtcccacacagtacgaaggacgactacagaggaacacgcgcggctgtacaaaggcccccgcacgtgcaacgtaaccagagggatccagtacacaaaggaggaagacacacacagtaccgagcagcagtcagaaggccacaaccgacgccacagccgcatggaccaaacagaccacg

SEQ ID NO: 554968 - DNA, 169 bp, Homo sapiens
ctccactgcactccaggacctggcaaacaaaacaagactctagtctcgaaaaaaataagaaaaagaaggaaaaaacataaaaaagggtcccccttggtggaccccttggcctttaaagggaaattaaaattaataaacggttaatggcccagaattttgatacttaaat

SEQ ID NO: 554969 - DNA, 161 bp, Homo sapiens
ctaatgcatggtcctcgctcaagaatagtcctccagctcaacgactagtcctcagatcaacgatggatcctcagcatacaacgatagtcctaccgctccacgatggtcctcagctcaacgatggtcctcagcccaacgctggtccacagctacaacgatgg

SEQ ID NO: 554970 - DNA, 389 bp, Homo sapiens
  misc_feature (361)..(361): n is a, c, g, or t
cccctatcacttccttacgtatcttcgagtgacacgttgaagacaagggtacaggtaacaaaaattaagatcacaatcaccaatgaccagaatcgcctgtacaccatgaagaaatctaaaggatggttaatgatgctgagaagtttgctgaggaatacaataagctccaggtagcgcattgatactagaaatgagttggatagctatgcctattctctatcgaatcacattggagattatgagtagctgggcaggtaactttcctctgatgataaggagaccatggaatatgctgtagtataagggattgacatggtctgtaaagccatctagatgcttacttttaacacttcccacgctntcaagaaggtacaggatggtagctaggg

SEQ ID NO: 554971 - DNA, 231 bp, Homo sapiens
gaagcaaagaaaaaaaaggctactacatctagctaaattcacttccgattgttgaaacacaagggaggggctgggccgggtggctcacacctgtaatcggagcactttgggaggccaaggcaggtggatcacttgaggccaggagttcgcgaccagcctggccaacatggtgaaaccttgtctctactaaaatacagaaattagctgggcatggtggcacatgcttgtaat

SEQ ID NO: 554972 - DNA, 134 bp, Homo sapiens
acagatggaaacagagatatctggggtcgttgtgtatcagtggaaccgtctgtctgtgggatcatctcatccctcaggtgactttatcatgtggagctctttatctgtcaagccctcccccatgggtgaagaga

SEQ ID NO: 554973 - DNA, 4156 bp, Homo sapiens
gaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaataggtacaaatgtcctaaggtgggaacatgcctggcatgtttgagaataacaaaggatccagtgtggctggagcagaacaagtggggagtggggtgggagtgtataagagaaaagataagagataacagagtcaaatacaacctcttggctactctgagcgagatgagaagccattgggggcttttcaagtaaggaatgatatgaattcacattttaactgcgttactttggctaccttgttgagataagaaaagactacgatgaggcaaatgtgtaagaaagaaaactctttacgaggtcattgcaataatccagacaacaatggatggtggcttggagagagtggtagcagtggaggtaataagaagtagtcagattttttggatgtatgttgaagataaaggcaacagaatttgctcactgattggatatgaggtatgagacaaataggagtcaaggataattctaagtttttgtcctaagcaactaagaggatgtcattagcattaactaagatggggatagtctataggaagagcaagatggggggcaggtggtgggggttgatcacaagtttgttttagatatgttgagtttgtgatgtcttttaaacatctaagtggatatatcaaatagagaattcagtaaatgagcttggaggtcagggaagaggtccaggccccagatataaatgtataaatgtcagcagtattcaatgccatgagagtagatgaaatcgcttaaaatgagattagagaagagtgtgaatggaggagaggtctgaggactgagttttcaagtgccccaacattaaaagattaagaggaagaggaggaatcaggaaaggagactgagcagggatggccaatgaggtaggaggaaggaaggtaagtaatacttcctagaagccaagtggataaagcatttcaagggggaggtgagtagttgtatcagatgctgctgataggtcaggaaagatgacaaatgggaaatggctattaaatttagcaacatgaaaatcattagtactttgaaaatagtcgttttgaagtggtgcatgtgaaagcctgactggttcaagagaaaatgggaggagatacattttctcctaaatggaagcaaagaaatggggtagtagctgagtggaccatcttgacctggtgtaatcctacacattgagggaataatggcttctccctgtcttacaacacatttattcaataaaatggttactaagggcctactgtgtgatataatccccaacccttcctctaagagtgatggttttgtgctcagcaggccacagcctaactactctcagttacgccacctggtggtggtggaggtaattgaccatctgaaccgtggctatcttctgactccatgaccttctcaattcatactatctcaaaataagttggtagctggagtgccttcaatcataagcatagctttaaaatttgtgtcttgcatgtaaattgcttcactgatgtttggcttaggcttagttgaagtacatgtttaaaatatccaatgactttgcatgatttgaactccaatacttaatgattttgtggaatattaacttcacaaaacgttttgtgaaaaacaaaatcagaatagtaagtgaaagatgtctcattgtctcttcctctttctgaatttcctcatagtcatattagtggaaatgctaaattcagtgtttaatttccatgaaatgtgttctatttctcaagcaagtgataacaagaactagaccattgaataggttaaaatattttactatgcaactttagaataaaatgattaggctgatgagggttataaagggtttcctttggatataaatcattaaaaatttagtcatt

SEQ ID NO: 554974 - DNA, 127 bp, Homo sapiens
tagtcatcgtagacgtaccgatgtcgacctggttacttcccgagaatatcgccgacgtactgccgtcggaagcgcgcaagatcgaggagctgcgccgcaggctgctcgaccgcttccgttcgtatgg

SEQ ID NO: 554975 - DNA, 4065 bp, Homo sapiens
gaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaataggtacaaatgtcctaaggtgggaacatgcctggcatgtttgagaataacaaaggatccagtgtggctggagcagaacaagtggggagtggggtgggagtgtataagagaaaagataagagataacagagtcaaatacaacctcttggctactctgagcgagatgagaagccattgggggcttttcaagtaaggaatgatatgaattcacattttaactgcgttactttggctaccttgttgagataagaaaagactacgatgaggcaaatgtgtaagaaagaaaactctttacgaggtcattgcaataatccagacaacaatggatggtggcttggagagagtggtagcagtggaggtaataagaagtagtcagattttttggatgtatgttgaagataaaggcaacagaatttgctcactgattggatatgaggtatgagacaaataggagtcaaggataattctaagtttttgtcctaagcaactaagaggatgtcattagcattaactaagatggggatagtctataggaagagcaagatggggggcaggtggtgggggttgatcacaagtttgttttagatatgttgagtttgtgatgtcttttaaacatctaagtggatatatcaaatagagaattcagtaaatgagcttggaggtcagggaagaggtccaggccccagatataaatgtataaatgtcagcagtattcaatgccatgagagtagatgaaatcgcttaaaatgagattagagaagagtgtgaatggaggagaggtctgaggactgagttttcaagtgccccaacattaaaagattaagaggaagaggaggaatcaggaaaggagactgagcagggatggccaatgaggtaggaggaaggaaggtaagtaatacttcctagaagccaagtggataaagcatttcaagggggaggtgagtagttgtatcagatgctgctgataggtcaggaaagatgacaaatgggaaatggctattaaatttagcaacatgaaaatcattagtactttgaaaatagtcgttttgaagtggtgcatgtgaaagcctgactggttcaagagaaaatgggaggagatacattttctcctaaatggaagcaaagaaatggggtagtagctgagtggaccatcttgacctggtgtaatcctacacattgagggaataatggcttctccctgtcttacaacacatttattcaataaaatggttactaagggcctactgtgtgatataatccccaacccttcctctaagagtgatggttttgtgctcagcaggccacagcctaactactctcagttacgccacctggtggtggtggaggtaattgaccatctgaaccgtggctatcttctgactccatgaccttctcaattcatactatctcaaaataagttggtagctggagtgccttcaatcataagcatagctttaaaatttgtgtcttgcatgtaaattgcttcactgatgtttggcttaggcttagttgaagtacatgtttaaaatatccaatgactttgcatgatttgaactccaatacttaatgattttgtggaatattaacttcacaaaacgttttgtgaaaaacaaaatcagaatagtaagtgaaagatgtctcattgtctcttcctctttctgaatttcctcatagtcatattagtggaaatgctaaattcagtgtttaatttccatgaaatgtgttctatttctcaagcaagtgataacaagaactagaccattgaataggttaaaatattttactatgcaactttagaataaaatgattaggctgatgagggttataaagggtttcctttggatataaatcattaaaaatttagtcatt

SEQ ID NO: 554976 - DNA, 303 bp, Homo sapiens
  misc_feature (20)..(20): n is a, c, g, or t
tgtcgtccttaatatttctnagccttttgtcatagaggtggtcggttggacctcaaagcctccatctaattttttttgtctatgtttctatatctctctcttttacgcttctttcccggaccgtcccctccctctacaattatatttactaccttcatgattgctttttattatttctttcactcatcattattgttcattttttaattaacaatttttttcattattctttttcttaatttgtaacccgtttctaattttctcaattattgcgctttctcaacccccctccttcctcattac

SEQ ID NO: 554977 - DNA, 325 bp, Homo sapiens
ctggagacctcaggaagctataatcatagtagaggcaaggtaggagcagcacttcacatggctggagcaggaggaagagagagtgtggggagtgggagtgctacacacttttacgcaaccagatcttgcaagaactcactatcacgagaacagtaccaagagggaaacctgcccccatgatccaatcacctcccaccagaacccaactttaacactggggattacaatttgacatgagatttgggtggggatacagatccaaaccatatcaatgctcatagataggaagatagtattttgttaatacatcagttctcccgaaatt

SEQ ID NO: 554978 - DNA, 358 bp, Homo sapiens
gtggtgttgattgctcttggtggctgtccctgctgcagcagcccatgatggcggtggtaagaagatatcccgcatagcgaacagaacggacacatttcaccgtccgccttacctgatggctagacccgtgaacatgtgaagctgatcaaggaattcgagaactacatccaaggcatcaacctcgtccaggcgaagaagctggtggagtccctgccccaagaaatcaaagccaaatttcgccaaagctgaggcggagcagatcaaggcggccctggtggcggtgggcggcaccgtgggtcctggaagtagcctccagctcggaggacttgtgttcaggggtcctggacccatcggcgtg

SEQ ID NO: 554979 - DNA, 1054 bp, Homo sapiens
ggtgttcccccaacctttatttccaagtgcacattttcagtctttcacaatagctgcctttctgtgcatgtggtgcatttcaacatgcatttcaagttccatttgttctcaaccttggggtcaaactgcaggtcattttgcttcctgggcaagcatcttcgcaattattgagtgctcctgatggggcagcggggcatgagctaaagatacaatagtttaccctgacccgacaccgattccacaaaatagcaatgtaggattatagcagactctgaacttctgactcccagtaacccatcgttagggcactctagacactatggaggtacccaaggctcagccagtctctatattaagaaaatttaacaaataagagtaaccctgtcaccaatcactgaatctctagattactactcttagaaaacacgctgtggacattctagagccctccatgtagaccgaatctgaaatcatctctgcagatactacaaaaatagacccagtcaaattctccacttggaggaaaatagtaacaagagtggaacccataagacattagagtccacccccccatagactaccaaacatgtctagacccccgaagagagctcatagtcaggtcccttgattccatcctattaaccataaaggggatgagtgctagcaactcaagaaataactcatctaacacctctggtgcttttccttcaggattcccatgatccctcatggtcttgagaagggctggtgcaggaaaaacaagaaaacctgactcttgcccatcacttgaacaaatataaagcaatgaacaaaagatgtttaacagaagacaactgtcacctacgaatccaggtgacccgaaaaggaaaccacggcaccacgaaaataagatgaacaatcccacaataaatagaatcttgcctttaaaaccgcaaccaggtggatatcataacaacaaaacacacacaagagtatgttagacacaccgcccagggaaaaacggtccaaggtgactacattgagtattcatacctagtgttaaggaacataaaca

SEQ ID NO: 554980 - DNA, 221 bp, Homo sapiens
gcagaagtctccaagaccccgggaggctaagtcaccggcgttggaatagagcctgcctccttaccaagatctctctcgtcgacctccctccggcctgcactccccagttccgggccctctggcacccaggcagctcctgtttggaatgggagctgcctaggtgggagccaccactcctgcctccccacaccactcacaccagtaataaagcacccaaatac

SEQ ID NO: 554981 - DNA, 321 bp, Homo sapiens
atggacttgatcaatcatttcggccttcccttgtggagcctgtccaggagaatggatgtggactgtgttctgatggaggaaaataaattgttcttggtcaggtttttgaaaataacagtccttgtctctcaggtgggcacatgcttcgctgattgatggaatatctagaagccttggcttaaatatagaacaaatgatattgagctacttaatcttactatcactgtaccaggttccataaagatgatgccttggtgagctgaggctgctgtaacaaacaaaggcacgtttcttataaacaatagaaactggttttcacag

SEQ ID NO: 554982 - DNA, 459 bp, Homo sapiens
aaaaaaactctttccctcggagacgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccattgcccgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 554983 - DNA, 1266 bp, Homo sapiens
  misc_feature (604)..(604): n is a, c, g, or t
  misc_feature (1192)..(1192): n is a, c, g, or t
gggtaatctaggctggcagtggtgtgatccggcaccaaatcgtggccgcggtgcggtgcggagatctccgatgagtgccctggtactatgaacacagtctgagctggaggtggtggggcgcaggacctcgggtggaatggcggtgccagcttctgggggccgatgacgctggaccgcggctccacagagtacgcgtttgatctgatatagccccacgcggggcatggactgtgatcacgatacgcactgaatgtccatggtcgatcgccgagtgtgtcttccctacggttgcggttcaggtgtacatggagcggttgatgtggagggctccttccagatccatatgcagttgccccttgcaactttccatacaccgcggaactgcaagcgtgcgaccaaggggaggcgcattcaaggtactgcgcttgttgctagaaggcttggtgacactggagttagcctacatgaggggggccgcaccaaacggcacgggcagtaacacgacgcattgctcaagcaccagcctcaagatcaacgggttctaaatacacttgggccggatgtgcacgctaaagcgcttgacaagtattgaggtacgcgagantcgcccgagagttcatctttcttcgaacaccgtcgtaccgaggctcgaagccattcgcctcaagacacttcaattggcccgagtaggaatctcgcgaaagtagctcgattcaatcttggcgaaagtcccacccgacacttagtcaactctagttgttccaattgtaggccaattccccgggcacggggggttaaatccagaggatctaggcaaggtcgcgacgataagtaggtacagccacgtcaattgtgtggggcggcatcaaggaaccgcggcttgggtgaaccctcacggaaggaaaggtcgccttggcgcgaacactttgcgtagggatgcttggtcccccggaaaatgtgggcccatttgggcacccccaggcgtactatggtacagaatcccaaggacaatgcgaatttgaggcccacggcgcacctttgctggaaggctttggccgcggcgttatcagagcaccgccaatattgtgacactttcagagggggagaagaccacacaccccttcagagaaggcgtggtggttcaaacaccccctatcgaattgaagacagagggactaggggacatcgcgcnatttctagtaattggggttccaagcacacctcgctggaacttgatgcacggggcacgagagacaccgcacaggc

SEQ ID NO: 554984 - DNA, 113 bp, Homo sapiens
ttggcctttctgctgtatgtctcccagtgctggggtctctccttggcatgagttcagctgggggtagccagaaactgaccttcagaggtctgcagttctccttcacataccgg

SEQ ID NO: 554985 - DNA, 503 bp, Homo sapiens
accaacaagtctcctagcattatcttatctttgttttttattactgtacgtttactggaaattattctggaggttgctgtctcagatcagcggactttttgggtcgtaggaacctggtatgagtcgtcggtgggttgcgtatcgaaggggtcttgttgtccggagtcggttagtaattatccttcccattcgttgtgggacgcgtcggtttaatcgtttagttctaggtattcggatccaagcaacaacctgtcggcgagttcgattcatgcgcttccttgtaattcgatatactcagaaagttcttattcggaggataacgtttctaaggcttcctataacggtatttcggtcgagccgtaaggctcattttataccagggccccttcggataataactttcgggctcgtgatcgttatacggtagatacggcgattcggtctaaggaaatagaggcagcgtagggtgactggtctattcgcgtacacttggaacgggctgg

SEQ ID NO: 554986 - DNA, 669 bp, Homo sapiens
aaaaaaactctttccctcggagacgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccattgcccgccggctcaacaagcacgaggagaacctgaagaccaagaagcagcagcggaaggagcggctgtacccgctgcggaagtacgcggtcaaggcctgaggggcgcattgtcaataaagcacagctggctgagtaacacttattcatctccttcatgtgcccctttcgctcaaactacttaaccttctattcaaacaacatgccgcccgcttgctcaaatcgactttaaaccttggccacctttttactttggtccccatccgagcttaatttcccaagttcccctatattggattgtacttatttttagtgcctcctctttctcaccctcttactgctcccg

SEQ ID NO: 554987 - DNA, 407 bp, Homo sapiens
aaaaaaactctttccctcggagacgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccattgcccgccggctcaacaagcacgagagaccttagccacgacgcagcacggaggagcgctttccccttccggagtcgcggtca

SEQ ID NO: 554988 - DNA, 903 bp, Homo sapiens
gatactgtgacgctcatactgcacaccagtgctaccagatttgtaactatcagatttaaatgaaagaagagaagggaagaggctgagttgcgtggcagtgtcataacgaatagtcttggccgggcggtggtggcttcacgctttgtagatccacgaggacgactttagggagagccgaggcggggctggatcagcgaggtcaaagagatcggagatcatcctgcgctaacactagtgaaaccccggtctctaaataaacaatacaagaagatcacattgaagcctgggccgtgagtggcagggacgaccctgtagtacccatactactcagggcagcgtctgtaggcacagcagtaagtggctgtgacagcccgaggcaggcggatgccttgaaacgtgagccgaaattggcgcccactgctactccttcgactgtgcgccaccacgagcgagcattccgtctcaaccatagaacaggagcgaaccctggaaaagcttcaagaacgcatgatcgtcgggtgctgaaagagaaggggtgttggaagataccggcatatgtggctctctgttcgtcgggtcttaaaccgagattattcgtgtccgagcgtggaagtacattgcagggatccctacaggaagaggcggtcttaagattgcacgaaagaactcgacgtgtaatcgcgtagggcatgattaaatcgcgcggtgaaaaaagtttccccggtttcaccaaggaacggacaggaaccaagaacccgaaccaaccttgtcctgggggagtggggagaattctccacccattccaagaacggaactggaaaggacttggagcccaggccaagaggccgggggcagggcaagactgaacggacgggacgaagggacagcggattttgtcccgcc

SEQ ID NO: 554989 - DNA, 692 bp, Homo sapiens
aaaaaaactctttccctcggagacgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcacctcgcctcaggtaactctactaggtcatgacttccatgctccccgaccctctgcccacgaacgacactcgccacgcgccgtcgccttaccacgcccgccccgaacctgacgaccaccacccccatcgtaacgagcctccgctcccgctcccgcaccccgcccagtccctccctcctcgcaccgtccccgtcccattgttctctccccctcctcccctacccttactcatctccctactctcccgttcccctcactctacccccgccacccttttctctaccccctacctacctctcctctcttccctcctcccttgccccaccctcacttctcggccatgcccctgcccccctccactcgctactccctctccccacccttccgcctgcccctacacctctcccttcctccacctactacgtcctccctccccccctccccctc

SEQ ID NO: 554990 - DNA, 106 bp, Homo sapiens
ccttgttggtagtttctgaggatccccgttcgccaccgcgacagatcaccgagcgtatctcctgtgaccttcggctccgtcgggccgctggggtccgatgctcgaa

SEQ ID NO: 554991 - DNA, 301 bp, Homo sapiens
aaaaaaactctttccctcggagacgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagagagggaaccttaggggattttatcaaggggcaggaggtgtcaagccccttgg

SEQ ID NO: 554992 - DNA, 593 bp, Homo sapiens
tgtctgctaaacaacatccattctgcaggatccattactccatgggtcaaggagtaattttgactttcaagtattatttaaggaatacattttgtaaggctgtggctgccatagtggttgttctgtacaaagtaacttgaaaaccttctggaaaggattcatcattctagatgccattaaggacatttgtgattcatgggagaaggtcaaaatatcaacattaacaggagttcagaagacattgacctcaaccctgatggatgatcttgaggggttcaagacttcagtggacgaagtaactgcagatgtggtggaaatagcaagataactagacttagaagtggaacctgcatatgtgactgaattgctgcaatctcatgataaaacgtgaacaaatgaggagttgcttctaatataagagccacaaaagtgggttctttgggattgaaactacttctgggggaagatccttgtgacctttgttgaaatgaacacaaaaggccttagaatattacataaacttaatttggtaaaacagcagccgaagtttgggaaggaatggattccattttttaaagaaaggttccactgtg

SEQ ID NO: 554993 - DNA, 960 bp, Homo sapiens
tgctaacatgagacactctggacgattactggggctaccccgtgagttatccgccatacgggtgtgggacgcccgtgggtcacaattcacccggtcaccctttacgcgtgaaccccccaattgcggggggccgctcccctggggctcccccccccaatgaaggcgctgggcaacaacttgtgaggggaccgcaaatttccgcaaagtggtttcaggggaggctgttataccagcaatattccctcaccgctttttattggcaccctgctgttgcccacgcaaacaccggaggggcttcgcaacctccacgcctgcctctgtggcacaccccggcactggctcctcctctttgtcaacgtgcccccattggcggggccttttgccccgggcccctgatgggtgttcccccgtcggcagtgggtctgtgaaccacttggtgccacctttctcctgtggccttggaccagcccgcgtccaagagccggctctaattgtgcggcggaagtttttctccacaacttggtgtgtatgaatccccccgcttgctcccccgggtccgccccccaccactctggggtttctcccctcttgcggtagcctctctcccgtggtagcaccctgcgacacggtgaccccggcagccctgccgattggcgcgtgcagccacccgtggtttggccacttcggcgcccatctcctttcgcgcagacacttctgcacgggagtggttgcgagcaaccccctcgggtaatcaaggcggtggggtcgcccccagacgcctttgcccccgccggccgattcctccccgggtgttactcgttcggcgcaacaggcacccgttccttgtggggcgtgggggcaggcccctcggctgctcgcaggcggggtttcctttgccctccccccccccttaagcccctccccccccggcccacataacaaaaaaaacaaacataaaaa

SEQ ID NO: 554994 - DNA, 472 bp, Homo sapiens
atgcagacaggtctcacccagcatagtggctgggtgagagctgggactcaaatccgagctgcgtgcccaggtccccagctgccccactcgtgggcagcgaattccacacccacatgcaacgctcccacaaggtcagccaaacagagcactccgcagcctggagatggcaggccagggtgtggcactgcaccaggcaggaggtgcgggcaggcagctggcaggaggtggggcaggcacctcatctcatcaggcctgtactggcagaggcagagcatcgacctgaccctggtgctgggctgccggctccctcctgctggctcgcagatggcatcacccaggtggtaacgcaaaggctcttgggtgtgtgagagggggagatgttgtctgtgctagagtttgcagagatggcagcctctgctgtgatcttgtgcttctccccagatcctgaggaggatgaaggggctggcctgga

SEQ ID NO: 554995 - DNA, 889 bp, Homo sapiens
tagcttccttagggctttgtgcccctcctggcaagcgtccaagggccgttgtggccgaccaggagtatatgtgaggtgtccaaaccgtagcgcatgtagattaaccctatctcgccccgatcccgttgccctttttccgtgagggcccccggagggccactctaacgggggacttgtacccccttgggcactctggggggggccttggtcccagcacgagcgcactctttgatctgagattggaagccactgagcctgagggtccacgatttccccgggttcacccagagggaaggggctacagcccccagctgtgtgcagggaggacacatcagccccctaccgcgcccacacatgcctaaacttgtttcaaaccttggggttttctatatatttcagctgggaaagcttacctttaaccctttgcgaaaaatagatacgtgattagcctccactaaccttgctgactattaagccgtatattccccctgtcgctggccatatgtcattgcgtacccccatacccccccgaagtagcccgaggcccgtttggacatcaccatatctaagtgttttagtaactatttctggcgtgagtccaccgatcatgtagatagagtccattattgtttgtggagtttttcagctataggggaggggaactattaaaataccctttgtttctattccataggtaataaaattagttgtccctgggtttgggaaacttaaagccccttacagccctggggaagggttttctgtcttatggagatgagtcttagcatttaagttataccgttgtctgcctttaaatagtagcctgctaccatgacttctttgggtagacccatttcataaggaattaaataccagatatgagtaatga

SEQ ID NO: 554996 - DNA, 472 bp, Homo sapiens
gatcttgccagtacgtttaatgaaaataactcaggatacccaaaaatgcattatgtaaattaaccagtttctcagtttctgtagaatatctcctttagaaaacatggcattttgtccatgtctgacctgttctaatggggagaaattcctcctaaaccttggaaggtagaaaggaacatggcagaggatagttttaaggacgtcacagtttgacttagcccatatgatggaatgtttgcctcatccgcaaacatcctttcccctcatgtaatcgactatttcccacattcatggaaaatttgacatttgtcttaagtggttcccttgtgagaatatgaaagcatttctacttttgaaaaaataagaaaataaccacagcagaaatatgacaagatttcacatttaagatctcaaaacaccatttcactctatataggaaaacatcgttttgtacactttaaatacatacact

SEQ ID NO: 554997 - DNA, 313 bp, Homo sapiens
tctccgtcgtttacaaacttcattgatttttgactgcgaggggtgtgtggactggagaagcccttgaggtgaggtgttcccagagttcagagcggtcctcagttggtcctcggggccccaagggatggatgccaggtcgtgacttggaatggcctggcggcccgagcaggcgtggccctacctgggtgaacaggtccagggccttgtgcaagttggcgtgcatgcccgtggggggctcgttggtgatcttgatggcgttctccagaatgccctgggggatgatgtgggtcgccagactgagtggcgggtaccg

SEQ ID NO: 554998 - DNA, 370 bp, Homo sapiens
tggggtttccacccatgttggccaggctggtctcgaactcctgacctcaggtgatccgcctgccttggcctcccaaaagtgctgggattacaggcgtgagccacagcgcctggcctgtagtgccttctttatgatgggttcccagtgctggaagtgccagaagatgggatgctacaacacggctcaatgaatgaatgactattctggtattcaaagattcaagtgtacatccttttacccaggtcagttttaagggcaaagactattttattatctcgtgtcatttatttaactatggtcatgaccataatgagctaaagattaaactatattcatgaggattgaaagactcgggttccctgggcctagt

SEQ ID NO: 554999 - DNA, 132 bp, Homo sapiens
gataggtactggaggatctctacagtcgaccattgctccatcttaacgatatttggagtgtcagcactggtgctcactgtgtctggtgtgaactagtacagttgaggcatgcacctgcagtggtgaatacac

SEQ ID NO: 555000 - DNA, 470 bp, Homo sapiens
ataaggcgcgtctgcgtcgaggcgggcggatcacaaggtcgggaaatggagatcatcctggctaacacagtgaaacctcgtctctactgaaaatacagaaaaaagtagccgggcgtggtggcgggccgctgtagtcccagctactcgggaggctgaggcaggagaatggtgtgaacccaggaggcagaggttgcagtgagccgagatcatgccacggcactccagcctgggcaacagagccagactccgtctcaagaaaaaaaaaaattagccaggtgtgggagcgggtgcctgtaatcccagctacttgggaggctgaggcaggagaattgcttgaacccgggagacagaggttgcagtgagctgagatcgcaccattgcactccagcctgggccacagagtgagactccatctcaaacaaaaaaggaaggaaagaaagtacccagggggcacgcaaaaggcgcctaag

SEQ ID NO: 555001 - DNA, 573 bp, Homo sapiens
  misc_feature (4)..(4): n is a, c, g, or t
cggnccgatctcggttcacttcaacctctgcctcctgggttcaagcaattctcccgcctcagccttccgagtagctgggattacaggcgcgtacaaccacgcccagctaattttgtatttttagtagagatgaggtttcgaggtttcaccatgttgcccaggctggttttgaactcctgggctcaagcgatctgccctcctcagcctcccaaaacggtcggattataggcgtgaaccaccgcacccagccgcctggaatttttaagcctcaagtttgttccactttgaatgcaagaagccacctcatagatggagtctcgctctgtcacccagatgggagtacaatggtgcaatctcagctcactgcaacctccgactcccaggttcaagcgattctcctgcctcagcctcccaagtttaagggcccttgggcgggcgacattgtatacccttggggtaatagattgggccaaacctttggcccccaaagttggccaccccaaagggccgttaacaaatttttattatataggttaaattttaatattttaaaaggggtttaacggaaaggaa

SEQ ID NO: 555002 - DNA, 240 bp, Homo sapiens
ctctagaggatctccgtactgtggtgtaccgtagcaaataaataagtaataggtggaaacgatgagtgcgttttaaatcggggtagattttaaataggatggggagggagatacttaatgagacgatagccttgagtcagtccccaaaaaccactggtgccaggacctcagggcctggaatgagggtaaagtgagttaggcactctcctgggaggcagacacatgtacagggaatagaat

SEQ ID NO: 555003 - DNA, 604 bp, Homo sapiens
ttgtggatgtatgtatgaggtggtagtgtttctgagactgattctcactctgtcgcccaggctggagtgcagtggcgtgatcctgggctcactgcagcctccaccttccaggttcaagcgattctcctgtctcagcctctcaagtggctggggactacaggtttgcagcaccatgcccagctgatttttgtatttttagtagagacagggttttgacatgttagccaggctggttgaactcctgacctcaggtgatccacctgcctcggcctcccagggtagggattacaggcgtgagccactgtgcccagcctatacacagcactttcaaccaccatctgtaaagagatacaaagtacctcctgcttcaagaaagggttcctatgaatctataatccatccactaaaagcagtgaagttccattaaatatcggggctgagatcctaatttccatgtggagacaaggagacttagtcccctccataaagctgggtgtttcccttgtgtctggggtaaattcgatacaaactgcttcttttcgactcctgaatccattaattacacttttttttatcacattcacacacttccgcgtgttgctga

SEQ ID NO: 555004 - DNA, 306 bp, Homo sapiens
caggcagatcacaaggttaggagttcaagaccagcctgaccaacatagagaaaccctatctctattaaaaataaaaaaactagccaggtgtggtggtgcgtgcctgcaatcccagctactcaggaggctaaggcaagagaattgcttgatcctgggaggcggaggttgtggggagccgagatctcgccactgtactccagcctgggcaacggagtgagactctgtctcaaaaaaaaagaacaatcatggggggaaaggacactctcttcaatactgatctataggagtggtggggtaccgagctcg

SEQ ID NO: 555005 - DNA, 785 bp, Homo sapiens
ggactcagcgggcgtgaggtccggctgagcgagcgagcctgggcgagttaattgtggctgtggttgacggtggagacaccccccggagggaggcggagggaagggaggcgaggctgcactgattcttccggctcccactccccagcgccccggaccgtgcagttctctgcggaacaggccatggagctccgaagtccggcgggtcccgacggcgttcctgtccggcggtcgcgacctctgcggtttcggctgcgcagctggaggccctgcggaggatggtgcagagcgcgagaaggatatctgacggcaatcgcgcgactgtgcaagagtgaattcaatgtgtacagtcaggaagtcattaatgtccttggggaaattgaatttatgcttgagaatcttcctgaatggttactggtaaaccagttaagaagaacgggctcaacatgcttggaagagggctatattcagccacagcctctgggagtggtgctgataatcggagcttggaattaacccttcgttctcaccattcaggcactgaataggagccatcgctgcaggaaatgctgtgattataagccttctgaactgaatgaaaatacaggcaagaacttgggcaaagcttctcctcagtatttagaccaggatctctatattgttattaatggtggtgttgaggaaaaacacggagcttcctgaaggcagggatttgaccacattttctatacgggaaaacattgcgggttggaaaattgtcactggaaggctgttgcaaggcatttgac

SEQ ID NO: 555006 - DNA, 314 bp, Homo sapiens
gaaaaagtcaaatgcggctaagaacctcatagaaacctccagagaacacagtatgtattagtctctgtgtatatactcatattatagaggctccaacacctgataagtctcagggtatagtaaaaactataaaccttcaagtggtctctggaagattgtatagaaaaagattgtatcacttatgatcagactagtgtcagtatataaaatacaggaaatcacccaatgagccacaggctggactgatatctgcctgacctatggcttcagttacctaactgacaacatctgtacagaggcagatctcataacag

SEQ ID NO: 555007 - DNA, 166 bp, Homo sapiens
taaaaaaacacacccaaaagagaagaaaaaattcaacaagagagagagagagggggggccgggggggggggggggaaacaaaaaaaacggcggacagccccgagagaggagccttgaaaacgcggggccgcgcgggaaaaataacaaaagaggggggggcgtatct

SEQ ID NO: 555008 - DNA, 485 bp, Homo sapiens
  misc_feature (378)..(379): n is a, c, g, or t
  misc_feature (424)..(424): n is a, c, g, or t
ggctctcacacacacgtgcgtgattggttagttcgcctgtgcatatacccacctatgcccacagggaggtgtttgggggacacatgtcagagacgggcaccaacagctggcagctgacttggcatgggagtttctgacagtggtggagtcccacaataatggcttttagcttaccacatcctgtgcctcagtttacccctcttgtataatagagagagcttggagagactgaggacacaggagacacaggtggttgagtgttctgagatctgcagactgggaggcattatgcctgtaaaatgtaaagttaacaaaggcagaaactggtggtgggaagtggaggaggtccttaaaaagaaagatgggactgggcctggnngtcacgcctgtaatcccagcgcttggggaggctgagacagaaggntcacttgagcccagaaatttgagttcaccctcagcaacataatgagaaccctgtctctgca

SEQ ID NO: 555009 - DNA, 160 bp, Homo sapiens
ttagccccccgggacgccccaaacagtgcatgattcggctgctgcagcggagccacatggcttcttctgtgggatataaatttaaaatatgaaacaatgaatacgtcaagtaaaagggtttaaagaagaaaaataatcgagcttcctgtaatcccagata

SEQ ID NO: 555010 - DNA, 365 bp, Homo sapiens
tacctgggtcgttgtgttgtggtactctgggtactactgtcggtagacaatgtctacctacgactaacggacactaccactggacgctacgacgctccaacgacgacggtctgggactacgacgacataccggttactaatcccttacgactcacgtgacacttaacttactacctgtgacggtgtaagacagacgacaaacggaccaaagacaaagccctcaggaatgcccacaggaatgcccacatcaaaggtctcagtagacagcatcaaataaaaagcaaatgcagcagtgaaattgataactggataagcctgtggaatttgaaattagtaaatcattgacaaagctgcttcattagaat

SEQ ID NO: 555011 - DNA, 140 bp, Homo sapiens
tttgagttgtaatgtcggtcggagtacgcgtatcgatgggcagtgaggggcgaatatgatctagctttatatcggatatagtagcggtagtacaagtactctagaatatagtagatggcaattaaggtgtatcgatggcg

SEQ ID NO: 555012 - DNA, 411 bp, Homo sapiens
  misc_feature (273)..(273): n is a, c, g, or t
caaggaagaatgatccggccccaaataagaaaccctgggctggtcagcaacaacccctttgttttgagaagagaggaggaaagaataaaagaagtggggtgaagttttggtttggtagaggaaacttgaagacattttccctggaaaggaagagaggaagaggagggagatgtctgtaaggacgagcaaaccgggtgacagctgatttcctcatattgaagtaatgaaaactgcaggagtggaatgacagaacctttggtcatacttgagggngtgaagctcaaatgaggaggaaggaaaggatccaggggttagaaagagcccctgtgtttcttgacatggaagtggcctaagaccttaatgagtcctagttataataaattcctaataaaaacccagtttatccctgca

SEQ ID NO: 555013 - DNA, 873 bp, Homo sapiens
tctcgcaccggaacaacaaagcaaggaagaggagtccgagcctcgggggctctaccaacgggcgggcgggagtcctgagactgggagcgcgccgttcatcctcatccttgtcctccagcttctctttcgcatcggaacgcaaggcggaagcaggcgctggcgcaggtatcctcagcacagggttccctcttcccaacggatggtgatctagcggggggggagaaaagggttaagttttaaaaaaaccacgccaaaattgcaattgcaggaccaggtaggtggtcggcgtggggaccattccttatgttaacaagtgtggtacgtccgggtgctttaaagacacaaggggatgggtctattttacaaccttgtaggggaaggatggggcttggggggagcggagcggcaacatgttggtaatttgaataagaaggggctgatgtggtgggaacaactggtttttgatggaaagggcataagggaaaccgtatagaagttaccgaggctaacgaagtgggggtccctcaggagaaacaaatttattggtgaccgggaggcaaccagtgtgaaggaacgaacgctaaaagtttgggggccagaaggccttagaccagggtggttcgtgaagaaactagggtctgcggggtaaatatttacagattttaaagggttggtcaagcgttcgtggcaggtgttgtaactttgcctatttgggaaatccgtgtggcagaattccacaggaaagtagaccttctatgcagtttaggaactggatacacacggggggtgtatggataaaattcgtagagtacttcaagttttcagaggagttccataacgggccagtaagggtgtactggggaacataccatg

SEQ ID NO: 555014 - DNA, 558 bp, Homo sapiens
  misc_feature (138)..(138): n is a, c, g, or t
  misc_feature (385)..(385): n is a, c, g, or t
gggctctccagttaccgctttgtgcagaacgtgactcgggccctgcagctggcagcagagtttgcagcaaaggccgcgtcggagcagcaggcaaacacgtctggaggagacagccccaaggtttgagcccacctggcnccgtggtgcacctggtgacccaggatcgggccataatgacccggcgcgggcggcacaaacaacccagggcctgcgggggtgtgctcaaggtggtttcagcccacagggaaaggaaccccagctggcggtaaaaccgtcggcccttttttgtttttgggcccaaataatccccgttggtcatttgttggtgaaaggggtggggggtcaccaagggcccctccccccacgctccttgttaatttgccgngggaagcccggggtcaaagccttcaaacagcccttgagcaggagggggttcccctaaaaactttgttttagttcatttttgtccaaaaacggttttcaaattgatttttggaaaaggggagaaatttcaaaattaaattaaaaaaaaaccgaagttttccttcccatggggca

SEQ ID NO: 555015 - DNA, 262 bp, Homo sapiens
cacgaggccaagaaacagattttgctgtgacatttatttagcagctagtaacttcacttatttcagggtctccaattgacaaacatggcactgtttttcctgtactctacccatctattgctggacttctgttgtccaagttggcaaacactgggtgtgactgcgctgcatgaacgcatgcccgttcacactgctgacaataggcttacatgtgtcagattacaaatcattactcaatttgcattcgaataaactgttttac

SEQ ID NO: 555016 - DNA, 102 bp, Homo sapiens
aagggctacctcccagaatctctacaccacctgctagtctctatggagtcagggactggtgacttcgggtacctggtgctgctgtcccacgttggcgagcgc

SEQ ID NO: 555017 - DNA, 291 bp, Homo sapiens
  misc_feature (221)..(221): n is a, c, g, or t
  misc_feature (250)..(250): n is a, c, g, or t
ctttactcctggcattcagctttctggctggctgcgcctccaagccggcttactacatttcgcccgcaccggttcacattcccaagaccgccacctattggctcgataccttcgacgttgacgtggtgggcaagaacccacgcttcctgcctgatgacaaagtccgcgagcaactgggtgtcgacctggtcaatcgcctgatcacggccaagcgctacgcnaccagcaaggaaagcgccgactatctgtnggatgtgaaggtcgtctacgcccgtcatttccaacaaatag

SEQ ID NO: 555018 - DNA, 692 bp, Homo sapiens
agcgggtctccctccccagtgctatgccgcgagcggacgcgtcttgacctctgtttcgtcttggtcttattttaccctccactcttcgcctttcctgtttcttttgccaacggttttaggttttcgtccctgatcctcgccacattcgagagaattttacacttctgtagcgatggatgtcctcagtgtcgtgggtctcagcagagggtcgaaaggcgggaggcggggaggatagtacgatggaatgtaacagtgggaacacttccgataaagagtaagtgctcacgtaatcaaccaatgtccactgactgagcagttctggtaaggaagggtcattatcgccaccatcgaaactaagactacaccaggaaggtggctcctggctcagtgacatgctgagtgagctcggcctcgaaagcagtccgtgcattgctctgtagatctcgagaacgcacccacaggggcgtacttgcggtacttaacacgcacgtgctggaacaggctcctgtattgggcaaccgcgctggaatggtaaactgtctactgtcatagagagctcttgcccgcgtccacagacactacgacttacagcggcttccttgattaaaaccaggacaggattggcaatcgggacatgcaccgcacctaagctgcccgcggataggaccgtagagcccaattattccaaccag

SEQ ID NO: 555019 - DNA, 1214 bp, Homo sapiens
agcggggttaccgggaagtcgctgaagacagagcgatggtagttctggaggcctcgctccgtgtggccgaccctgaggccacagtgcctccgcggtagaccggacttgggtgactgggctcctgggctccctgaggtgaagagcatctgggggctgacgggatggaacgggtctaagactgtccaacaatcagcaccatgcagtgtgacgcttccgtgtgccagacgctgcatgccatgccccttgaaagcttgcgacacgagctttcaatgatccttggaccctgttgtcatccagtcccaggaatctcagcagagctccagttacattaacctacaagcgccaagtgcgaaatccaaggacgagaacccacggcacggaacgaagaaacctaagcgtcaagcgagaagtgaagcccagtgagaatctggagaaccgtccatctgcccaagggcattggctggtttcattcatcgaccaggaactttcaagttccctccacaccgccaggccccagggaactggaacgtggttccgaaccaagaaaacgatggctcaaacccaagccttatcaaccattcctttggaattttggcgcggaaactgggcccacatttccttggaacttggtggccgcggcacgccccaaattggctacaagtaaacgccccccttcccaggcccctgtaaactgcaaccttggaccacgtggtccaggcattggaggtgtaggaaaccccccattctatcatacgcggacccccgctttcaacgttggttccgcgctcactcccacaggcaaggctaatgaaattagcatgggagaagttcaaggcccgccaagaacctgtcccttggcttgcacgcgtggcacaatgattgcgcccagccaactccacttttaacccttccccttaatatacgaaacgaaaacagccaaagtccccttggaggcaacgcaagcgcgtccacgagacacatgccaaagcgtgggtaccacaccctttggagtccagacacactgcgaaggacttgcgatttcccatcggaacgcaccgttaaatcacatacaccatctggcccatgtggccatacacgtgcgggccacgaacttccctttaaccgacatcgtcccaacgccgctcttggcacacgtttggagcccgtcaacttgacacccctggcgctgggaaaactccagggggttatcagcc

SEQ ID NO: 555020 - DNA, 796 bp, Homo sapiens
  misc_feature (550)..(550): n is a, c, g, or t
ctgtctcttacttttaaccaggtgacatactttgacctgctccgtgacacgagtgcggtgctatgacacagactaagatcgagatagaccctagtggagcatttaacttctagttgaatgcacaactgagtacctaagcaatagcccaccaggttacttaatagctacgcaaatcgctgcaattaacacagatttcgagcttggcggccagacctcgtgagtcatgacacccaacgctcctgagctagtacgactgcttaacagacttcagccaagtctaatacgcggaagctagcgtactacgtgcaatttcgatgccaactaagcttagacgcacacggaaagcatagttgacccgtatgggactaacgagacgcaagtctctattgctcagagttccacgtatcaagcagatacggggttctacgagccgacgcagtgttcgcgatcacgagacgatcaccgactggatgacagacccgccttattacagatggattgcggtatgaggattcatagcggaccttaccaaggtccattacggtgcacntctgatgctctcaagaactcagcgagtgaatctcagggatccgtgtcttcgtagtgctaccttcgacaagttccgtcgcgctgatacgtaaagggggcaatgagcaaactagaggcgctactttcagcaatagtcgtccttctcccctggtaagactgcatagtcagtcatcgaagcgtttagataattaataccgcacattccatgcgcaagaagcagggcttgtgttagaaacaaacatgaaaa

SEQ ID NO: 555021 - DNA, 271 bp, Homo sapiens
  misc_feature (38)..(38): n is a, c, g, or t
  misc_feature (60)..(60): n is a, c, g, or t
  misc_feature (154)..(154): n is a, c, g, or t
ttactaagccctaaaaatcctctgttctgcttgtttanaccctccccaccaaccactganctttttgtcttttccagagtgtcacagagttagaatcatacagtatgtagccttttcagcttagcttctttcacttagtaatatacatttaagntccttctacgtctttttatggcttgataactcattttattttagcattcagcaatgtttcattttctggatgcactacagtttatttaggacttcttaaaataggtcaaaagcattt

SEQ ID NO: 555022 - DNA, 625 bp, Homo sapiens
tgctgggcgactctagaggacccggctcatttcaggttttcaggtatgtcctccaatacctgtttattgaaagtttttaacatgaagggatgttgaattttaccaaagaccttttctacagctattgagataatcacatggttttggtcttcagttctgtttatgtgagggaattacatttattgatttgcatatgctgaaccaaacttgcatcccagggatgaagccaactctatcatggtggataagctttttgatgtgctgctggatttggtttgccagtattttattaaggatattcacatcaatgttcatcaaggatattggcctgaagttttctttttttgttgtatctcttccaggttttggtatcaggatgatgctggcctcatagaatgagttagagtcctctaaaattgatcacataatcagaaaacactcctcagcaaatgcaaaggaactgaaatcataacaagcagtctctcagaccacagcacaatccaattagaactcaagattaagaaattcactcaaaatcacacaactacatggaaattgaacaacctgatcctgaatggctcctgggtaaataataaaattaaggtagacatcaagacgttctttg

SEQ ID NO: 555023 - DNA, 632 bp, Homo sapiens
cggaggaaaacaaaaaaaaatatatggggtggggggggggaaaaaaaaaaaaaaaattcttccccccccccccctttgttgggggggaggggggggggcccccccccccccccttttataaaaaaaaaaaattattttttggggggggtggttgttgtttttttttttttttttaaaaaaaaaaaacctctccccccgcgcgggggggggtgtgtttttttttttataaaaaaaaaaaggggttttttttttttttgtcgccccccccccaaccttttttttgttttaaaaaaagggaaggggtggagggggggggcggggggggggcaaaaaaaaaatttcccccgaagtatttttctcgcggggggggggggggggagaaaaaaaataattttcgccggggaaaaggctcccccccccccaaattgttgtgtttttttattttccggccccctttataaaaaaaaaaaaaattttttaaaaatttttcccgcgcccgccccaaaggtttcctttccgccttttaaaaaacaaggggtccaattcccacccccctgttgggccaaatctgtggttttttgctcttccccaaggatccctttttttttttttttaacctaaccacttttttt

SEQ ID NO: 555024 - DNA, 144 bp, Homo sapiens
gctctgaggatcccaaccaaaaaagaggctgcactgcaaggttgaatcctaagccaaaagaacaaagctggatggcatcacacttacctgacttcaaactatactacaatggccacatgtaaccaaaacagcatggtactggta

SEQ ID NO: 555025 - DNA, 131 bp, Homo sapiens
ctggccgcatcgtgggatcactggaacggtgaaggtgacagcagcggttggagcgagcatcccccaaagttcacaatgtggccgaggactttgattggccatttgaacagtctacaagtttaacgttattt

SEQ ID NO: 555026 - DNA, 865 bp, Homo sapiens
cttgtgtcgtgtagcgccacccaggtagaaaatcaacttaaatactatctctcctctatcaggacgtattgagaacgagactgttcgtcactacgatcctgcgtaccacccacttcctccagtctgtagtgaaataattagagaaggaacaaggattgggcgaagcagaagaccttcacctattgatcacagacattcagcaattccacagtgaagatgaatcgtctcttcacctcagagatggagcagtctctcacatgggagcaagatccggagaacaaaactcaggctccttgtgtaaaccgtctcacagcgccactctgccgaagttcccaattccaactactcgaagcgagtcgacgaagccccacattctcacgcaagagctcccagtactgtgcgagatgggcatgctgctgagaacaagtgatgtcattagtacaacgaacggacatatatgacacgaattgctgatttgacatagcagaattcagctatcaaggcacatatgactaatcttattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgtggtttgaatctttctccaccaaatgtcacctgttcagttacctctcagagcatggacttgaaggagcaagaggacaactcgaggtatctattccaggcagcaggaagccccagaaaaggctccaaattgtatgtcctggtcttctccg

SEQ ID NO: 555027 - DNA, 384 bp, Homo sapiens
gggaatttttaaggaaaaacttttttcccccggaaacattttttccccttttttcccccagtttaaattttccccccccaaaagggaaaaaaaattgggtttcccccccgggggggcccctttttaaaaattgggttccccccgggcccaaaattttcgcccaaaagggcccctttttttttttttcttaaccttagggggggggggaaaaaaccccaattggtttttccctttttttttccggtttttttttcccccccggggttttaaaaagaaaaaaaccctttgtttttggcaaaaaattttttttttttttttccccccccttttttttttaaaaatttcccttttttttttttttaaaaaaatttcccccccccccca

SEQ ID NO: 555028 - DNA, 179 bp, Homo sapiens
  misc_feature (25)..(25): n is a, c, g, or t
  misc_feature (27)..(28): n is a, c, g, or t
  misc_feature (37)..(37): n is a, c, g, or t
  misc_feature (98)..(98): n is a, c, g, or t
ctggtctacatatcaacagtcattngnncactctcgntttctccccaacacattttttaaatctttatatgcccaggctgtgaattttccaaatcttnacattctgcttctcttttaattataaattttatatcatagcagcacaaacaaagacaggctccttcagcagcttcacagaa

SEQ ID NO: 555029 - DNA, 386 bp, Homo sapiens
ctttctacgtctcatcactggcaacaactataatgtgatatgaaaatatctgtgatttctattggcaacaatatcataggtgctgtgattttctgtctgctttcataatcaaagaacatgccaaattttaactagtgaaaattaaaatataacatttgtttaccatctaaagtcaagactccctgaattctatcctcagacctctggagggaggtgtctatgacttcacattaagaattcctagcaaaaaaaaaaagaattcctagcttaaagtcaaaaatctctctcggtaaatgtcacattgtacttgaaaatatgtgggttattttcaaatatcttttgatattgatttctaacataattccacagtgatgagacgtagaagg

SEQ ID NO: 555030 - DNA, 229 bp, Homo sapiens
ggatagctggttgtccaagatagaatcttagttcaactttaattgccacagaaccctctaaatccccttgtaaatttaactgtttaggtcctaagagggaacagctcttttggacactagggaaaaaaccttgttagagagaggtaaaatatttttacacccatagtagggctataagcagccaccaatttagatagcgttcaagctcaacacccactacctatataat

SEQ ID NO: 555031 - DNA, 124 bp, Homo sapiens
ggtaaagtttaacacatttatttactgtcaaaccgtgttaaactttacactggatattagtgatgggctcattattaacaggtttacacggtttgacagtaaataaatgtgaattttttcaagt

SEQ ID NO: 555032 - DNA, 150 bp, Homo sapiens
tgatatcaaggactcacccctataccttctgcgtaatgaattaactatgaaagtaacattgtcaaggagatgccatagctgaagatctccgtacaccagacgagctacctaagaacagctagcagagcacacccgtctatgtcgcagaat

SEQ ID NO: 555033 - DNA, 156 bp, Homo sapiens
gagcaggaggcgccatcatgggagtagacataccgccataacaaggaccgaaagttcgcgcaagagcccaagagccaggatatctacctaggctgtttgtcaagttatacaggtttcttggccagaaggacccacctccacaattcaaccaggttg

SEQ ID NO: 555034 - DNA, 376 bp, Homo sapiens
  misc_feature (22)..(22): n is a, c, g, or t
  misc_feature (89)..(89): n is a, c, g, or t
  misc_feature (94)..(94): n is a, c, g, or t
  misc_feature (96)..(96): n is a, c, g, or t
  misc_feature (145)..(145): n is a, c, g, or t
  misc_feature (161)..(161): n is a, c, g, or t
  misc_feature (166)..(166): n is a, c, g, or t
  misc_feature (183)..(183): n is a, c, g, or t
  misc_feature (186)..(187): n is a, c, g, or t
  misc_feature (219)..(219): n is a, c, g, or t
  misc_feature (236)..(236): n is a, c, g, or t
  misc_feature (294)..(294): n is a, c, g, or t
  misc_feature (301)..(301): n is a, c, g, or t
  misc_feature (369)..(369): n is a, c, g, or t
tcattctgaaaatgacacaaancacaaatataaaaagaaattcaaatataatcacactccctaataaaacagcctaattaccaaaagcncacantntaacaagtaaattctaagacttaagccgtgtacggtgtgtgcaaatttncagaaacctataccancacangcaagtatcttactgcnacnnaaaacaatctataccctttcaggatgcgtgtngtaccataatcagaccntaaatttaaacattcatcaagagacctttttaggaggcgtattgtaccaagcagaccnaaatgtnaactttcatcaaggactatgtgatgtcaagcaaggcagtacccatgtatttcattcaaaaaccaatantcccccc

SEQ ID NO: 555035 - DNA, 248 bp, Homo sapiens
gaaacaaagatggctatgtccaggatggaggagtacatcgcggatctgtactcagccgagcctggggaggaggagccggcgtgggtgcagacggataggcagcactgaacatgtgggtgaggcttgtggactggaggtctcacagtggactgggcagagacccactgtttggggaacccccagtgtcaggatctgtccatctgttctctttgatcacgtttccctagagagacaattcaactaactgt

SEQ ID NO: 555036 - DNA, 192 bp, Homo sapiens
catgaaaactagaagataaaatataaaggtatatattacatatggttgcacatattacataaacaatattaaatatcgaaaagtataaatatcataatagcaatatcaaaatatatacttcatataaactcatagcagggtaaataatcaggtcctttaatatatggtgtatcagatgtctcaatcagggca

SEQ ID NO: 555037 - DNA, 423 bp, Homo sapiens
ctgatcgacaaaaatagagcgttgagaaacgtaccttgcacatgaaatgtttctgtgatcaccccattaatgttgaaaaacctgctgcttgccctggctctctctgtaattccaaaactagggacacagagccccaaatggatcattacccaatggacgcctgattctgcaacatgacagatacactatcccatgcttaagtttaaatggctcaatactgcggatgcgcacattgaacccaattgcatagccgtacgaactgtaatggtttaaacttgaacaactgccagtctgtccaaacacagacggtactcatcatattcatcttagcggacattctcattagggcaaatgttatcatatcaaatacacccatctcaatagtcagtttaaacagcatattactcttgatgaacatgtccc

SEQ ID NO: 555038 - DNA, 1162 bp, Homo sapiens
  misc_feature (1162)..(1162): n is a, c, g, or t
ggacatgcgaggctctgggaggcagcgtaaggctagacatgggcagttgagagggcgatgacattgatctcttcgcctgaatgggatataatcagtagtcaaccctagtatgcacttctcgtactagttgcacatgcctcgccgagaaaaaagttagtttaagtaggtgactggacagttaactgggttattgggcagtgcgcagtgcactattgggcgtgtgacgtttgggggagtggtagagccttgcctgagagagtctgggcagagggttggcgtgttagcacatatggattgaatgcagtcgataaatgcatagggtagtatcgtatacattgaagtccatggatagatactgataggaactgaagattggtatgtcgagactaggagggcagatcaggaaaacagttatactctgaaaaatggatggttgaaacgtgcttcgtgcggtcgtcgaagacctagtgttagttctcgagttgactcgtctcgcaatacaccatgagaagaaacatttgatgttcccatccctatgtctgggctgacccttatgctaggaatgtatgctttggaaaaagacatgacttgcatgggtacatttgcaatatcatccccatggatacagaatcatgtatccacaaccggtcacactggacctttatgcttacccaacatggcaatggaaactactaatggggatcattctacggggctatgccattgtggacctaagagggctacggcggtatgaaccgtggaccaactgttacttgaacggggccagtgttaagccgttggatacagaaacacaggtaataacgcagggtcccatggtagcaaggaactcggaagcacatgccatttttcgttgggagccaacggtgttgccgtggttgctaatccgttgcatttgcgggagggaaatcccttttaggttgtggggagtacttacggtaggaaaacctatggtagacgtgggtagttcactggatggaggtggagactcttcgtcggccttctctttggggtgtgcgaggaggtgaagacgaggtgaactaaaccgttggtgataaagtcctaggggccccagatttttcgcggagacaagaatacttatggacagggggaaaaatggtggtggttgtgtggggtatgatgn

SEQ ID NO: 555039 - DNA, 534 bp, Homo sapiens
gaattccgacagattctcactttgtcacccaggctgcagtacagtggcatgaccttggctcactgcaaccgccgccccatggcgtcaagcaatcctcccacctcagcctcctgagcagctgggactacaggtacacaccatccgcccggctattctttgtctttctaggagagacacggtttcaccatgttgcccaggctggtctcaaactcctgaggctcaagcaatctgccttccttggcctcccaaagtgccgggattacaggcatgggccagcacgccctgcagccttatctactttcttaattgtctgttgcagtttcatgtaggttaatctcatctgtctacctacccaatgagagacaggaactaaaactattagagcatctgtatactactacagacttcataggtaattttatacaatactgaaggccaaagtaggatatgtgaagcaacgtcagagatagtttattcgcttaacctaatagggaacttggattggaatccagatgacttcaaaatccggaattc

SEQ ID NO: 555040 - DNA, 1748 bp, Homo sapiens
  misc_feature (296)..(296): n is a, c, g, or t
  misc_feature (663)..(663): n is a, c, g, or t
  misc_feature (1197)..(1197): n is a, c, g, or t
  misc_feature (1381)..(1381): n is a, c, g, or t
cgtgtagccgtgtgttgcctcaaggtggtggtgttgcttactctcgttgtgatgtgttcttcggcgtcgtgtggttggctcccttcttcttactcgtgggatcccatctcattggtggtgttctttttctgtggggtttctcctcgattgtttcattttggggggaggatgattgtttgtgccacagaaggtggccatcttttcgagactccctgctgtctgcccaccggctgctggtgtgatataaattgtttggggggagtcatgcttatcccctcatgcgccgcgcgagcggncgctgtagccacactgatttatgcgacaatcggtgcgcagcgatcaaattattgttcatggtgggtggcacaaaagtgcttgcctcacgtgtgttcttatacacatcattcttctctggcgtgttgatcccctcccttgcgaccgcactaaagtttgtctgccgtttccatagagtaattctctgtgtgtatattctcccatgcagagggttgttgtctcccgtagtgtttgacgctcccccatcagtgtgtgtgtgctccacccactggtggccgacattattttgttgtgtggcgccaacaatttgtggttgaccgcccacagtagtagtgtgtcgccccccgtttttgtgggcgctgctcgcgnaatgatgttgtgcgcggccctcatcaggtgtatgtcctctcctcaagtttattcttactgttggcgtcccaatggggtccccccctcttttatgacagacaccaggtcggtgttacactatatggttggccgccagttttgtggcacaccaccaggggggcctctttgagaacgaccgccatgtttttagggagtagagggggcgacccgcgccctggtagctcgccgtgtgttgccggcgccctgttttgtccctctacgttgttgatcccccggtcgacactctttttatattgagggcgccccggtggtggccccctgtgggtcttgtgggactgtgctttccacgcttgtgctctgtgtgttttcttgtgtctccctcgcgagattggtttgcgcgaaccccacgcgtatgtttgtctatgggccgcacagtggcgccacaccctcatatttgtattgttgtttatatgggggcgcttgttgttgggggctgctccacatgtcacgctctcctcgctatatgttcgtggnttttatacacgtctttgtatatagtaagagagaaatctgtgcgcgccacacatttgtgccacacgtgtgtgtctgtttctcgctgtgtgtggcgccacgcgcgcactctgagaatattgtgtgtgtgtgcctcacgcgcgctgtgccacacagctcgcagaagatctatattcacacacagcgnggtttccacacacacccatatatcacacccccacactgtttggttgtgcccaccgcggggaacacgcggcacacaatattgtgccacctgagaggaatgttttttcctgtttatacccccacgtttgtggaaagtgtttgttatatcccttctggaagaacctcccacttatatgaattgtttataagggagccaccccgcgggctttgaaactgcaacctgaatggttattcacccacggccactgcattcctggctgtcccaagggtggaccccgctcccagacttttgggggaattctcccctcctgcttttttgttactgaatgaaataaaagttgttccataaagacttttatccccccaaa

SEQ ID NO: 555041 - DNA, 415 bp, Homo sapiens
acccctaagcaaaggtattgggaaagtgtccaggttggtgaatgtgtccacttgccaggaaggtgatgcatccaaaattccacggatacagaagttcctgtacctaggaccattggctggactttgtcctatgaacctattcatctgactgtcatactgttcatttgtatcctttagaatatcctttataataaaccagtaatacgaagtgttcctctgagttctgtgagtggttatagcaaattatcagacttgaggaggggtccacgtagccaggtcagaagtataggtaacctggggactcactacttgtgattggcatcagaagtggggagcagtcttgtgggactgaacccttaacctgtagggtctgcactcaccttgggtgtcagaattaaattgaattgttgatccc

SEQ ID NO: 555042 - DNA, 270 bp, Homo sapiens
tttattgatgtgagcctgccgcgcttctttgcgctagagctaaagctacatacaatggctttgtggccacaattctcccgtacatttctgtacctgctttagtagtctatacttctgggagaggaaaaacatacaaaaccaaaccctatatagctgcgaccaccctccatcataaccctttcgcaacattagaatagattgtaaccacaattgagaaaaactctattccgtgagaatgttcatccatccaatacccaattcatctaagga

SEQ ID NO: 555043 - DNA, 169 bp, Homo sapiens
acggagtatcgcagtgtacgaagtcctcgtcgccgacgtgcaccttgatagaagtagtatgtccccgcgaccagctggctcttgaatgacactggccttaaagacagtggaacttcttgtatatctttctcttcaagatgggacctcacttggcccttgccatatgcaa

SEQ ID NO: 555044 - DNA, 317 bp, Homo sapiens
  misc_feature (32)..(32): n is a, c, g, or t
  misc_feature (35)..(35): n is a, c, g, or t
  misc_feature (43)..(43): n is a, c, g, or t
  misc_feature (73)..(73): n is a, c, g, or t
  misc_feature (179)..(179): n is a, c, g, or t
  misc_feature (199)..(199): n is a, c, g, or t
  misc_feature (239)..(239): n is a, c, g, or t
  misc_feature (265)..(265): n is a, c, g, or t
  misc_feature (271)..(271): n is a, c, g, or t
  misc_feature (291)..(291): n is a, c, g, or t
ggggtcggggagacgctgggggccctcaacgnggncctggggncaggcggtccggtgtggatcaaggagacgngcacccgacacctgcgttcccgagactttctggcaccgcaccgagagctgcaggcggtgtcgatgacggccaggttccggagcatttgctccatgccctcgactgnctgcagggccccggtgtggncccggtgctgcgctgcgcgcgacccccgcgggtctgtctntccaactgcagcggtccgccgtcttngagcgngtcctcagcgccgtggccgnctatgccacgtccggctagactgcct

SEQ ID NO: 555045 - DNA, 131 bp, Homo sapiens
cccaggggccccatgggctgagcagggggggtccctgaggtttagcaaaaaaaaaaaactttctccatgaactcccgtttgtggagaaggctgcccttgaatggcctgtgtttttcaacccagaaattgta

SEQ ID NO: 555046 - DNA, 228 bp, Homo sapiens
ggatcgtacatgctgatatgtcttcatgacgagtagagctcgtccaggaccttcaccaaatcatcttggagctgctggccgacttcttaactcttttaaagagtcttcctgagatcctcgctgacttgtacaaactcgaggaatgatattattcaggctagatgatcacatcagggatggtatggtcccatgctttcccaacttcacctggatttaacgaggagattc

SEQ ID NO: 555047 - DNA, 669 bp, Homo sapiens
caggacatgactgggaaaacctgtgcgtggagacagagtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagccatctaccaggagcgtgggctactcacctcagcaggtggctgtaatccactgtaaaggacatcaaaaggaaaacacggctgttgcccgtggtaaccagaaagctgattcagcagctcaagatgcagtgtgactttcagtcacgcctctaaacttgctgcccacagtctcctttccacagccagatctgcctgacaatcccgcatactcaacagaagaagaaaactggcctcagaactcagagccaataaaaatcaggaaggttggtggattcttcctgactctagaatcttcataccccgaactcttgggaaaactttaatcagtcacctacagtctaccacccatttaggaggagcaaagctacctcagctcctccggagccgttttaagatcccccatcttcaaagcctaacagatcaagcagctctccggtgcacaagctgcgcccaggtaattgccaaaaaggtctaaaccagccaggcacg

SEQ ID NO: 555048 - DNA, 190 bp, Homo sapiens
gtggtgttaagtgtgttacgtgttgatcctgtccctcaggtttggaggtagtctacttcatttacaggtgaacactcccgggagaggtaaactaagttatccaaggttgcacagttgataaacaacagaacagagattcaatgttggtgaatttgatgacaaagcccaagctctttatcttgctcattgg

SEQ ID NO: 555049 - DNA, 518 bp, Homo sapiens
tatcctttgtctagcatatacacgtgtatgcactattcactatgttagtcactatagtagccatcttggttatcagatcgactgttgggatattgcagtgcttgtgtcgaagtaacccctattttacttaataatggccccaaaatgcaagagtagtgatactagcatactgttgaaattgttctattttattatcagttattgttaacctcttactgggcctaatttataagtcagaatttatcataggtatgtatatatagggaagaacatagtatatatgggatttagtactttccatactttcaggcatccattgggagtctcggaacttattttccatggataaggaaggactcctgtatccatgagctgtgggacaactacaaaaggcgtaacatacacacataatgggaataacagaaggagaatagagaaaggaacagaaacaatatttgaaacaatacggctgaaaatttctccaaattaatgtcagacaaagggaaacaccgggtacc

SEQ ID NO: 555050 - DNA, 266 bp, Homo sapiens
agatcaccttgatcacctttagaaaaattcacaagtccccatccacaaaaaaaaaaaaaaaaaaaaaattatcagggaataaaaatagatttggaacaaaagggaactttggggggcgggggggggcatctcattttctatagcaccagtatcaccgggttcgcctttagcaccagggtgggccgtcagcaccgggggggccagcaaagccagcggggcggggggggtgatctccggcacgatgagggtgatctcctgcacgatag

SEQ ID NO: 555051 - DNA, 698 bp, Homo sapiens
gggcaaccccaagtgtgtctccattgcaatgtgtacttattctgtaggtaggatggccccacaatgtgggttaaaatgtcatccataggtttctgatccacagctacagtgtgtatcttactaccagagtcacgcttgtggtccaatctgtgacccttcctgcccagtctgagtggtggccagaagagggatctcccatagtgctctaggagtctcaggcaaggtaggtcagggctattgtgcggcagtggtcgtgagtgtcgctgtgactcaggatgaagggctagccttaatgacccatgcctttcccttgctgcacctgcaaagagcgtgactcgcagcaaggaaattcgcaccagcaattacggcctgtgttcattgcgtatagctggtatgatgcagttctctcacatagttctttaagttatcagaaaagtatatgaagttgataacttcgcatggaacgtggtactgaatatcttgcgagtgagcgtcgtccgagcgtggccacgccggatatatgagtctaccttgcacagcgctacgaggaatctattacaaatctcatacatagcagccagagtggatgatttcgagccgtattttgtaggctagtaatgacccttatacgtgaaatcatgttcggaacagcatagaagccattagaacacaccaacaattcatggagttagggttag

SEQ ID NO: 555052 - DNA, 627 bp, Homo sapiens
  misc_feature (6)..(6): n is a, c, g, or t
  misc_feature (98)..(98): n is a, c, g, or t
  misc_feature (101)..(101): n is a, c, g, or t
  misc_feature (105)..(105): n is a, c, g, or t
  misc_feature (228)..(228): n is a, c, g, or t
  misc_feature (231)..(231): n is a, c, g, or t
  misc_feature (251)..(251): n is a, c, g, or t
  misc_feature (260)..(260): n is a, c, g, or t
  misc_feature (271)..(271): n is a, c, g, or t
  misc_feature (276)..(276): n is a, c, g, or t
  misc_feature (306)..(306): n is a, c, g, or t
  misc_feature (333)..(333): n is a, c, g, or t
  misc_feature (336)..(336): n is a, c, g, or t
  misc_feature (363)..(363): n is a, c, g, or t
  misc_feature (376)..(376): n is a, c, g, or t
  misc_feature (386)..(386): n is a, c, g, or t
  misc_feature (392)..(392): n is a, c, g, or t
  misc_feature (397)..(397): n is a, c, g, or t
  misc_feature (509)..(509): n is a, c, g, or t
  misc_feature (514)..(514): n is a, c, g, or t
  misc_feature (559)..(559): n is a, c, g, or t
  misc_feature (615)..(615): n is a, c, g, or t
agcggncctgccgggaaaccccctccccatactcctcccccccctccttcaccagccgctccacctcctcccgcttgatcttcttcttcctctgctgnaangccnactggcctgcgatcatctcgtacaggaggcagccgagcgcccaccagtcagggctgaacgtgtaccgttcattcttcaccacctccggaggccatgtaacccacggtgcccacacgccctttnatngtctggccctcgggcacatncacagctantcccaggtcanagatncggatgtggccgtggtcatccaccaaaatnttctcgggcttcaagtccctgtacacnatncgctcccggtgcaggtccgtcgcaggncacagcagatctngggggcatanaaaacngcccncacttcggggaaaccagcctggcccatgtggtagatgtggaacttgagggcgcccccgttcatcagtgtcagcaccaggcacagcgcgtccttggtctcataggcgtaggcnaagcncactacaaacctactgttcactttctccaggatctgcttctcgtncagcgccatggcctcccctttccgcttcttgatccgctttttctctagcctcttgnaggcatacatct

SEQ ID NO: 555053 - DNA, 214 bp, Homo sapiens
aggccagggtggccaacagtggctgggtccttccgggcccctccgtcctcctttccctgagcaccttcatcaccaaaggctttaaggaaccccgccatgtggcagggcacaggccctgttcctggtgaaccttggaccccagcatgtcagtgctttagggattgtttactccagggatttttttcaaaatttttaaacatgggaagttcaaaca

SEQ ID NO: 555054 - DNA, 481 bp, Homo sapiens
cgggttatgtgactataccatcatcattaatacaccacaccagcaggactgacatgcccactcttcccaattgcatgtatacccacgttacactggcaatatgtggtgcttctcagtataagattatggctccataatactgagtgaaagtaaattagaacccaatgcttggcttagaagaggtatcaaagcctaagcaggtaaggattctaggactcaaattctgctgaaattctccccttcttttcattcattgtgtgtatatttctctttgagtcttcggacatatttattatggctgttttaaaggccttgtctggaatttccattacctggatcctcctcagggtcagtttctattgaatgccttttctctctagattatttttagtcgtctttgtgtatcggtgatctttgatggcaactggacattatacattatacattgcagagtctctggattctaccacaataacccgga

SEQ ID NO: 555055 - DNA, 290 bp, Homo sapiens
acagttgatcagagctgcatgaagggaacacatggcagaagtgggggtgggagcaaacctagctgggaagagctgagtctcagcaagtcagtcctttcagcgggtcatgacatcacgggctgctcccacgggacacacgtggccattaccgtgtctcacacgtggggccagacgccagcacttggacggcaacgctgtagacagtctctcagcccatcagcgtgccccctatgctccccatgctgacatgcttcatcagcctgaggcggttgctttcctgctggcctctg

SEQ ID NO: 555056 - DNA, 564 bp, Homo sapiens
  misc_feature (464)..(464): n is a, c, g, or t
atccaatccaaggttcccaaatcgcccgcacatccaccgaggatgcctcctatataggaaaatccctaagttttccctggcgcccgccctctcccccttcgaccgtactagtaacgagagggtggtaggcttaagacccgtttctcgctaagagaaggggcttatcgtctaactttacaagaggaattccgccttgcactcatgatgcgttgtctttgctgtatactgaagtgtcgtgtttggggaagcgggggggtatggggtgcttaggtagacttatgttgtggcgttggtgttgttagagatgtctactttccgaactaggatagttcgttcgttgttctgatcctactttgatcctttatggtttataatggttgtacttttctttttggtgcgggggggtatgtgggggtgggcgcttaggggaacgggggggggggggggggggacaaccactctgngaagtccggacttgcatgcacatacgtacagcatcgtgactcttctgtgatatcgcctgggttcggttcgctaaccatcattttgcggcatcatagctaa

SEQ ID NO: 555057 - DNA, 163 bp, Homo sapiens
atgattcggaacgcgtgaattcacgacaggcgggcttgaaggcaatcttctttatgatggccgtaacaacaagcccgacccaagttccggtgtctatctcgaaggcgatattcagccattctacgagtttcaacgcggcaattttgcaacccgtttcactgct

SEQ ID NO: 555058 - DNA, 294 bp, Homo sapiens
gcaggacaaaggcagagaaggcactgcatggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaa

SEQ ID NO: 555059 - DNA, 380 bp, Homo sapiens
gtcccctactttgcaaagggctccggggggccagtgcccactaccagccccttgatttttcctccaaagtacagtttttggggctacccctataaggcccccccgttttattagcaaaattgcggcggcgtggaacccagcctgaccccttagagttgacccccgtgttgccttttccaggcaggcctggcctttgccctgggattggggcgcccagggcctcgtgcctttttttttggcctagcctggccccctcaggacctgcccagcctttgccagctcctttggcatccgcccttttttccctggggctggggtgggggtggcagggaactgggacctggaaaaacaactcctgtaaataaaaccctttatttgta

SEQ ID NO: 555060 - DNA, 152 bp, Homo sapiens
atcttgagatcccgtgtgtcgagtaagagctcaggtggaaaaggagggagctactctcaggctgcgtccaggacagtgccagggctctgatgtgtctctcacagcttgaaatgcctgagacagctgtcttgtgcagggacttgagatgcagg

SEQ ID NO: 555061 - DNA, 142 bp, Homo sapiens
tgcctagcggtattggtgcgtgcactgtgtctcgacgcataccagtcacgatcggcgatgcgcacccgctccagcggtggcggatatcggcgtcgggaccggtcgcgcgcagaaccgtgcgcaggctggaaatagcgcttga

SEQ ID NO: 555062 - DNA, 602 bp, Homo sapiens
agagagagtgcgcgagagagagataccgctctagattctgagtctagatgaccgtgccgactggacagacgttgatgagagctgctagagtttttgaatttggtggtgcagaagtcctgaaattgtgatcagatattgcagtaccgatttcagacatacatttgctctggtacttatagtacaataccactcttaccctatactactgggtcatatgtggctgtggtgatagaagctgttgtagattatgcatctgcttgtacgaaaggtgacagagttttcactagcagtacgatctatgtgggttttgcagagtatgctcttgcagtacaccacactgtttacaaactacctgtactggactgttaacatggagctgccatcggcattccatattgtactgcttattgagctctgatccacagtgactgtgtgacagctgtagagagtgttctggcttatggtgcaacgtgaaggagttgctattatgcgcattgcctgatcgtttgagcttatggtttagagatttttgggcactgcttggtacttgatcgaatgacagcaacactgctcttgactaagcgaggcccatgtgtgctctc

SEQ ID NO: 555063 - DNA, 437 bp, Homo sapiens
  misc_feature (24)..(24): n is a, c, g, or t
acggtgtctggggacgagtactanagctcgctgccctgtctagtatcattaactgtaaaactaaaaacgctctaaaatataaagtctgttcgcttttttacaagtaactgacatgaatacacttcttcttcttcttttttttttccttgtaccaggctggagtgcaatggcatgatctcagctcaccgcaacctccacctcctgggttcaagagattctcctgactcagcctcatgagtagctgggattacaggcatgcaccaccacgccggctaatttcgtcatctcagtagagacggggtttctccatgtaggtcaggctgatctcgaactcctgacctcatgtgctcctcctgccttggcctcccaaagtgctgggataacaagtgtgagccacaatgcccagctggctcttctaatttttattttaagtctat

SEQ ID NO: 555064 - DNA, 1093 bp, Homo sapiens
gggcgtgatgtctcacagaaagttggtccgcctgcccagacgatgggtccctcgtgcttcctgcctcgtgaagcgcagcagcagcgcgatacgtggagacaggcgaatgagctgtacccatagaggcacgacccagtccagagaccggttccagccgtcaaaggccgtattcctgcggactacaagggcgtggacatgcactcacaatcgatgccgcggcaagctcgaacagcgccgaggcatccgacggctgaaccaagagaggagagcggtgagacggctggttggaacacatgtgttacgatagacagcgctagctcgcaagtgaggtcggggtatagctgggtcactatgttgggcgcgcatagcagtaggattaatgcgcactctgtaggcggctttcctgtgtatccctttcgatacgagctggattctgtctgggcgtagaacgcgagcgagttcatgtttgacttgaacattgccaacaaagacagcgacttgctccccgtacataacatgcacacgcattcagccacacgtaccacgcctgcctcacaggggaactgcaagagggacgccctatgttacagcgcaacatgtgcgcatatatcgttgagaccaaaaggaacaccaaatgcgggccagcggcacgttgcacagagcacagtcgccggccacagggacccagcgccagggcgtcgggcggagggacaaaaaggtgaacctgactcacgagggaccgaggggcacactgggacccttggaacacggtgtcatgacctgcgggagccaaaagagtacgttgcgcacgattaccgccggctgagggagtgcaacgtcatagggagcgacggcaacgcaaggtgctccgagcgagaacatggtccgagcgcctaggagacatacatcccccttgccgtggactcggacccacgagggaaacaggcacaaaaggtggcgccccaccaccctaggtaagatgggcgcagcgcaacattcgcccagagggtgtcaaacacgccgtgctacgcgcacacaaccgtggcagggaggcgccggaacaaaacagagtcctggggggcaaccgccggga

SEQ ID NO: 555065 - DNA, 880 bp, Homo sapiens
ggttgagagctaagcagacatcaggacttaccagctgcagagaggagctacccactgtgggcttcgtctctgctgagagctgaacactcactgggacgccctgcctatggaaaccagctgttcactctgggtctcctctgagctgttctgtcgctcagtaaaggtcttcttctgcttactcgccctccatttgtctgccttacctcattcatcctggacacaggacaagaacttgggacttgccggtatggtggagctaaaatagctgtaacacaaacaggattgaaacatgccccttgctcgccacattgtggatgacaagagcggagggaacgaaaggagagaagatctgcgacccttcggcaaacccagacttaggagatcggagagccaagactgtgacacccttttctggggctctgtggttcctggcgtctccaagcttctgggcacctcggctttccccggtgccagtcgtggaagctgcttgtgcagagtcttgctttgtcacccaggctggagtacagtggcgtgatcacagcttactgaaacgtctgcgtcccaggttcaagcgatttttctgactcaacctctggagtaagctggaattacagtgttagcagtcactgatgctcaaacatgagaaagacttggacatccatcacgataagaaaacgctgcccaaagtgttagactaataagtgacaggggttgggacaatgaaacccaaacatcaaccttcggaacaagtgagttttacaacgctagattatgctaatcttatcagaacaaaacacgacattgttcgggcacggtggctcaacgcctgttatcccagcactttgggaggccagcgggccgatcatgaagtccggacaag

SEQ ID NO: 555066 - DNA, 755 bp, Homo sapiens
aggggccccggcctgctctccctccctccccccatctcctcctccgctgtgccctgctctctccggaggccctcctgcctcattgctcctgtaattttggtctttcgagtgccttggtggtttccctgatctcccgtgatgatacagagactgtctcctttttttttaacttgtgacaatcgtgagcttactgtatatccattttcgtaagtataattatttgcaagaccaccccggacaggccccagctctgattccttcaaggcccggcctgtccggggccaacattccacaccttgcggtttgaaacagctgttttgcccacatttgctgcaggcttggctgtctcctgcccctggcctgcgccagtctgtgcctatagccgccagccgtggggcccggggtccctgctcggatgcccgcctctgccttctgatgccttaaacagctggggcccatggctctgcgttgccacgagtcgcagatgccaccgtctctgtgtgacgcttgatctatggaccataacagtctctggccttagggattgggccaggcctacccatgggtctccaacctggggacaagtacaggggggatgtcttcatcttggctgaccgtgccccgactgcccctcgtaccgggcctccgtgcagcgatgggcgtctctgccagtgccctgtgtctgtctgtggggatcgtactggttgcctctgccggagctctgtgtggacgctgttgagatgatctgttcgctg

SEQ ID NO: 555067 - DNA, 188 bp, Homo sapiens
  misc_feature (7)..(8): n is a, c, g, or t
gtggtannggtagtatgtaggagttgaagattagtccgccgtagtcggtgtactcgtaggttcagtaccattggtataataattacatcacaagacgtctgcactcatgagctgtccccacattaggcttaaaaacagatgcatcccggacgtctaaaccaaacactttccgtacacgactggttgtg

SEQ ID NO: 555068 - DNA, 344 bp, Homo sapiens
gaccaaataaataaaaggtacattttcaaggagaatcagaatcattatttgataagattctgggctgggcgcgctggctcatgcctgtaatcccagcactttgggaggctgaggcaggcagatcacctgaggtcaggagtttgggactagcctggccaacatggtgaaatcccgtttctactaaaaatacaaaaattagccgggtgtggtagcaggcatctgtaattccagctacttgggagactgaggcaggagaattgcttgaacctgggaggggcaggttgcagtgagctgagattgcgccactgtgctccagccttggtgataaagtgagactctgtctc

SEQ ID NO: 555069 - DNA, 465 bp, Homo sapiens
tctctggatccatgaccatccttttccttctgttttggggacatggtcttgctcttttgtccaggctggagtacagtggtgtgatcatggctcactgtagcctccaactcccaggctcaggtgatctcccacctcagcctcccgagcagctgggactacaggcatacaccaccaagcccagccaatttttaaaatcttttgtagagatggggtctcactatgtttcccaggctggactcaaactcttggactcaaactcttggactcaagtgatctttctgccttggcctcccaaagtgctgggattacaggcatgagccaccatgcccagcctgggtcttcattttcttcattttcataaaggttcccatgtcaggtggaggttgcagtgtgccgagattatgccacggactccagcctgggcgacagagtgagactttgtcaacacaaaaaaaacaaaaacaa

SEQ ID NO: 555070 - DNA, 1716 bp, Homo sapiens
  misc_feature (1)..(1): n is a, c, g, or t
  misc_feature (1209)..(1209): n is a, c, g, or t
  misc_feature (1418)..(1418): n is a, c, g, or t
ntccccccctgctagcaggagcgacgacggcagcgagggggggcggaggcgcgatgcgcttacgtttgtctgtgtctgtatttttatttcgtgtgcttgctctcctgtctggtgttgttgttatagtgtgttctctctgttttgtgttaggtcggtcttgtttcttcttctctcgtggttgtttttcttgttcgtctgactatgtgtttctcactcgttagatggtgtgcgttcatgtcacctgtggtcttttatcctcattcttttcttcggtgcataggttgttttgttttggttgctctctccgtgagtgtttctgtgttgtctcctccctatctgtggtggtggtcttcgtgtgccttcttccccgcccaggagtgcgcttgtggtccgccgaatcaccccgcatgtgtgttgttgttgggcgcgggtccccgcagcctggttggtaccccctggggcgctttgtttcgacgactcagggtgtgctctccgaatagggtggttgctcccttgctctccctgggtgcgcctccctgcgctgtccctttgtgtggggtgtttctcagtattcacgtttggttgtcttccttcttctggggctccccaagatgttcctccctcccttggggggatatttgctgcgggtgtgttccatcatctcttgggggcgtctctcgctgtgtcacagccctgttcccgggacgagatgtggtggagtgatcccttcccacttctcgcgggtgttttttttccggggttgttcggcgctccctctttcagtgtggtgggtcccgccccgcgccgtataagtgcttttttttttagtccgcgcgggcttttattgagcgtcctcaaatgttgggcggggagacaacacgccccgtgtctttggtgagcccacagcagaccctttttatctctgggcgcgcctccccggtttcccccccgcgtttggtgagagattttgtgcccctccggcctcctttattatttttgtgtctttgttgttgtgtgtgttgtgtgtttttttgcgggttgtgttgtctttctgtgtctgtcttggtgctcttgagccttccacggggaggttttatacaacacctcgggagacgccggtgtgaaaaggtggacccacaccacgtctccggttttggagtgttcgagagcactttccccgcgccacaggttgtcaccacacatgtgggncgcgagaggagcttttggagttcgcaccacttggtgttgttgtgtttgtaattaagtgtcacttgtccacacataatgaagaatcgcactctgttaccacaggaaagtgcccctctcgccactcctataaatagccaccccccacgctttcttctctctaaaggaggaaattggcccacagtgcctttttcccacaagtgccacacacnccaggggagaggtggagtaagcacttgcttttcgtggtgaaattatagtgaaacgccaaattgtttgttaatcttccgcctctaataacttttttattgttgtgtgttattcttgagatgatgaggcctctcgggcgcccccctctccccctctttttgtgccccccacctgagatgtatgtaaggcttttggtctccctgggagtggcgtggaggccaacccgggcttaccctgtaccctgacttgagacccagttgaatataaagtgccccccccttaaacaaaaaaaaaaataaa

SEQ ID NO: 555071 - DNA, 108 bp, Homo sapiens
  misc_feature (16)..(16): n is a, c, g, or t
  misc_feature (104)..(104): n is a, c, g, or t
ctcaattcggccgggncactagctggacataggtgccgctactacgctgagctaattttatattttttgtagagattgagtttcactttgttgcccaggctggntctc

SEQ ID NO: 555072 - DNA, 309 bp, Homo sapiens
ttccagcgacgctagacccaccacgattgactcaggacgacagagaaggtagataaatctatatagcaaagagattcagcaaagggactgaataggtaatcaaaaaaagaaaaaaggaaaggaccatgaaaaacaattgcccaaaaaagaaaagcctggggccagatggctccaggggtgatttctgccatttttcaaggattagccaccaagtctgctcaggctctttcaaaaatctggaggagggggtattattcccggagcttattctatgacaccggtttggccctgatacaaaggccagcaaaa

SEQ ID NO: 555073 - DNA, 167 bp, Homo sapiens
  misc_feature (29)..(29): n is a, c, g, or t
  misc_feature (38)..(38): n is a, c, g, or t
  misc_feature (40)..(40): n is a, c, g, or t
  misc_feature (46)..(47): n is a, c, g, or t
  misc_feature (67)..(67): n is a, c, g, or t
  misc_feature (106)..(106): n is a, c, g, or t
  misc_feature (120)..(120): n is a, c, g, or t
atgtgtaagtatgctgctggaggacagancaagagacngnacccannccaatacatccctaatggangaccatggcatagagaaggagaggtgagacttgctggantgacacttacttangacccaactacagctgctatacagaacggattttatccttcaccata

SEQ ID NO: 555074 - DNA, 193 bp, Homo sapiens
ctcacaacattgccagtggcacacatgtcgacgaggactgggtctaccagttccaactgcttgtggttctcacccctgaccacaccccacccgagtgtggccagaattcccttatatgtagcaaaaacgacagctgccgcgtgacactgaacacacattagcaccatgcacacattaaaatgcagcatgctca

SEQ ID NO: 555075 - DNA, 305 bp, Homo sapiens
gcaaaattaacccccttaataaaattaattaaccactcattcatcgacctccccaccccatccaacatttccgtattttgaaacttcggctcacttcttgcgcgcctgcctgatcctccaaatcaccacaggacttttcctagccatgcactacttaccagacggctcaaccggccatcactcgagacgtaaattatggctgaatcatccgctaccctcacgccaattgcgcctcaatattttttaactgccccttaccacacatcgcgcgaggcctatattacgggcatttcactactcagaaa

SEQ ID NO: 555076 - DNA, 1182 bp, Homo sapiens
gactttgaaggattgccaccagcgttggtcgcgaataagcaagggctgtgtttaatacggtgggccccactgagcctttatgcgggttcctatagggtttatacaatggcccttgggttggctcgtaaattttcgggcacacaaggggggaaaatccccttgggggtataacggcggcgttcacatgttacgtgtgtcaagacccatgggggtgtcaccgcaggacacttagggacacagggggccttcttataagtattgccctcctgcatcaggtggtcctcagagtaggttattggtagtcggggatttctctcgggtggtatgatatgaataggaagtgggtgctgaacggcgcgcccacgttcgaaggggtcgccttcttgtggcccaaaggggcgtaattgcctcgtgccgcgggaagttgtgttttctgcagacacgtaccctgtcacacatgtgttgccacgcgtccccgtgcgcggtgtttgtaagcgaacaaagccccccgagcgtatcgtgttgaaaacctaactctccaagcgttttttttccgcaaaacactgtttttacacacccgagacacaaaggcagtttttttctcctatatgatctgccggtctttttgaactgtggaaacactgtgcttaaaattttcggtgtacacatcccgcgaaatttccccgagggaattgtgtgacccccgcggagatacggttcgtagtgtaatcaccgcattaacgccgcaaggaaatggattgtgggacacgtgtatacgcgggtgtttccgccgaacccgaggcccttgcacccctgggccaaaacccacacgggggccaccttgccccaacccgggttcccgcacatggcccgcgcgaagccccttggctttccacacgccacagcctgtcccgcattccacacccggcttggcacaataattttctccagaagcgattttccagggtcgacccgggaagaaggaaaggtgagtatgaggcatgcaacacaggggtgcgcaccagccaacgtttctctctctctagacctcactgggcggcaaagaaggtttctcccggattccagcctcacagacaaagtgtgccctttgaccctctcgggaaatgaggagagccccccattggacccatgtttgcttagtgtcttcacctgtattttcct

SEQ ID NO: 555077 - DNA, 179 bp, Homo sapiens
gatcgcaggtgtgagccactgcacctgggcctataattacttttaacataactgatatggtttttctgtgtaccccccatatctcatcttgcattgtagctcccataattcccacatgctgtgggagggaccctgtaggagataattgaatcatgagtgcagtttcccccgtaccgatc

SEQ ID NO: 555078 - DNA, 145 bp, Homo sapiens
  misc_feature (23)..(23): n is a, c, g, or t
  misc_feature (119)..(119): n is a, c, g, or t
  misc_feature (126)..(126): n is a, c, g, or t
tgggtgatctagcaggagcttantatctctaatcttggtgacagatagttagagctgaaaatgctgtttaggggcccaaggccagaagactgtacaaaacacctttgagtctactgagncttattntggactttgtatttccctg

SEQ ID NO: 555079 - DNA, 179 bp, Homo sapiens
ggtcggtacctgcttactgggcgtatgcccatttccgtaacactcacaaaactaactaatatctaacatctcagacgctcaggaaatagaaagcgtctgaagctatccgtgcccgccatcatcctagtcctcatcggcctcccatccgctacgcccccggtgtgctgggtgatccgtct

SEQ ID NO: 555080 - DNA, 1570 bp, Homo sapiens
taccaaacgcccactctatcgtctgatccgtcctaatcacagcagtcctacttctccatatctctcccagctcctagctgctggcatcgctaatactactaacagaccgcaacctcaaacaccaacctctcttcgacccctgcctggcaaccaagcacaacccacaatctctactacacaaacaccatatacctagaactcccaccccagcgatcaaccccttgacagtcacaatcatccctctatccctaaccaagcgccctcacaggaaactaaagtcatcccccatttactcggccaccacctctaccatacacatcccgaagagatcacaacatcgactacccaccttcgtgccacaaaccacatacgcgctattgacacccctcgagccataccgtgaccaactcgcaacattcggcccctaccccctaccggcgcctccacacctcccgacgccttgcctcgccaccaaaccccaccacctcactttttcacaaggacaagcgccacacttaagcaccctccattaccaacctacaacgtttcagcccaacttaactacaacaccaacctatacgcagaacctaacccaaatctcaactcccaactccgactattattcccccctccaacccggacaggctccccacagcacaccctcccaaagaaccatggcagcaatccacccccaacaaacatcccaacagagacaaaccaacacacactgcaaccaccaggaaaaccagagacataggccacaaacggacctccctgcaaagcaccccaaaaacccacctacccacaaccagcacagcataccaacacccccacccacacagcaacacaaaaaaaaaaacaagaacaagaaaaacagacaacagacttcaccagcaccagcaaacctatcgatccaccaccacgacacacagaaaccaccacatacacaacacaacaaacaccacaacaccaagaccagaccaatacgaaaaccaacacaacgaaacgaccaaaacgacgcatcccacgagacaccagctaacgcataccgacaacacaaaccgaacagacaaacaaaaccacgagagtacacacactacacaaataacaaatctcgtacatacgtcacactactcccacccacacacaacagcaagaacccacaatccatcgtcatcgcgtagcaacaccacccgccagcacaccgccataccgacacaaatccaaccattctacgcatcacgcacgaacatctacagcgacacctcaactatcaccaggcgctaccacactctactaaacctcaggcaccacccactacaccacaagctccctcgcacagatctacaattcacccgaccttcaccaccacatacgtgataaccacacacacatacacgcatcacgccacaccaacgtatcctccaccaccactactctccatcatcaaactactcgaactcgcgacccaactcactccaacaacaccacaccacgcaacacagctacactcccacaccacactccaccatcccacacatatcactccatacagaccagatcacacaca

SEQ ID NO: 555081 - DNA, 1491 bp, Homo sapiens
  misc_feature (390)..(390): n is a, c, g, or t
ctgttcgtttttactctgtctgctgctccccttagtttcctctttctgtgtttaccgtcggtctcacgttgtggatgatattgtttgtccgtttctttcttgccgccagtcggatattccgcactgtttgccccaagtgttttctacccattttttttagtgctctaaccctacctactctcctccttcataacacgttgtggcgtgtaggggtgagatttgtggctcaccaagccacccttttctcctgccatagtatggtggtcgcctttttttgttccgccgtcccctccctctgtcccacggcttatttcaatttcgtgttgtacttttcagtttccacctgggtccgcattctctggatgtcatcgtcctcatgtttgtggtaantcctcctctctacttgttgggtatttctcccccattcctgtccacagcaccacccgacgttttaggataaattggtccgggaatgtccccgttttgataataaatggtctccctagggaataccccaaacacaaggctttgtgtgtggagaaacgtgatttgttttatagagtgaaatatttggtgaagcagcccttgtttttaacacaccttgtttttgtgtgtgtggacgctgccctcataaaacctttaattgtttcctaaacccccaattttggacgggaaaaagacacccatggtgttggtacccgagttctctctctcaaaagggagtcttttatgaatctctatgtataaatttactccagtttgtggactcccatgcccgcattctcccaggttgaccctggggtatctaaattacgcccacgaagggataatattatatatttccaattctgttgcttatatatatatgacccaccaactgtcaccaccgtattgttttgtatattctcgcgctcactatcgtccaccacattatgcccatatgatcctctgtgagatccccaaacccccaaaatgttccaccgctattgtagtataaccacggagcttataggaataaatttggccaccaataataccacccactgtgaaatattattgccacggccacttaaaatgtatgagctccactgtcctcttttatgggaccactggattgtaaagcctggagaacccactacctttctcacgcccaatcttccccaccaggacccaacaaacccaacacccaccactgtttctcacactcacacacggtgggagaactgaaccacaatgagaaccacctgtggaccaccacggaaaggggaacactcacacacacacccgggtcccgttgtgggatggggggaggggagaggggtatgcacttaggagaatatacctaaatattaaatgacgagttaaatgggtgcacgctcaccccaacactggcacacacatgtaataacacataatgtaacccaacctgcccgcttgtgcgcatgtaccctagaacttgaagtataataaaaatataaatatacttattta

SEQ ID NO: 555082 - DNA, 297 bp, Homo sapiens
  misc_feature (292)..(292): n is a, c, g, or t
caggtgaacaatggaagctggaccctggctgatgtcttgagcctactctggaccaacatggagcagaccactacattagatgaaaatattgagaaagtactaatgaaaaggaaaacagaggattaataagccaagtctgagaagttggagaaggataaagaagcaaaggaaggctctgagccagcggagcacgaagaccttcaagagactgatgaggaaggctcaaagaatgatgcctcgatgactgactactcattaactgctgataacatgctgaccaacagagcaccanagcag

SEQ ID NO: 555083 - DNA, 793 bp, Homo sapiens
  misc_feature (793)..(793): n is a, c, g, or t
ggggaacgctggcctctgaaactagctctggtgacctgggtgtctgcgtgccggcccctagctggccccgtctcccataccccagaagggtattcactgtgtggattctagagctatatgtgctactaccagttaacccacgacacgatgttccctattctacagctagctaggaggactaggactagctactactaactacctgtgctgtggcatgtgagagaatcctgtgcagacagaagaaaaaactatgcgactatggtaggagaaaagtgtgtaaagagtcacgagaaagagtatggctctacagtagaagcagtgctagaaaccacttgtttcaatcaaacatgctttattgatgcaggccactagttcgtgggacccagtgggtatcaaagcagcagcataaccattcgtcacgcatacctctaccagtgggattgttgctctgtggcaaaggctttggtgacagaaactccactcacacattatacatttggggtagaggaaccagtggtgtcgcccttgggcttggcccaagccatttccaacaccacacacaccacatgcttagaaagatatggtgtgctggacaatctgttggacgtgtaatcaacttggctttgggaggtataacgagaggcgacacggacgctgttccacaacgccctgaacacggaagccaccattcccaagccaagttccctttcattccacacataccttgatgaacaagcggctaccactctctcgggaggacataccaaatgtttggccctatggcaccttcccn

SEQ ID NO: 555084 - DNA, 1860 bp, Homo sapiens
  misc_feature (650)..(650): n is a, c, g, or t
gggtcgtaaacatagtgcgcgctgtggcgtgcgacgggtccatgtgacggtaatgtgaagacttatggatatcaagatgtgaacctatagataagatcctgcggcgatagcatgagatgactcgtcaatatactgcaacacagagataaactgaatagcacgcggtaagcagcatggccgtgaggcgtgtcctgaagacagagatgtccatggaatgggatgtttttctcgacgggttgcatgttactctggcacgtcatctacaatggtaggcgtaggattcgcaaagccagatgggcatgcgaggtacctcacaaaactgagacgtacctctcgggcgctcgagggaccgggggccgttcgcaggaccgtaaaaacgcgacgccttaaccataaggagcgaaaacgccccataaatggccagaaaaaacttagacttgccacacacacggaacgcccgacagaggcggaaccttcaaaaagccacggaaaacccctacttaaccttgtgcccgtgcttcccaaattggcacacaacaccaggcctcgcggcaccacgagaccaaccggtctccaccttcatgttggggcaccacacgttggcacccatacaccacaacgggggctagtctttattgtctgtggggccncccccagcgcgccatacccccttgtggtataggtataacattaaccgtacccttcatcacctggaggcgccacagacgaggtgaacacttggggaccagccggacacacacacacgccgcacagacacatccggcaaaaccctacccgacctgtcgggggcaccaccctggcccgggaacatggcgcgtttgaggtgtactgccgtgatggtacaagccgaaacacgaaaaggcattcctgtccaaacagcgccgcggtgtggtttggccacaacttctaccactctcgaggcggacgacacatacgggggacacacacgtcaacggctgggaccgcgcaacaccggacacaccatcttggccagggccgagggcctgaaacaaacccttggtggggaaaacagggcgacacacacgggaaaaccgtctaagctgaggacccagcccacgcacccacaaaacaaaacccaacttcgcgacaacctaacgtacagttccctgggaagcgctgtaccaaggacacccaacagcgctcgaccacacggccaacgtgtccccacaaaggggtaaggagacccgcatggctacagcacgagcgactggcataccctaacagtggggacaaaacacacagcgctgacactgccacacacacattgggacatgactgcgttaccccagcaccaaggcgacaaaggcgcgggccacttacaagcaggggctgccagctacgttctccgaaaaaccgccgtttccccaagaaaacaaaaccgcacaagcgttcacgcctcacatcctgcggacagcacaacacttggctactgcagcctaatacatcggcccgttgcgcgcctaacggggaacacccacaagggggtggggcacacagagatgtcaacagacaggaacgtatcgagaagtccccaggccatacggtagcagcatcacaccgaaataacctgccccgtgtagcaacggaacaggcgacacattacgaaagcgccgcagagcacacaacggacgaggaggaagaagcacactatcaacattctcacagtgcgcgaggcagcgagacaatggaacacagaactgacgggagtaccgaacatagcgcgccgcacaaatggccgaaccccaactatggtacaaacacgccgaaacagtgatggcccacaacggaagaggagcacaccccactagcgtaccggca

SEQ ID NO: 555085 - DNA, 251 bp, Homo sapiens
cgaggtcatctagagatccctggtgcatgataaaaagtagactgtcttgaagagactgttagtagaaatttagacattaaaggttattctggtgaaggcacagaaggaagtgaagaggatgacagagaaagcgtccatcatcttttttttttttttttttttggaaacgggttctcactcttttgcccagcctgtaccccttttcccatttcttacccaagccacccccgtggttcaccgaccctcgattt

SEQ ID NO: 555086 - DNA, 83 bp, Homo sapiens
tctacatctgtgctgtcatccatcgatcgggcctcgattgggggatacgcggcgctacgatctcctgggacacccgacagatg

SEQ ID NO: 555087 - DNA, 712 bp, Homo sapiens
  misc_feature (291)..(291): n is a, c, g, or t
agcggggtgtgcggcgagctgagggtggcggtggtcgacatgtgccaggtcccggatagcgagggcggccgcgccggctccagggcccatgagagccgcccaggaggagacatcgagcaatcgtttgcggacatgtccaagaagaagctacatccttcgcagcaggcctaataggatggtatctaatatgttgggaccgaacagaagaaccatcgagaacatacccgaagaggacaatcatccccccagaggggttaacaaggaatgtgggtatcgttgtggagcgaatcnaagcgccaccggatggccatgactgcgacggagcaccatcgtaaccgcaacgctggcgaagaggacatgacgctaagcagtaactatttgtctcggcgatctccagggtctaactagcctactttctaccgtctctggctagcatccctaaaaacaatatccctagaggatatggaacttgcattccagacgtgaacagcgcaggagacgggtatgccaggtgctcttttccaaaaaggcgtccaaggcgagatgcgacatgtttctagggagaatcatggtgggtgccgtagattatcctggatgcaagcattagtcatcgagttaggaagttcccctgagtcacccaggaaacagtccaagacctagtgctgactgaagccgtgggggaagctcttctgtgctggtggcggacgcccaa

SEQ ID NO: 555088 - DNA, 128 bp, Homo sapiens
tagtcgggtagctgtttgatgtgtaagctcctggttgatctggctgtctggcgtgctctgagtcctggtggtagttctggcgcacctgcgaggtggacgcggtcgtcatggacttgcgacaggcgtac

SEQ ID NO: 555089 - DNA, 236 bp, Homo sapiens
gcgacgagagctagcaccactcaataccctgtgcaattaagtgagaccctgtctcaaaaaaaataaaaatgagaatataaacttaggaagcccacagtaaagaagtgaaaaggtaagaaagtaaaccggtacctggtaactgttactgattttaatatgcttctaaatagggtcctcgttattttccactcacctgaaaaccctggagttaaagatggcagttttcttggccaatt

SEQ ID NO: 555090 - DNA, 523 bp, Homo sapiens
  misc_feature (336)..(336): n is a, c, g, or t
  misc_feature (479)..(479): n is a, c, g, or t
ggaattcagcaatgcccacggttatctgctggacacgagtctgtagcctactctgtgcggacagacattgtgggacaacacagaggtcattgccagctacaatcagctctcaagtttacgccagccaaaggcggtgcgctaccgcgtggtcaacctctatgaagatgatcataagaacccgacggcgacgcgcgagcaggtggacttccagcaccatcagctggctgaggccttcaagcaatacaacatctactgcgagctggacgtgctggaggtgagcaactcctccgttcggcggcgacttatcctggccaactgtgacatcagcaagattgnggacgagaactgtgaccccgaagtgcaacacacgctgacgggccacgacggcggggattgccgcacccgcgccaccctgccttcgtgaagaagcagcacaacggggtgtgtgtcatggactgcaactatgaacggttcaactntgatggtggagagtgctgtgaccctgaaatcaccaatgtcactc

SEQ ID NO: 555091 - DNA, 101 bp, Homo sapiens
aaattccacttttattacttccaaggatcaaccagatttgtgcaggcgaccttctttccagccagaaagcagttataaagtggatatccagcctggacaag

SEQ ID NO: 555092 - DNA, 858 bp, Homo sapiens
ggagaaggccgtgtagcgtcgtcgctgtactccgaggagataccagtcggtagaggggtgcaaacaagtgcagtagtaataaaacttttaatcttggagaagctaaaagccatacgtccaagaagagcactcagtcaacagtcaccatccagcagcagcaccaccgagcgagcgaacagcagccagcgcgccacacagccgccaaattacctgcaatgagtgggcaagcaggccagcaggcaaagatgagaggcttgactattgacctgaagaatttgtagaaaaccaggagagaagaccttcacccaacgaagccgtctttattgtgggaaatcttcctcccgacatctactgaggaagaaatgaggaaactatttgacgaaatatggaacggcaggcgaagtcttcatgcataaggatcaaggatttggctgtatccggtgtggaaacccgaaccactagcggagatggccaaagtggatgctggacaagtatgccactccgtggagaagcagctgcgtgtgcgcttatgctgtcataggtgcatcccttacagttcgaaatcttcctcagtatgtgtgcaagcgaactgctgggaacgaagcccttgtctgctgtggggccaggtatgagaagggccggtaagccattgttggattgatccgagggaagggccgccaggaaaaaggccatggtggaagtctaccaagggaaggccaagttggatctagaaactctggacagattgagcgaaggcctttcctggaagccatttcttgacctgtgaacagggagccatggcccttcaataaccaggctccaaaacaggttgtaaaaacgttcacgacaaaaagcaat

SEQ ID NO: 555093 - DNA, 941 bp, Homo sapiens
  misc_feature (941)..(941): n is a, c, g, or t
gcacgggtgccccagccgctgcgtgcctgcggttggggaccagtgcagggaccgggtcgcgccgtgctatgtgccctgtaccacactgaggagcgcggcagacctgctcgcaaattaccgcctcttctttaggccctcagcggtagccgcgcgtccaggccaccttacttcccgcggggagcgcgcaccgagtcacgagaactgccagcgaggaggcggcgggatcaagaccccaaagctggagagcagaggcgcatggctgccgtgtgggggggtagatagcgccctgttgccctgccgagcgccctccccgagggggtaaggcagattgcaagcggcaccccgggggggctgcagcacattagccggccggccgcgttacccggttcacacaagctcagtgaggaagggaaggcagagcccgcgcaacggccggcttcctagaggcgtaagaaagctcctagtgggggaagctcgctgacgttcggaaggcaggccggaactttgcgggatgcctaatccagcgcgtctctttagcggggggactcctgataaggtctttccccacagaagctttgcttgggtacgccacgaagtttaacccctgagttgtgcaatccaccatcccaaaagggcttccgtttgggtcccagggacggcagccccgttttcccctccccacaggtttgaacaatgcccccagaaagctaacgggacttcgggggggcgccagaagtttgccgagcccaagggagacggcccatggttttcgggagccatatggcgcgggatacgccaatagggcgactatggagcgttacccggacagagagatatgagtcgggggtgtttacacccccagaattgcgagactcggggtggaaacacggggcgattgcccccttagaacaagctggcggcaaataaagggcgcgtaatcn

SEQ ID NO: 555094 - DNA, 100 bp, Homo sapiens
gtgcacagcagctgtgcctccgtaaatggttttacaaagcctgggtctgaatgagaaggggattggggccagacagagtaactcatgcctgtaatctcag

SEQ ID NO: 555095 - DNA, 483 bp, Homo sapiens
agttcgacggagactctctcactattttaggcatatagaaaagtgcaaaaatagtagagagagtgcctgtattcccttcgcccagattcctctaatgctaacgttgtacataagcatagtacactgataagaaccaagaaattaacattagtaaaacactattacctatagaccatatttgaattttagcaggttttccacttatggccttttttgttccaagatcttatctaggatcccacattgcatttagttgttatttttccttcatttcttccagtctgtaatggttcttcagtcttttcttatctttcataatcttttctgagtattttaaagcaaagcccagacatatcatcttcatttgtaaatacttccctacgtttctctaacaggtaaggactttttctttgttatcatacataacaaaactaataataactgcactccagcctgggcaacagagtgagagtctccttcgaa

SEQ ID NO: 555096 - DNA, 1351 bp, Homo sapiens
acaagatggctatatggtcggcttttaccctaccctgtactatacatgaaaattccagttattaacaccactcaaactggtgtgcagcttgttcacctctaggcaagagggattgtatatatggcaggcttccctgtgtgccgatgtaaagggctacatttggtgaacagtgggacttccattgggcactcattaagctgcataatgcatggccatgacagtcacaacagggtgcctcaatgcatgcatcagtgcacaaatccagttactttctcacacacattctcttacaagcaacaatccaagtgctacatcaaccatcagtcatcttctagatgtgcactatcattcaggcagcataagcgcaagcagccatttggcgacaactttgccaccagcctcagactcatagcatctcaccatcttggcgctataagcgggcttcagcttcatgccaacattgcttctcttcagatcatgccactgtgcttccacaatccaacctttcccaccatcacaaaaccttccccgtgagttcctcccgaacaaacgcgtcccagacagccagaatcagcaggtttcacatggaagttcgggagatgagtacagatttatctctctacagacctgggagcgtggataaggcttttatcctacattacctggtcaattgggggcatccttaccgccagtcctttacctccgcgagttaccccacaagttttcctgtgtccaattcgttccccaagggtccttggatggttctatcacctacatcttcttggacgggaccacgccagaggctctggggacgtcccaccgttccacagttagtacaccaatagtaatccctacaattcaccatccataccacaattacccccagaagttcccacatggttactaacttcaaaactgcacacatcttccataaacccttctcgtgatgcacccggctctatacaacttgggccccaactggggcgttcctacaccaacctttttcacaccttgggactatactccctatgtagctaacccacttctgcacaaccccacacgcaattttttcttcgtctcaactcgaaccttgggactctcttaccgcaacatgcatcgctgctctccacaccgtcgcaacaccgccgcactgccacacgctccggaacaaccgctccaaccatacagcccaccttcaggaacaacagaacacgcctacgacaaagatccgtataccacgcacaaccggcagccctcgcaccccccggggcacctgcgacaacaacacgcgcacagcgccccaaagcgaagcgcaacaaacacacattacagacacacccgagccgacgtc

SEQ ID NO: 555097 - DNA, 322 bp, Homo sapiens
ggcgggcgttgaggaatttggcttggttgatctattccccatgggagcttaaacacagaaatgtgtgtgtatatatatatatatacatacataaaaacatttccagatacatgccattgaggaaaattccccctcagggaaaaatgatgaccagaccaaagaatttgcaaagaatgggagacccccttattagacccccaaaccaataaaagaagtctttttagaaaaaacatctttagaatgggaatatcaatcttcgaagccaaaatcgagaagcccaaccccccctagcattcctgcacatctgtacccacgccttcca

SEQ ID NO: 555098 - DNA, 229 bp, Homo sapiens
agcatatcctcaaatctatatgtataaagtcacacaagagtattcagcaaatggaaactaaacctatgtaggtacatgacacttgtatcactcaaaaataactgaaacagaacacaaagaattcacttatgggaaaaattctacatctaaggccgggcacggtggctcacacctgtaatcccaccactttgggaggcttaggcggcagaatcgcatgaacctgggactt

SEQ ID NO: 555099 - DNA, 501 bp, Homo sapiens
  misc_feature (129)..(129): n is a, c, g, or t
  misc_feature (294)..(294): n is a, c, g, or t
  misc_feature (307)..(307): n is a, c, g, or t
  misc_feature (350)..(350): n is a, c, g, or t
  misc_feature (368)..(368): n is a, c, g, or t
  misc_feature (414)..(414): n is a, c, g, or t
  misc_feature (428)..(428): n is a, c, g, or t
cacgaggccaatgatcatcgggttcttcatcggccgcctcccttggtatcctcatgcccgatcgcgttcttgtgggcacggagttccagctccttgatattgccctccgtatcggagagtttttccagnacctcagggtcctccacctggaccatcttcttcagctcttccacgtccacctcttccacgtcgtgggcccggcgcggccactcgcccgtcttcaagcactgcgcgcagcgcaccatctcagccagaccctggagcagcaccaggaaacccgcgatgggaatcagngtcttgaagtggnacaggggcggccccccggcggttgtgctggagtgctcttgcanagcccaggaagtcttcgngaagtctatgccagagtaagccagtgccagaatgccggggatgaanaacaagaagtacancgccaggtccagccctgcctggaggcggggaggaaagaagccgtagagcacgtcaccacgcacgtggccgttg

SEQ ID NO: 555100 - DNA, 632 bp, Homo sapiens
tggccggggagagattaggcttagaactccagaaactgttatcagcctaaacaggtgcagcagcgtgtttgttgtctcttgatcaacttacaatgacttttatgtgacagtatcaatgttatggcattgtataatagatagcaggagacacaggattcttacactgagatagcagaacgaaattttttttggtcaatagtttggtttggtgtgtatttagagtaaattcacctgtttaaaaatattactgagctgttctagacaccaaggtacatcagtgaaaaaagcagacaaaaatggaactcacattccagttagtaaattttagtagttatactaactgctaaaagcacctggtatactacaaacagatataaaattaaggtagttgatggtgatgttagggctacatgtaaagctaagatttgtgtcttactgaaatgaaactaaaccagtggtccagacagcttaaagtgttggtaatttattgaaactattcttctacttcagagaattacaagagacagcttctccatctggatgctctgcaaatgtatatattagttttgatagagacaataaatccttttgtaattactacaaagcttataccatttgaattatttctatag

SEQ ID NO: 555101 - DNA, 176 bp, Homo sapiens
taaaaaaaaaaaaaaaatcccaaattagctggggggggggggccctgcctggtatccccgcttctcgggggggtggggccagagaattggttggacccgggggggggggggcccggggggccggggttgggcccttgccctcccgccccggcccccagggccaggctccctttcca

SEQ ID NO: 555102 - DNA, 434 bp, Homo sapiens
  misc_feature (430)..(430): n is a, c, g, or t
taccctggtcatgcaaaatacacaaattgatatatattctttctagaggaagatgaaagatgaaagagccaatgaccattttcacacatatgaaaagagaagaatttaagtacagttcagtttcactgtttttccctcagttcagcaagggttaagacactgccaaatctatgcatcacccaacagagtgatttttcttaagctgagacaggcctcaaactcagtctaaaactaggagaatcctaacagaggagcaagcagggaaaataatacaattttgcaatatacccactgacctcatggtcattattttccaaacttgtgtagactacatcatggcctgtgagattatccgggatccaggtggaaacgtactattttccctttattccacctacacagtcatctattattccctaagtccaagtgnatac

SEQ ID NO: 555103 - DNA, 411 bp, Homo sapiens
acccttagggtaatcaccctcgtggaaaggcaacagacaaatagcatagagtgaagcggaccaaatgccatcctacaataacctcagtggtctgatccacaacgagcatgccgcgtaccactctgaagtaaaatctgataatagtccggcgtatctggccaagatacaaaagctgaaactatacactacacagcaaaaccccacaataaaatacgataagaactatactaggcaacagtttattgctcagtaaactattttgaagcattactgataataagcttgtgggtcacataagattccgcaaaacgttagcaacatactcttgattcttgaagaggtgaggtcctcgagacagagtatactgacccaagatttatgtaacagctcgaatgtcattttagtaagatg

SEQ ID NO: 555104 - DNA, 255 bp, Homo sapiens
acacgcgcaccctgctgcagtccattgtggcttagtgaatcaatctataatccacgaggacgaaggttcatccctggctcgctcagtgggttaaggatctggtattgcaaatagctgtggtgtaggttgcagacttggctcagatctggcgttgccatggctgtggaataggccagtggtttcagctccaacacatgaacggcagcttcgctgcggccgctgcttctgcttgcctcgttggccttggttgtgtct

SEQ ID NO: 555105 - DNA, 245 bp, Homo sapiens
cttctttacgacgaacagccacggtttttgctctggcgagacaccaagatttctcacaaactttgtgttgaagtccccagtctcggtcctattggtaacgtactggggacgcaacgcaggagaagggtcaatttttccaactccgatggctacgtttccctctccctctattgggctggtttcatagccgagaaacccctcatccagtctcatctgagtttgggagcgcaggttattgtgaagcc

SEQ ID NO: 555106 - DNA, 252 bp, Homo sapiens
aaaaggggatttagaaaaaccccccccccccccccggggtgggtttgggtccccttgccccccccctcaaaccctttagttttagcccccccccgttgggttgggccggggcccgtttttttttttgggccaggggggggcggggcccccctcccccccccccccccccctgccccccccccttggggccggggggggttttgtaaacaccttctttttttttccccccattaaaaaagggggggggtttca

SEQ ID NO: 555107 - DNA, 808 bp, Homo sapiens
gataagacagttgcacgaccgctaggactgcaaggtgaaccgtgaacagcgtacgtatgcccagcagggaggttccagccagcatcacattttttagtccctctggcctcacatacaggtctcaagcacattcagggagtaatctggtgacaagtatcgatcaatattaagtttagcagtgcatcgggcccatgtacggactcgcgcgctggccgcccagggccttcctgtaagctgcactgcagagagaccccacgccagaagcgccgtggcctagctggcatgctaggagaggctctccagtgcgccactggacatgtggtgcctgaggtcatgggcatacatagacgacatgagccccaatggcaagacacatccctaggggcgtggatgcattggacatctggcatgcgagaccagagcatcgtgcataggtgctactcgtggagaactgcatgcccgtcagaactcctgcactcatatgcctgatgtggaaacgcaccgtgagagaccggggactcgggaaccttgacctgggggctgggcctcagtgcccacagtgacagcgtgacctggcccatctggtggacagccaagcttaaaaacccctagaccctggtgaagaagcttcctagatgacccaagacacggaaggaaagtcaaaattaaacacaacacttgacctacactcgtgtctttacctggacacaaaagaatacgcgaaaccacaacacagaaaacaaaagacccacaaggcgacataaattgaaaggaggaaggcggagagacacaccaacaagacgaatac

SEQ ID NO: 555108 - DNA, 407 bp, Homo sapiens
  misc_feature (6)..(6): n is a, c, g, or t
  misc_feature (24)..(24): n is a, c, g, or t
  misc_feature (98)..(98): n is a, c, g, or t
  misc_feature (118)..(118): n is a, c, g, or t
  misc_feature (124)..(124): n is a, c, g, or t
  misc_feature (158)..(158): n is a, c, g, or t
  misc_feature (188)..(188): n is a, c, g, or t
  misc_feature (241)..(241): n is a, c, g, or t
accggnactgaaatggtccggttntaatctaacaactttgtgctatttgatgcttattcattagatggtgtaatcagatgtatggccttagaagcagnttgaaagtgctactaatatntactantaatatttaatagcagcggatttagatccaaatncattgattccaagtggtagaagatgatggnggatctctattcactccctacacccaccatcttaattctaatggcaaagtagncatttaaaaaaccctgggggctttcacagtgcctgccctacctcatgaggtcagttcccaaattaaaatttgctactttactcagctgagagttagtagtaataatctattgaagcttaagtagtttttaaaccttttaatagtcacccctcttaacctcccactg

SEQ ID NO: 555109 - DNA, 806 bp, Homo sapiens
cttctataatagccatcctaactgaagtaagatgatgcctcactgtggctttgattagcatttccttgctaattagtggtgttgaacattttttcatatatttgttggtcattgtatgtcttcttttgagaaatgtctgttcagagcattgtttatatttaattagatgttgtgcttctttgctgttgatatgtttgaattccttgtatattcttgatattaatttcctgccagatgagtttatactttctcccattctgtaagttgtcttttcactcactttcttatttcctttgctgtgcagaagatttttagcttgatgtgatcctatttgtttattttttctttgttgcctgtgcttttgatgccttattcataaaatattttcccagagcaatgtcctgaaggatctcccctatgttttcttctagtagctttaccatttgggtcttatatttgggtatttgagatactttgagtttatctttgtatagggtgagaggcagaggtctagtttcattcttctgcatatggatatccagtttttccagcacaatttattgaagagactatccctttcccgcaatgaagtgtacttgggcatcttgtaaaaaatccgttggtgagatatgtggattttccggggtctttattctaattccatagggtctatgtgtctggtttaatgccaataccatgatgtttggggtactaaccagtttggagggtattctggaggcctggacctgattcattccgttgtcctttggcagaaggcttgggaaccaggacttggagcctaaatc

SEQ ID NO: 555110 - DNA, 1850 bp, Homo sapiens
  misc_feature (437)..(437): n is a, c, g, or t
  misc_feature (676)..(676): n is a, c, g, or t
ccgcctgtcgtgcgtacgtctatgagtacagtgagcaaacgagaggtggggagcatgcaaggttgactcgctacattacggttgcgtcgctacttatttgaaagtctagcgctccgtcgtgcttgttctgtgctctagcttcatgtggttgtgggttctgccgtctctccgtccgagtagtggttgttgcgtggtgtggttgttgtcgccactgcgcctcccccctgtgtggggtggtgttgcacaaaggggtgggtctcctcctccctcgtggtggtgtttttataatacggtggtgttatagggtgtgggtgggaacagcgctcgtgttgctgcatcatcctttcgtgagtagaagggcggatatatatgttgtgatgtgagagcccccccctgttgggggcgcgcctcccgctcgttgggtgtcgcgccggagntgtgtgttgggcaggacgccgcccgctgggatgacaaacaggggtgtggaaatagacgcgccgccattagttgtttcgaccggttgtagttatgacgcccccgagtgtggttgccccgcgacgccttatgttgcggaggagcttccctgtgggttcgtcttccctttgggcaacaacaggttgtttcaaaacaggggggccccccctagtggaaacccgtttggggagcagcttgcggngcccccagtggggaatagaattggcgaatctgtcggagtgttccctccctgtgggccacacaaaccgggtggtaaaagttctctgtatataacggacaactatacgcgtttgtggaagactgttgaggttgagggaactttccttgtggccccctctttgtagattggcccgtcctcggatggtgcagcaccacataatccgttgtgtgaagctgccttattcccatcgggagtcctctgcccacccacaacaatttggcggggagaaccttcggttcacacatagaggactctgtgcatttttcttagccgtggaagcttcgtggggagattcacactgtacccaacactgtcgttgaccacctcggaagcgggcgtaaacacccccttgtagaaagggcttgtggatgggcattcccttggcactttcgccacactgctgccaccgatccaccctcgggagagattacacagggcatgagaaattgagataggttgtgtacacagaaagggttggtaaaaagagagggagagcggggtcccccacatatggagagagatgacccctcttttggggatgatagagagcgtgtgaacaaggcgctatcatctcgcagagacttatagtggctccgcggggcacaaagagggtatgagaattttacacataggtccgcggaatacccgcacacttggagaagggtcggcctgacatgtggccacgctgtgacacgcacaggggacatcttgtgtgtgtgtgtcacctaatacattcgcaagcagggtgagaagagggcttactgtctgtaaagactttcgcggtgtattgggaccacactcactgttgcccgcgagagccccacgctccacattgatgaaacaacgcttctacacgcctggagagtcacactctgttggagaacctctgggccgcccccggacctggcggccacagggaggaacgaggtggaacctgggcctggtgggcgccccaacccctggcacgcacggagcccacccacgtccaagtgcttctgctcctgaatgtggatgacccacgaggcacattcccacgctctggcttaactggatgccctaagcaccaccctggttccccttgtgaacccttctgttccaaacttttgccatgcttaaggattccccacgactaaga

SEQ ID NO: 555111 - DNA, 344 bp, Homo sapiens
cagcggagatctccaagcgcagacaggtcctccttctgctccctcatgacctttgaggctcctctcaaggtgacactgactgagatgttctctgactgactgagatgttctcctggcatgcaaaatcatggataaacggtccaccaataaatacagtgcaacatacgagacatgaatatcgtccaaccatcagcatctcatcatgattgtaacctgtgcgtgatatacaactcttaaagatatgtggacaaaaagttatctatcatctttttacctttgccacgtcatgcaaatgtgagttcgccacatgataatcacccttcatcagaaatgggaccgcaagg

SEQ ID NO: 555112 - DNA, 116 bp, Homo sapiens
ccggggggccccccgggtttttggggtccccccggggggacccccccaggaaacccccctttttggggggggcccttttttttttcccccccgggggatttttattttttttggga

SEQ ID NO: 555113 - DNA, 130 bp, Homo sapiens
aggatgatgttagctggatttgtcgtatattcactttattgtgttgatttatgtcccttttatgcccatgttgtttaaggttttttttattataaaggtatgctgatttattgtaaatgctattttcagc

SEQ ID NO: 555114 - DNA, 245 bp, Homo sapiens
tgcggtgcatgcgagtgtacgacaacggggattgcacgtgatggaagagtgcgccctgggacaaggacctctgcaggaccacgatcgtggcgctatgtcgggcagacggagaagagctggagcatggtggagaaaagctgtacccactacagaggaagaccaacagggaccctgaagctcatcggactggacttgacagactcaccagcctttaccgagagttgtagtagtagggtatagactat

SEQ ID NO: 555115 - DNA, 629 bp, Homo sapiens
cacagtagctcaaactcctagattcaagtgatccttccaccttggcttgttgtacccaagcgagttagaaaaacgccacactttgagacaaattaagagtcttttattagccggcgacctagagacggctaatgctcaaaattctctcggccccaaggaaggggcttgattaacttttataccttggtttaggaaggggagggggggtctagttaaaacaattttacggaagttaagtagtcaaaaagttaaaaggacaaatggttacaggaaagtaaacagttccaggtgcaggggctttaagactattacaaggtgatagatccggggctttgggcgtttatcaatcggacgaattcctgggaactgcggatatagcttgccacagtatcttatcagttaattgcattcttggatgtgctaggagtcagcttgcaccaagttaagtccttgaggaaggggctgccactgaaagagccaagatggagtctctctggctctcttagctaagggagagtcaattcaggtggaaacaagactaggtgattacgggaaaagggagagtctaaaaacagagttagtaaataccaggttgggcattaccgcctcccaaagtgttgggatccagg

SEQ ID NO: 555116 - DNA, 209 bp, Homo sapiens
ctctactttcttgtagtctgatgccaaaatctatagagtatcttcatcagttccaaggcccttcatggcagcacgaagttcatcagcatcaaatagcgctggagtttttagcagactctaaaacaacctcctcaaggtgacctgtaagggcttgcttcagtgtatcatccaggggctttcctgtctcctggagatatgctgctttgatc

SEQ ID NO: 555117 - DNA, 889 bp, Homo sapiens
  misc_feature (881)..(881): n is a, c, g, or t
tgactgagcgagtggagtaagaaatacggagtgggacgtgtctttgtgtaactgctgccttgtcactccgctcaggcagtagcgagagctcacactcgttggctgacctatgtactgatgtgcatgatttgaaagctgggtgagatctgtgggaaatgtattatcagggatctgaacgttctagatgtctatagacatgagcaataattggggggaaagaaaggatgatgcatatcttgggaattcgaaatgagttgtactcagaatgcgatgaggcatgaattcgtggtgcctgtatgcatgggatcatcgctggacttagcggaaatttccagcaggggcgtaatgtaagagtggctttgtaaatgtaatggggcattccatataaagtctgctattgcccgagatttctatgataaatgctcagggaagagtgtatgatgtgatcagtgattgtctattcaagattgcagtgtcggttgttgaatactagatagaggttctgggagtttgtgtccattgatgacttgtgagacggaaattgtgcctgtctgatttgttaataaaagaacgtttaggggtgaaaggatggattctcagagtgatcccatggtaagtatggattttgtgtcaaactcagcgtattttttggttggtgacttagttaataagatttcttgatttgtgacttcggatgaggatagggctcttgaatgctgttcggggggtcaggggagacgtgaaagaatgggtgggcccctaaggtggaaggattcagggaaatgttggtgccttatagcacaagtagagggttttgacagaagtgtattacgaatgtgaaattaatatgatatagaaggttatatagacaaagataaaanatataaaa

SEQ ID NO: 555118 - DNA, 433 bp, Homo sapiens
tggacgacaatcatataaaacaaaagctttaacactgattactagagaagtgcaaatcaaaaccacaataagataccatctaacaccagtcagaatggctattaataaagagtcaaaaaataacaggtgtggcaaggctgtggagaaaaataaacacttatacactgtcggtgggagtgtgaattagttcaaccattatggaaaatagtgtggcaattcctcaaagatctaaagacagaaataccatttggcccagcaatcccattactgggtatatatccagaggaatataaatcataaagacacatgcacacatatgttcactgcagtactactcacaatagcaaagatatgaaattaacctaaacacccatcaattacggactgaataaagaaaatgtggtgtatatacacaatagtcgtccaaccaata

SEQ ID NO: 555119 - DNA, 381 bp, Homo sapiens
  misc_feature (23)..(23): n is a, c, g, or t
  misc_feature (29)..(29): n is a, c, g, or t
  misc_feature (39)..(39): n is a, c, g, or t
  misc_feature (49)..(49): n is a, c, g, or t
  misc_feature (79)..(79): n is a, c, g, or t
  misc_feature (85)..(85): n is a, c, g, or t
  misc_feature (91)..(91): n is a, c, g, or t
  misc_feature (152)..(152): n is a, c, g, or t
  misc_feature (165)..(165): n is a, c, g, or t
  misc_feature (199)..(199): n is a, c, g, or t
  misc_feature (220)..(220): n is a, c, g, or t
  misc_feature (289)..(290): n is a, c, g, or t
  misc_feature (301)..(301): n is a, c, g, or t
  misc_feature (310)..(310): n is a, c, g, or t
ctgtaggaattcggcacgagcgnctctanggacacagancacagagatntgggtctcagacccatactgagtgagttgnagacanttacanggactctctgtgcacccttgaagaggccccgtgaaggaagcagtgaggagcttttgagtgntgacctgtgtcgnaccaccccagaatgtgcactgggggctgtgccanaagcctgggggggacccttanttcccttggtttttttggcttcctggctaacattctggtattttttcctggaggaatattatgaagcgnngtcttgagganctttcctgngctgtgggtcttgggcctgaagaacaatgactggtgtgggtgctgcggcaacgagaggctgtgggagcgtt

SEQ ID NO: 555120 - DNA, 352 bp, Homo sapiens
agtgcagtgggattagtcaccattgaaacagatagagaggcatgtaccgaagcatcagaggtggagctctcagtaaatacagtcactggggctgctacttgtagtaggagtagtgggaacacttcggacacctgactctatcttcatgagctaagaacaggggtgtatcatacattcctaaacctccttaagaagcaagctggccaagatcagagtgaatagaacttgtacggtggcatatacttcggtggcccaaaaccggaatctaaggaacacagacaacctgcggcgaatgaattgcttccacaaatccatcagtaacgatgtggcaccacaagagttggagtacttg

SEQ ID NO: 555121 - DNA, 230 bp, Homo sapiens
ttctttcatcctcagcatgtccttgttttcaatccagtaagtgtttttcacgatgccagctgctacacagtgctgagaagtcaggcggtgactatgataaagaactaacgttttgggatagtgtgatcgtgaagatcaactggtcaaatgaagattcccaatgcctcagccagaacttagaatatctagcggtcacggtgactacggaatttgcatatttacacgcaagc

SEQ ID NO: 555122 - DNA, 141 bp, Homo sapiens
taagtgaataaaaaaggggattaaccatgtaggatgggttgaacttgaacatccagggttgatgagatccttgcaaaacactggggttatagaaccatgctctaatgaacggatatttactgtatttttgtaaaaggaaaa

SEQ ID NO: 555123 - DNA, 368 bp, Homo sapiens
  misc_feature (60)..(60): n is a, c, g, or t
  misc_feature (90)..(90): n is a, c, g, or t
  misc_feature (112)..(112): n is a, c, g, or t
  misc_feature (145)..(145): n is a, c, g, or t
  misc_feature (157)..(158): n is a, c, g, or t
  misc_feature (161)..(161): n is a, c, g, or t
  misc_feature (165)..(165): n is a, c, g, or t
  misc_feature (170)..(170): n is a, c, g, or t
  misc_feature (180)..(181): n is a, c, g, or t
  misc_feature (215)..(215): n is a, c, g, or t
  misc_feature (228)..(228): n is a, c, g, or t
  misc_feature (231)..(231): n is a, c, g, or t
  misc_feature (233)..(233): n is a, c, g, or t
  misc_feature (245)..(245): n is a, c, g, or t
  misc_feature (247)..(247): n is a, c, g, or t
  misc_feature (252)..(252): n is a, c, g, or t
  misc_feature (266)..(266): n is a, c, g, or t
  misc_feature (270)..(270): n is a, c, g, or t
  misc_feature (280)..(280): n is a, c, g, or t
  misc_feature (287)..(287): n is a, c, g, or t
  misc_feature (292)..(292): n is a, c, g, or t
  misc_feature (296)..(296): n is a, c, g, or t
  misc_feature (299)..(299): n is a, c, g, or t
  misc_feature (304)..(304): n is a, c, g, or t
  misc_feature (307)..(307): n is a, c, g, or t
  misc_feature (313)..(313): n is a, c, g, or t
  misc_feature (324)..(324): n is a, c, g, or t
  misc_feature (331)..(331): n is a, c, g, or t
  misc_feature (337)..(337): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (356)..(356): n is a, c, g, or t
  misc_feature (362)..(362): n is a, c, g, or t
ctggtgttcatttcaaggccagtgttcagcagcagggtttggaaagcaggttttgtgggnccccccgccccgccccccgcactcctttanagcagcaggagggggttttccntcctgttttttgcaacattttatacaaaactgngctgtgcccctnnggnaggnctggntttggcaaanngaaaacaaatgaaaccccttttttttttttccgncccacaactttgnagngntttttgcccccntnccccnttcccccttttggntttnattttaaagncaggggnctgcnaggnagntggangcnagatanatactatattnaactggnctgttntttaanangnaataaagcngtttgncctgga

SEQ ID NO: 555124 - DNA, 196 bp, Homo sapiens
cgcgagtatagcgggctcaggaatatacaacagcatgatctttgcgaccaaatccagcaaccacgaacttcatacatatttcctacaataaagttcaagcaaccgtcatagagtacaaaggctgtgattttctatgccatatcttcccgcgttaaactacgcgtgtaccgacgctcgcaatatcgtaactcatagg

SEQ ID NO: 555125 - DNA, 867 bp, Homo sapiens
  misc_feature (705)..(705): n is a, c, g, or t
gagcatgccctgcgcctcagcccgcgcgctcgcagttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtctgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgacgaaaaggtgatgccatgattatggaagaacacagggaaaatcttcaagaacagacacaggacatgacgaaagggtattgcttttcccaccagcatttcggtaaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaacctggaaatcagaacacacatagtgacngaagcctggaacaaagtgtgccactcatttactgccgccaatagaaggtatgtgtcacaccagttgaagcagcatgtctcgatggggaaaaaagcattatccagaatcccaagaccagcagaagaaggaccatgagaaagtggatttgaggtacatgaggaa

SEQ ID NO: 555126 - DNA, 742 bp, Homo sapiens
  misc_feature (580)..(580): n is a, c, g, or t
gagcatgccctgcgcctcagcccgcgcgctcgcagttctcgctctcgcctgcctgcccgctcccttgcttgctcgcgctttcgctcgccctctcctcgaggatcgaggggagaggacctggtcgtgaccaagtataagatggggggcgacatcgccaacagggtacttcggtccttggtggaagcatctagctcaggtgtgtcggtactgagcctgtgtgacgaaaaggtgatgccatgattatggaagaacacagggaaaatcttcaagaacagacacaggacatgacgaaagggtattgcttttcccaccagcatttcggtaaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaacctggaaatcagaacacacatagtgacngaagcctggaacaaagtgtgccactcatttactgccgccaatagaaggtatgtgtcacaccagttgaagcagcatgtctcgatggggaaaaaagcattatccagaatcccaagaccagcagaagaaggaccatgagaaagtggatttgaggtacatgaggaa

SEQ ID NO: 555127 - DNA, 481 bp, Homo sapiens
cagctcgcaccccagcgccactaacctcatgagtagctgggattacaggcttctgccaccatgcccggctaatttttgtatttttagtagagaccgggtttcaccatgtttgcccagctggtctcgaactcctgagagtttcgacagggtgatccacctgcctcatccttcccaggtgttgggatttcacgcgttagccaacagacttggcccaaaaagaaaatgtgtttcgaagcactagccacaccagagctattcaagaaaatgtcttctttctcttaggttcttcttgggttggcgcctgggacaatgggtagaataaggccttttttcattaattttaaccttcagaatgttaaagccttctaagaatattaattcatgatcttttagggcacccacataaattgctgatttgctgagatgatgacatccaagcgccaaagagtcgtcgaccttcgtgggaggaatcacatagtgc

SEQ ID NO: 555128 - DNA, 275 bp, Homo sapiens
aactgggcccccccagttgtaaaaaggtatgtttttccccccccgttatcccccgggtagcctgtccagttgagaagagtgaacccataactgggttttgttttaaaaattaaattaacccctgataagaggggctttttttttttaggggttggcccctgccccctagtttgatcccctcccccttttgggggccctgtttcccccccgggcctgttcctccccctgcctacctgggtaagggcttaaaatggaataaattgcttttttcccta

SEQ ID NO: 555129 - DNA, 1105 bp, Homo sapiens
  misc_feature (103)..(103): n is a, c, g, or t
agcggcctcggaccgtcttcccggacccttagcatgcatgctcgtggctctcgtagcactcagttgcgctttgcctgcgcgcactgcggagggcgcccttaangggtcaccgctaagcactacttggcacgttaaacatgacacagatagagcgaagcttcgttatcgtgttctgtaggcgtcgagactcacatatgcggtgcgccactacagttctccgtgaccacctcccgaccccaatcgctagtccccaacgacttgggactccgggggcgagactgaagcggaatgagggtagtcacgagtatatcgtggacgtacccgttggctcctgaatccggagaagaagcaaaggtcgctcgtagttcgctcagcatcgcgtgtctcctgtctacgctttccccattcacacgcgtttgtgccgccaggcggcacctgctctggagggccagcacatgcgtaccacggcgtacgtctgtggatgtataatggcaaaaaggcgaccggagctcgcgctggagaaggctacgggatactgacggaagatctgtaccccacaaccggggggcgaccgttccggggttaccccccccaaggaacccacccgggaacaggccaaagaattcccttgacaagggaaggttaccaagtccaaccttcaaggggaaagggcccgaacaaaagccttgggaaaaacgcagggggggccccccggccggggccccagccgaggaccaaccccatttcgacccaaaagccgaccgggttgttccttagggcagggtctcggacagggcgcaatccaaaggttatccgggcaaagaaattgcagggtggtttctttggggaccggtccattaccggaagatactggttctgaaacgcgtcttttggggttccaaagaccggcccaaaaacggaggccgagagtggttcacttgggcggcaaagacggaaggacataccggtaggagggggcttcccgattcacaaaagaattggcccgagaagttcctttccccctccttccagggggccgatttgcccccagaagggcctttggcgcgcccttggggggcccttccaaacagaagcaaagggttcc

SEQ ID NO: 555130 - DNA, 233 bp, Homo sapiens
  misc_feature (1)..(1): n is a, c, g, or t
ngtgatctagaggatcccttcagcccatgaagtcttaaaaaaaaaagggatcctattacccaccatacttagtctggcccgggattgattttacaaaagccagacaaggggatacagataaagggggttaaatacggagattaatcaacatggcccttttccccggccaagggctaatttcctagaccggcttcactatgactactaatggtgcggaaggggtcccggaggct

SEQ ID NO: 555131 - DNA, 392 bp, Homo sapiens
gcagggcatagcgtgcaggcaccatgagctcaggaacacaggacagaccggttgtccaagtcacaacggcacatgaagacactgggcccaggacagcagctcttaatccaaaatggtctcaagaatcctttacactctgaaaaataaaccctctttatgcctgaggtagcaatttttatgtaaacacatcagaccttggcgatgaccttgagctgtaggacctaaataactcccacaagcttagggtgccactaatggaacactaggcataaatgcgttttcctgcggacccaaacagctttcgattatgtgggcgtcctagcctgtctacgtgcctgtgtgtgtctatataatttttctatattctatattaccgctgagacatttacccc

SEQ ID NO: 555132 - DNA, 264 bp, Homo sapiens
tggggttcccccgggggttttgccccccggtgggctaagatggggccaggtttgggggttgttttttttaaggccaccccttcccggggttttcccggcccatggaattttgtttttagaacccaagggtttttacccaaagggccgcttgggttggggggtcctgcccggtatcccccccccttgggggggccagggcgggcggtccctttagggccgggggtccaggccccgggggccccctgggggaaccccggttttcca

SEQ ID NO: 555133 - DNA, 595 bp, Homo sapiens
attaacccaaagtcaatagaaagccgggcgtaaagagtgttttagatcacccccccccccccgcggaataaaggtaaaagttccctgggttggaaaaaactccagtttggacccaaataaactacgaaagggggcctttgaccacctatcttgtttagaaccccacaacaaaaacgctaaagaacccacaagtgtggggattacgaatatcccccacacatatatgtcctatatagtccccctataacaccgttcacaccacgttttaacatatctacaaccacaaacacgatgtgttcactctgctcccaagagtaaaaggacccctctgatgcggagagagccgcgcaccaacaggcgcgtttattaaaacacagccgcttcctacagaaagaggggaaacacccgcctggttgtgcggccggaggatggatggtgggcgcaacttcgtcctcacgaatttaattatccttcgcctccccgcgcccggcctatcgatgtacctttgaaaatggaacgaaatgcagaggtgctcgatagtaagaccgacccgccagtaggaggccatcagaagcccacacgctggggctgacaa

SEQ ID NO: 555134 - DNA, 1201 bp, Homo sapiens
  misc_feature (276)..(276): n is a, c, g, or t
  misc_feature (419)..(419): n is a, c, g, or t
  misc_feature (465)..(465): n is a, c, g, or t
  misc_feature (486)..(486): n is a, c, g, or t
  misc_feature (643)..(643): n is a, c, g, or t
  misc_feature (672)..(672): n is a, c, g, or t
  misc_feature (687)..(687): n is a, c, g, or t
gagccaaagagaacaggcgctccgagaggcagaaccagtacccctgctcgccagtctcgcctttcctaaaagagcagtgtctggagttgtgctgtttcccgactccccagcctgcatgtccagcccagtgggagacagggccttctggtgcagtttcccaatgatgttccgtcgtcgcacgtattcgtcgcgatgggatctacctattcatacatttgcatgattcgctctgtaagtagtagttaccagtgcctataatcgacgccaacaagagcncattacctaccacgttaatggattgtggtcatgggtggtgcggacgattctctggtccgaactcccttgtgctatggacagggacactagtatacataccacatggaagctcaggtagcatcctaattttaaacttatccgcntgtgcaagatcgtgtgacattccatcgcttcactctctcagctagnggagagaacactctcctctgntgagcagagtgaggcccgtcaatcatgcgaggccactatatacaaggcctttccaagcgtgtgtattcccatctccatgggcaagactgaggtacctcttcctatgagagtctcgcttcttcatgtacgaggcctcaggctggggtaagggtcgtgntccaaggacaagtgtcacggatatctcgnatacgagaaccaaanttccactgacaacagtattctacttcacttcattcagcatacgaacccagtaaaccccatgtggcgacatccagacatgatctttgcacagtcctaaaacgaactggctggcttgtgacacacatctattgcgatatttcgcaaatacacgacatctcacttgttccgtcttacggcgtcttgggcttacgattctcgtgtatattattccccgtttatagacttagagtatagagattcaattctacatgaaatgatggcagcagagggccttaaggttactagggtaaattgagctgaatggtgcagggaggactgttgagcaagggagcctaagtgaccagaaagcctgacacagaagatacgtcacgggactactatccttacacagggaactgcggcccctggggggtcaacaagccccctggcgcgcaccggcagctcacaaccaggagtctggctcgagacacacagtagcggccagaccgagggccccgacggccaggaaacacag

SEQ ID NO: 555135 - DNA, 128 bp, Homo sapiens
aatcgaggaaggtatgataatcccacaccaatattttgggatttcttggaaattgacccaactctccattctaataacatctccattccccaggaactgtacgaaaggtgctggagccacagtaacga

SEQ ID NO: 555136 - DNA, 240 bp, Homo sapiens
tgtaggccagcgcatcaaaattgacacctgaaattattgttctaattgaaattgtgttcccatcactgctcagcccattgttaaaatgctacatacataggtcagaggttctcattgttggctggctgcgtatcaagtcacctgggaaccttaaaaaaaatctgatatcccacctctaggaattgggatgtgtttggtcccgctggcctacagcacatgccggtaccgagctcgactcac

SEQ ID NO: 555137 - DNA, 384 bp, Homo sapiens
gtcgaccccgccatcactgatcaccagcgtcaaggttttaccacgtagatccggtgcgctgtccccccaaccatcgctgaccggtacccgcgctaacatgcgcacaccgtcgcgactcacctttggcttgccgaggtcagcatcttccagggtgtcgaagaacagttcaggctgctgccaaccagcgtcacgctcagtgctgatttgcagttcgccactctggtagccggccttaatactgtccactaacccatcagcaatcggtacctgccccatcgcttgggcaaaatcatgggtaaattgcgcgtcagacggcgtgccaagatccaggctgaatggatagtcggtcaagatacagacgttgctgcaagttgacgtcgacgc

SEQ ID NO: 555138 - DNA, 117 bp, Homo sapiens
tgtcaaggtcctaggagttgtgtaaggcccggacattgtgcagcttgtgctgtagctttaacgaacactagaacaagctacctattgagttgtgccccttggccttcccatatgcaa

SEQ ID NO: 555139 - DNA, 226 bp, Homo sapiens
gaaaaaccgggggtttcccgattgggggggggggggtttaaaacccccccctcggggtttaacccccccgggccccccaaagggggggggttaagggggggggccccccccccgggccctgggccccttttaaaaaaaaaattttttaaagggccccaagggattatttaccctttcccgggggttgggggtttggggattaaaacccaaaatttcggcccttgga

SEQ ID NO: 555140 - DNA, 91 bp, Homo sapiens
  misc_feature (19)..(19): n is a, c, g, or t
  misc_feature (68)..(68): n is a, c, g, or t
acctgcccagacctaaganagtacctttaaggagtggctggagaggctctttccatcttctttgtcantctagccctgcgctaggcctctg

SEQ ID NO: 555141 - DNA, 117 bp, Homo sapiens
  misc_feature (2)..(2): n is a, c, g, or t
gntcagactgtgagcatatatgcatggggtacccatctgagtcagtaatgactatctacagcgtgtatggcaaatcatagaagcgactgcttgacagatacgctttgattgctcgat

SEQ ID NO: 555142 - DNA, 219 bp, Homo sapiens
  misc_feature (85)..(85): n is a, c, g, or t
  misc_feature (87)..(87): n is a, c, g, or t
  misc_feature (194)..(194): n is a, c, g, or t
ggaactcttaatttaaatgttggaaacctagagtgcacttatagaattaaatggttagcaaatgcattggcagtggggtgtttangnaaatatgcatttttttctggtgaaaagtctataactttcatctcatctgaaaaagtttttacctagaaaagttgaattcttaccatagcctgccctctgtgttgttnttttacttgggtacaatccatttcc

SEQ ID NO: 555143 - DNA, 115 bp, Homo sapiens
aggcccctccggaacactgtggcgtgatggccgcgggctctccagaacatcatccctgcctctactggcgctgcaagggctgtgggcaaggtcacccctgtcgggctagtcgggg

SEQ ID NO: 555144 - DNA, 700 bp, Homo sapiens
cccgccggggtggtccttctctgggttttttccctcctatcatgcacgccagggttatctattgtgcgaagattaacacgccctgcagggggcgccacttctcgttctggtgtcgtatctactgcccgctcgcgtgtgacttacgcctgtgcgtgtgtcgccggatggacacacgcggggggccccgctctatcctttcgcgcccctctcgtcccggggctgcccctgcgcggtgttgtctctgtctcgtgtcgaccccccccctcgttggggaccttggtggcgggcgtttcggactgcacatacgttggtacaatgtggtgtgtgactcgctgcgctcggcggccccggctctcgtgtgacaccgctctctgtgtgaggtgtgtgccctcccccccctcgtgtgtccctctccctcggcacgtatactggttgttcgccggcgcactctatatgtattcgccgcgcgctgtccatctctctctactcctcgccactctatttgcctcgcgctgtgtcgcgctccgccaccaggactccacacaattccacattgtgggcacacactccatttctttttctttctcccgctactattgttccccatgtttttcttcttgtagcgcacctcacttatctctcctcctcctctctactaaatatgataataaaacacaccacaacaaatatcaaacaaaac

SEQ ID NO: 555145 - DNA, 165 bp, Homo sapiens
  misc_feature (76)..(76): n is a, c, g, or t
tgacgcattctcctgcgtcatggatacaaggtctattaatcaccttcggttatctcttgttaaagatcggcttcanattattttaatcacctacaacttttaaactaaactttaagcttgtttaagtcaccttcattttagtctagaccgcctctgcagggtacc

SEQ ID NO: 555146 - DNA, 244 bp, Homo sapiens
taatcccactcatttaacgggcccctgtccagctccgtatttgtgacatactcaggtagaaacttagaaatcgcaatctcttatactctattgattgttgatcatattaaagtttgcagtatctgtcaaatagagtagccatggtcttgcggtgtagctcaggcatgaactcctgggctcaagcaatcctcccgccttggcatcccaaagtgctaggattacaggcgtgtaccgctatgtctga

SEQ ID NO: 555147 - DNA, 308 bp, Homo sapiens
gctcctagacggactacagatgaaaatcgatatctttttcaaataataaaatttctgagatgacagcagtgcattgaggggtcccatactcatctcccattcttctgtcattcccagtcacatgaacatgctccaataaagatatcttcttttacagacgccttggcgcgaagtattagtgaactttccaaggtaactgtccatctttaaatataaccagtgcatttcattcaggtcgtaacaataatctggtcatttataaacaataaaatcccctcaagcttcacatcctccacaattttctttcc

SEQ ID NO: 555148 - DNA, 258 bp, Homo sapiens
ggagtttgagaccagcctggcaacactgagagaccctgtctctacagaaaaatattagctgggcatggtgatgtgtgcatgtagtcccagttactcatgaggctgaaataggagggttgcgtgaacctgggagatggaggctgcagtgagttgtgatcatgtcactgcactccagcctaggtgtcagagtgagattctgactcaaaaacaaaacaaaacgaaaaatttggtcgaatctgtagatgtagaacctgggga

SEQ ID NO: 555149 - DNA, 168 bp, Homo sapiens
gcctggccgcaagagcttagtatactagtacacaaaagggctcaacagtccgcttccccatgcactttatgaaacaggtgcaggactaggaaaagggccacattagttaaaattactaactgtacagaaatgatttaaaaaagtcacagctcaaaatcgcgctttggc

SEQ ID NO: 555150 - DNA, 2484 bp, Homo sapiens
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtggggacaagggtgtgccgtggctgaaaccagcgtggtcactgtgtggctggcacggcctgcacatgctgcaggagctgctcgcagtaggtggccgagcggtgcttgtggatgacggcctccgtctccctcaccaggagatctgggaacagcccgctgccctctttgaggacctctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgtctccgctcccagcgcgagctcccgctggctgcacagacacttccgcccggaccacgtgtctgccctcccagcgccagctcctgctcgctgcaaggatacttccgcccgggccacgtgtctaccttccaagcacgagcgctcctgctggcggacacttctgcccggagccacgtgtccgccctcccagcactagcgctcctgcttgcagcagggacacttccacgggaccatgtgtctgccctcccagcgtgagctcctgctcgcagcagggacacttccacccggaccacgtgtct

SEQ ID NO: 555151 - DNA, 838 bp, Homo sapiens
tccatcgctgtcacatgcctgggatgaagcctgatcctactgcagggccatgagctgtgtccattactgcagattaggtataacctgcgaagtgagacctcctctttacttgtggccaaggaccctatctgtcaattgtataggtactctgtgaattggtgagacggctgtggcacctacatgggccatacctggagctgtgatggtgtgtggactgctgacttggtgacaccatagcatgtcctcacttggctcagctgacaacatgctgtcgtcatcatgggactgtgaaacaggacaagcagctggcccattctcaatgaccaaattcggctgtccggacctgcggttttgacttagggcggcaacatcatcatgtactccacggacaagcacgatgggctaccagtgctatgtgagcttctctgacctgcgcggatccgagccagattgacaacaatgagccctacatgaagatcccttgcaatgactctaaaatcaccagtgctgaatgcggacccctggcggacagcggcatcatcgctggccatgagagtggagagctcaaccagtatagtggccagtcaggagaggtgcaggcgcacggcacaggagccactcccggcagaatcaacgaccatcaagaaaacaggcacctgaccaatgacgcgaaccgcgtccacagccaaaacacggcacaggcaacggaccccacaaccctgacacacctcgcaacatctacggagacaaaagctcgaccacaacaagagccctaaaccccaacaatgaaccgaaacaccgagacggggacagacacccaatatcacaccccacacaa

SEQ ID NO: 555152 - DNA, 406 bp, Homo sapiens
gcacgaggagagttagagagagagagagagagagtgagagagagttatagctagagcgtgttccacctcgatttcgttgtttctttccttgattcatcactctcttcatcctctccacttctactctctttggacatacctgtcatactccttcaaggctgttactccacatttcacgtgattgagttattgccaattctgttaccatggtaatccatgtttctttctcatacctatcctttattcctcccactgtatcttttttgtccatatctccccttgactttttttatccctctatcccttcttcttccacagtatgctttactcccatcactttacttctttccttccatcacatcctagttcttttccttcctctgcctttctctttgtgattttcttt

SEQ ID NO: 555153 - DNA, 776 bp, Homo sapiens
  misc_feature (260)..(260): n is a, c, g, or t
  misc_feature (263)..(263): n is a, c, g, or t
  misc_feature (267)..(267): n is a, c, g, or t
  misc_feature (273)..(273): n is a, c, g, or t
  misc_feature (366)..(366): n is a, c, g, or t
  misc_feature (381)..(381): n is a, c, g, or t
  misc_feature (419)..(419): n is a, c, g, or t
  misc_feature (421)..(422): n is a, c, g, or t
  misc_feature (432)..(432): n is a, c, g, or t
ggggaaagcactgtcgtcacgacttcccgttgccgacatggatcactgcgcctgttgccttcaaatgccgctcacacggaccttgtcagttcttgtggcgaaatggtctgcatcaggggcccgatcagagactccgactgcatgtggaatgctcgggcgtggcctgcgccagggcggcggcgcagctgcagctctcgcggcgcacggcggcgaaggggtcgagcagggagcagcgcagcgcgcgcagagcgtcgtccagntgnggcncgagcncggcgccgcacaggtccacggccaggcccagcagctgcacaagcgccaggcgcagctcctcacaggcctcgggcgggcggcgcgcgggcacgnggccggccaagcgcncggcgagcgcgggcagcaggcgcggcagggcatcgcgngnncgcgcggcgnggcgcaggcccagatccagcaggtgcactgccagcgcgcggcagccctcggcggggtcgctcaggcagcgcagcaagcgcggcagcagtaggcgcgcccaggggccctggaaagcggtggggtcggcggcagggcctggctcctccagcgcgcgccgcagggcctccaaggcgcgccgccggcccggcttgctgtcggcctccagccccggcagcaggcggctcagggcgcggctcagctccaccgcctcagccgtctcggccccctcagccgggtgtggggccgccacggcctccgccacccccagcgccgccatcttgcccgcgtcagccggccaccccgct

SEQ ID NO: 555154 - DNA, 219 bp, Homo sapiens
gacgactcctcgactagccgacagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctgtcgggctagtcggaaggatcctctaagcaccagccaatc

SEQ ID NO: 555155 - DNA, 373 bp, Homo sapiens
  misc_feature (367)..(367): n is a, c, g, or t
gaggacacctttcgggaagagcggtggcccttgtcttggactgtggctgtgggggcgtgggccccgggatgacctgtcctcatcctcccccgacagagtccctggagaagtgggagcgtctgaccgtggcggatgcgctggagcccgtccagtttgaagatggagagaaaatcgtggtccagggagagcctggggacgacttttacatcatcacggagaaaaatttgccgggtgtggtggcacatgcctgtaatcccagctacttgggaggctgaagcaggagaatcgcttgaacccgggagatggaggttgcagtgagccaagatcacaccattgcactccagcatggacaacagagtgagattcngtctca

SEQ ID NO: 555156 - DNA, 140 bp, Homo sapiens
ggcaaatcatactcaggaggtctattgtgaacccatatttcagcatgcttttgaaaaagggtaattaattttcctacccgacactgaattgtagggttgtgaaagaacattaaaatgaagacaaatttccccgtgggctg

SEQ ID NO: 555157 - DNA, 311 bp, Homo sapiens
ggccgaatcatcacgagtatcatactttaaaacaagatgtaacatatatacaagtattatttgccaattacaatacatacatttaaaaatattttagatattgtgtccattttggtttcaagtttactaggcggtcattttattgttaagaaattctaggtagttttcggctgggcacagtggttcatgcctgtaatctcagcactttgggagcctgacgtgggtggatcacctgaggtcaggagttcaagaccagcctgaccaacatggtgaaaccccatctctactaaaaatacataaaattagctggg

SEQ ID NO: 555158 - DNA, 2573 bp, Homo sapiens
  misc_feature (42)..(42): n is a, c, g, or t
gggcggcgttgggggtgcagcatgcttgctgctgcggcgcgngggggcgggcgtggagggcggcgccgctgcagtgcggggacccgctcgctcgctcgccagccgtccccgcgccccgcgtcccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtacaaaaaaaaaa

SEQ ID NO: 555159 - DNA, 2478 bp, Homo sapiens
gtgagtgagggccaagcaggaacaggggtcacggggcaaggagcacgtggcagcgcaggaaatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtacaaaaaaaaaa

SEQ ID NO: 555160 - DNA, 1200 bp, Homo sapiens
  misc_feature (197)..(197): n is a, c, g, or t
tttttttccatgtttttttttaaacaatggaagtgtcaaaaaatagggtcaactgtgtgtttagacttaaatttacatttaatgtgtattattgctgcacgtgaatgtggaacctttgtgtattgtgtaatttatcattagagaaagcacagttgtgcatctcatatttagtgcgcaatttatccctcaagtgaaanatcttccagagtctccttttatatttgtgtggaattatctccgtgttaaaccaatctcaaacccaccagaaacatgtgattgtgtaccaacagttaaaatgtgttcctcttgtacatttaaaccgtgaagatttctcgtgttataattaaacaaaagaaaacagtgttaaggaaagaggtgtactttagaagccctctttactttctcatagagttccgagaaaacacccttagaacaattctcagagggcattcttataatctctctcccattctagagaaaccaaacaaaaagaattaattttgtgtgctcatgtgcgtgttaaatctccattcattatatgtggattaaacaccgtggtgtgcaaattgtgggtctcaaaggtgatctccaaaacaaaacactgtgattgtctccaaggcgtggccattattgggggcaaccataatctcgcgttaaaccgtgggtgtggtctccacaataagcacgaagcttttacaaagatatctctttccccattttttctatctctggtgttctctttttcacccagagggttttctttgaaaagagtttccctggttgtgctccctaaaaataaacgtttgttaaggaagtcttcccccaagtttgggagttatactcaccatccatccggaaatctgaaacgcaaacgcgtttttgtgttagacccccttcgcaaaaattttcccttgtttgggtcggccgtggtggggacttttaacccaaaaaagtttgctcgttcatttataccacaactatagggggctccatgtagaggagccccgccttgtggggaacagctcacccagagctattcaagagaagagtcactatatctaaaatcattgttggagaggacatgtagattatcatcttgtagagcacatttcatatcatcataagacacagcggtggtgtgccacacaaattcatcacaaatattcaacaaactatgttctgcaaactgtataaggagca

SEQ ID NO: 555161 - DNA, 2670 bp, Homo sapiens
ggggaaagcactgtcgtcacgacttcccgttgccgacatggatcactgcgcctgttgccttcaaatgccgctcacacggaccttgtcagttcttgtggcgaaatggtctgcatcaggggcccgatcagagactccgactgcatgtggaatgctcgggcgtggcctgcgccagggcggcggcgcagctgcagctctcgcggcgcacggcggcgaaggggtcgagcagggagcagcgcagcgcgcgcagagcgtcgtccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtacaaaaaaaaaa

SEQ ID NO: 555162 - DNA, 2496 bp, Homo sapiens
  misc_feature (42)..(42): n is a, c, g, or t
gggcggcgttgggggtgcagcatgcttgctgctgcggcgcgngggggcgggcgtggagggcggcgccgctgcagtgcggggacccgctcgctcgctcgccagccgtccccgcgccccgcgtcccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtacaaaaaaaaaa

SEQ ID NO: 555163 - DNA, 175 bp, Homo sapiens
aaggctacctgtgagagatctttaaggcgagctcgggctactggcgcgggctgtataacgctgtcaggtgggtgcgctgaagggcggccacgagaacggagcggaagctagctaggaggttgcggaggccacagctcttccctctgcccaggtggttacccagggatgataccgc

SEQ ID NO: 555164 - DNA, 2200 bp, Homo sapiens
ccggtggaggacgtgtgggcgcggccggtggaggacgtgagggcgcggccggtggaggacgtgagggcgcggccggtggaggacgtgtgggcgcggccggtggaggacgtgagggcgcggctggtggaggatgtgtgggcgcggtgctggtacttttacaatgcttcgtgaacctgctgtccgtagctctgtttcacagatggggaaactgaggcctggcgattaagtggcctgctgaaatcatccagctatgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtacaaaaaaaaaa

SEQ ID NO: 555165 - DNA, 2482 bp, Homo sapiens
agcggggggggaggagccggcggcgcgcgcctccctgggcccggactcggccgcctcccgccgcctcccgcgcggcatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggaggtccgaggcctgtgtgaacggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtacaaaaaaaaaa

SEQ ID NO: 555166 - DNA, 736 bp, Homo sapiens
aacagtcgtatcaacgcagagggcccattacggccggggcccgcaaggtcgctttgcagagcgggagcgcgcttaagtaactagtccgtagtccgagggtgcgccgtgtcctttgtgcgttggtaccagcggcgacattgacggggtacactccggatgagaaaactgcggctgcagccagcttgtgagagctgagaaaggcgatggcctgaaggaccaggagcttgagccctcgggaagcccgggtgcttggccccccagagcaacgatgggggcctatggagaaacttctgggaaacttaacattttggggaggaataaattccccttgggacggcacccctgggtccagtgggggttatacaaaaaagaagtatctgggtttacactccaggttactttgttacctggtctggatttatccattattaccttgcacgtatcatggtctctgaaaaaacccattattggcatagtttgaaaaagaaggtccaaggaatattcccttgggtggattacaacttctggaagactgggagaaagtaatttccacccaagttgacaacgaacttttcctgggatcaaccattccatttacaaggatttactgttaccaaaccgctttacacacgggcttaatgaagacccttaagttggggtgccttattttttacccaataattttaagcggaaattttcctggcgacaaaggtaacttttacatacacggtttaac

SEQ ID NO: 555167 - DNA, 529 bp, Homo sapiens
  misc_feature (320)..(320): n is a, c, g, or t
  misc_feature (385)..(385): n is a, c, g, or t
  misc_feature (429)..(429): n is a, c, g, or t
  misc_feature (439)..(439): n is a, c, g, or t
  misc_feature (452)..(452): n is a, c, g, or t
  misc_feature (477)..(477): n is a, c, g, or t
  misc_feature (479)..(479): n is a, c, g, or t
  misc_feature (481)..(481): n is a, c, g, or t
aaactttttatttggtcaactgaaaaatatcacggttttttttccccttggcactcataacaggacgacgctaggactccaaacacacacggcatcaataacgtatcttgactaacgaggaacaaaagcagacacagttctagcattccagagagcggatgcttatgctcacattctaccagggcatgtggagagggcacacatagcttgagaaagtcaacctcgtttggcatcttctcatattctcacattgagtctcactaacatgctagaatagatacgtctctaccaagagcgtagaagagtgcagctcttagacncttgttgaactagcatgtcctacgtatgtagaaacacaatagcaagtgactgtcattatctgaanatatatatagtgtgagtgtgtgagggccatgagctgcaccattntgcgtgtggnggcaatcactttngtgtatgaatcgcgacaaatgatanantntccgtatgtacgtagcatcgaatatgacttgacaagtaagtaccacac

SEQ ID NO: 555168 - DNA, 142 bp, Homo sapiens
  misc_feature (88)..(88): n is a, c, g, or t
acctagcaggcacctcccaggcaaagcatgggcaagggggctgggcacgtgcaagcaaatcataccaagggtgttccagccattttcncccttccccatctttcctgggtcacgcagctcgcaattctgtcacatccatggt

SEQ ID NO: 555169 - DNA, 654 bp, Homo sapiens
  misc_feature (164)..(164): n is a, c, g, or t
  misc_feature (166)..(166): n is a, c, g, or t
  misc_feature (169)..(169): n is a, c, g, or t
  misc_feature (173)..(175): n is a, c, g, or t
  misc_feature (188)..(188): n is a, c, g, or t
  misc_feature (190)..(190): n is a, c, g, or t
  misc_feature (310)..(310): n is a, c, g, or t
  misc_feature (312)..(313): n is a, c, g, or t
  misc_feature (315)..(315): n is a, c, g, or t
  misc_feature (318)..(318): n is a, c, g, or t
  misc_feature (320)..(321): n is a, c, g, or t
  misc_feature (331)..(331): n is a, c, g, or t
  misc_feature (342)..(342): n is a, c, g, or t
  misc_feature (348)..(349): n is a, c, g, or t
  misc_feature (351)..(351): n is a, c, g, or t
  misc_feature (359)..(359): n is a, c, g, or t
  misc_feature (363)..(363): n is a, c, g, or t
  misc_feature (378)..(378): n is a, c, g, or t
  misc_feature (381)..(381): n is a, c, g, or t
  misc_feature (386)..(386): n is a, c, g, or t
  misc_feature (401)..(401): n is a, c, g, or t
  misc_feature (405)..(407): n is a, c, g, or t
  misc_feature (437)..(439): n is a, c, g, or t
  misc_feature (455)..(455): n is a, c, g, or t
  misc_feature (463)..(463): n is a, c, g, or t
  misc_feature (480)..(480): n is a, c, g, or t
  misc_feature (485)..(485): n is a, c, g, or t
  misc_feature (543)..(543): n is a, c, g, or t
  misc_feature (557)..(557): n is a, c, g, or t
  misc_feature (601)..(601): n is a, c, g, or t
cggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggnanccncccnnncccgaaacccccncncctccccgacccggggccggggcccctgccgccgccgccgccgccttccgacccctgcgccccggccccggtcccccgggccatgcagcctcggccccgcgggcgcccgccgcgcacccnannanatnannctccgcaatngcaccttcctnacgctnntnctcttctncctntgcgccttcctctcnctntcctngtacgcggcactagngtannngcgagttgtggagtttacaggggagttctnnnctgccgatcggtgcancagcgagnggagagctcagcgctcnaagantcacctggtgctggagagatcagagggccgtgtcagaacgcacgcgcgcgagacgagnggcactcgcactgngggcgctcacagaggaccccgatggagcgtggcacgctcacacnagcagtgctgcactgcccacgtctacatcactgcgacactgctggcaaagaga

SEQ ID NO: 555170 - DNA, 1140 bp, Homo sapiens
ggtttttgggaatgcgaggcagccgctggcggaggcgcattctcggggtggcgaggacgcctccgagggcggcgcggaggaaggacgccggctgtgcgcggtggtggcagcgcggtgcgccggggaatggcccggtcataacgtgcgctcactgcccatgacgatccccgatgtgtttccggcactgccgctcatcgccatcacccgcaacccggtgttcccgctgcttttatcaagattatcgaggttaaaaataagaagttggttgagctgctgagcaaggaaagttcgtctcggcccagccttatgtcggcgtctttctacaagagagatgacagcaatgagtcggatgctggtcgagagcctggactgaacatctaccacacggggacgtttgcccagatccatgagactgcaggacctttggggacaaagcctgcgcatgatcgtcatgggacacagaagagtccatatcatgcagacgagctggcaggtggagcccgaggagccggagggccggagcaacaagcaacaaggccccgcaggcaagtcaaacgcggcggcaacgaacggaggcggaggaccgagctgaggcgcctagggcacccgtgtggatgcttggcggactgggagccccaacccccttgagcttcccccgggcttgcgcggtgctcactggtgcgacggtcagacgaaacggtttgttccaccgatggactcttcccaggcttcaccggacggcagtgtgacacagcccttgtacctggcacacagtatccggctgaaatgacacccactcacggggaccattccatttgcccctgtgcacaccactcatccatacatcgcggaacgtacatgcttcgcctttgtcacgcaaatgtattgccggtgcgctgtggacccgacctcggggatcgtcgtagtggcaagcaaccgccccaagctcttcccgctggaagtgacgaaaatttgggaacgcacccgcgcggagcctcacatcggagcgtcaccgataagttccccattgcacggcttggacacgcgaacctccctggtgacgcgacgacgccgatgtaattcacctaagtcgtgacactgtatacacgggacctacgttccccgttacggcaaacagag

SEQ ID NO: 555171 - DNA, 583 bp, Homo sapiens
  misc_feature (164)..(164): n is a, c, g, or t
  misc_feature (166)..(166): n is a, c, g, or t
  misc_feature (169)..(169): n is a, c, g, or t
  misc_feature (173)..(175): n is a, c, g, or t
  misc_feature (188)..(188): n is a, c, g, or t
  misc_feature (190)..(190): n is a, c, g, or t
  misc_feature (310)..(310): n is a, c, g, or t
  misc_feature (312)..(313): n is a, c, g, or t
  misc_feature (315)..(315): n is a, c, g, or t
  misc_feature (318)..(318): n is a, c, g, or t
  misc_feature (320)..(321): n is a, c, g, or t
  misc_feature (331)..(331): n is a, c, g, or t
  misc_feature (342)..(342): n is a, c, g, or t
  misc_feature (348)..(349): n is a, c, g, or t
  misc_feature (351)..(351): n is a, c, g, or t
  misc_feature (359)..(359): n is a, c, g, or t
  misc_feature (363)..(363): n is a, c, g, or t
  misc_feature (378)..(378): n is a, c, g, or t
  misc_feature (381)..(381): n is a, c, g, or t
  misc_feature (386)..(386): n is a, c, g, or t
  misc_feature (393)..(394): n is a, c, g, or t
  misc_feature (396)..(396): n is a, c, g, or t
  misc_feature (398)..(398): n is a, c, g, or t
  misc_feature (407)..(407): n is a, c, g, or t
  misc_feature (414)..(414): n is a, c, g, or t
  misc_feature (417)..(417): n is a, c, g, or t
  misc_feature (427)..(427): n is a, c, g, or t
  misc_feature (437)..(437): n is a, c, g, or t
  misc_feature (501)..(501): n is a, c, g, or t
  misc_feature (565)..(565): n is a, c, g, or t
cggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggnanccncccnnncccgaaacccccncncctccccgacccggggccggggcccctgccgccgccgccgccgccttccgacccctgcgccccggccccggtcccccgggccatgcagcctcggccccgcgggcgcccgccgcgcacccnannanatnannctccgcaatngcaccttcctnacgctnntnctcttctncctntgcgccttcctctcnctntcctngtacgcnngngnggggggggngaaaggngangttgtttacntttaccatcnttaattcctttctcttctctatctttttcactcatcctatcattataacctcaatctccccaantatcccaacctttttctttactatatcaatatttccttttcataaattcactctcttctatacntatacttcaatctcacct

SEQ ID NO: 555172 - DNA, 388 bp, Homo sapiens
cacaggagtggcaacatgaaggaccacccccctgcgaagatgggttactttaaaggttagtcgttattaccaagtgatgtgatcccacacagctgtgggtcacactaactacattatagtaccacccagagcgaccactggctcctttaacaccaagtcctacacagctctggccacccattactacaatgttacaacattcacaataaagcacagtagcaataaagcacagtaaaaatcaactggagagtactctcacaagcaaagatatacctcactccagtcccattttctgggcacacacaattacccttccaccccaaccatgctatgagatacgcatcaacacttgagatctatcttcctacctactgtgggtaatgagaga

SEQ ID NO: 555173 - DNA, 120 bp, Homo sapiens
cgggcgtaagcattcgtcaggtacactgcggtctcaataggcccgtgactgctgtctacccaccttggcagctgtcacaggaggtcgtctgtctgcccagccacagaatggccgacccct

SEQ ID NO: 555174 - DNA, 528 bp, Homo sapiens
  misc_feature (274)..(274): n is a, c, g, or t
agcggaaaaaacaactattgggtacaaggcttagtacctggatgataaaataatctgtacaacaaacccctattacctaagttttcctatataacctgcacatgtaccctcaaaagtaaaataaaagtttaaacatagttccctattttgaaagattagagcaatatttcattgttgatagaccttcaataatagtcaaatgtacctaatatatattaaacatctacatggttctatgatactaacataaacccatagccaatgaactcttatngtcaagaagcttatagagtagaagtagaattaatttaataattaatatagagtagaagtgaattagtagagtagaagtgaattaatttaataatataaaaatgactctgtattataaatgttaaagtcaagagtaatttttttttttttttttttgggaccaagaattctcccttcgtttgcccagggtgtggattgcagtgacacaatctcagacaaggcaccacactggggccacaaagaagaatcggccgg

SEQ ID NO: 555175 - DNA, 145 bp, Homo sapiens
tcacgggaatatataatgacaggaaggatgatcccatcatacttctgctggaaccagcgcgatggcctcctcttagctagatactagtgtatggccccgaggcagcctgtcctgcgctatcttgtctagagatgctagaaacctg

SEQ ID NO: 555176 - DNA, 993 bp, Homo sapiens
gtgcccagggaggatgctgcagagtgactacctgcagccctgttctcattcatttggatgcgcctcgcagaagatctggggagaccatacatgctttagagccattgtttatgctccttagtcaagtatggcaagagcatatggccagattcgcatgtttcaaaggctgcagttgataagggcatgttgcaccaatcgctggctaatacggtgaagaccccttctctactaagaaatacagagaaaattagccgggcttggtggcgggtgcctgtagtcccagctactccggaggctgaggcaggggaatggtgtgaacccaggaggcgggagcttgtcagtcgtagccgatgaatctattaccagctgtcgagctccagatcctggtgcttcacaatacaaggataaagaacaacactgaggttaaaacctggtggtcctcggttgcactgcgagagatgcctatcgcgagggtaccccacatgcgggtgctctccatcgagaaaaaccatgtagaaaagtagggggcgcctctcttgggaatacttttggggggggctgaccgttcagcctgcatgcattagcgaatgacgaccaaactggggctaacgagggggtttcacgtctctaactcgggagggtattaccgaggtcattgcactagagaattattgtggccaatgtgtgcggagggaacagccccagtggcgagtttgaactactgctgcccgcgcgaaggggaagataggtggcgctattacagaaagggtcatcccaagtatgactagatttcgatttatggtataaccacatataagaacttggcctgtgaccaaagggcagacgccaacctcgttgattgaataccacaggacacgggtggcttgtccacacattgctctgtggagttcttaattgtaacctgtcaccatgaaatctggtccttctgtggggcaagtggagtctacacatcacgcccttgtataaatcccc

SEQ ID NO: 555177 - DNA, 217 bp, Homo sapiens
ccctgtcatcgataacgcacaaacccctgatctaggccttctgtacagatgcctaccatcctgccgcctactcctcctagacctaagtctgactagaatagccattaccttataacaatttcacagcaccaaatctccacgctccatcatcacctcaatcccggacaaggcatagttaaactttacttcctctatttcttcttcccactcatcctaa

SEQ ID NO: 555178 - DNA, 729 bp, Homo sapiens
agtcttgcgtcgacgagtccgggtctgtcagcgcagcggccaggtaagctgcaataacctatgtgtacactagaggtccccgagcttaatgctgagctcttgatctctgtgcttgcgttctctccagttagtgagtaacgctgggcgggttcatctgcgaggccgttctgctaccgaacttgccgtggtgggactcctggattggtgcttcggtgctcgctctaattgccgggtagatatggctcgcgatctacgtgtctctagatgatctgcggagaccttggactgtcggacgtgttgggagattgctctgttggcggttgctgggtggttggatggctccctgcgtgccactcataccgagtttggccatgtgagcagccttgcactggagttggttcactcgtatcttgtgtgcagcgatactttgatgcttccattcttgtatatcgccgttccggcgtacttggaggaccttttctagtcttttgcctctgaaattacccctagaagactagtttagttggtcccactagtgtcgtgtgtcgtagttctggtacactctacccttgctaggataggtccgcggaaggtgaataaacccgtttttccattgccagttgagttgccatctcgggtgaggagagctacattagttccctatctatgtttgcgacgcacattactagttgacgttgcgtttgacaggtgtcatcccctttgaatgcc

SEQ ID NO: 555179 - DNA, 416 bp, Homo sapiens
gcacttgaggttaaggcaactggaagcatatcgagcagtgagtttctgtctcacagaattaaagcaattctcctggctcactgcccacgtagtgggaaagcgcaagtacaaaatgcgccttgcagtaactgcttaggaattatgtactgtagcagcaaccaaggaggtttacttaacaagtgtgggaacaaagcattgcaacaggtgaaaatctgccacaccacactagagatggtcgcgcgcatagccgtacgcgacccaacatacactgtagccttaataacgtaatgaacgaaatagatgcaccatctataatccgagtcacaataacatcgtcctgactacaattagtcaccgacaaactatgtcaagctagtacaatacaacactttactaaaggtatacattggcggttc

SEQ ID NO: 555180 - DNA, 494 bp, Homo sapiens
gagtgcagtggcgtgatcacagctcattgcagtctcaatcccctaggctcaagcattcctcccacctcagcatcccaagtagctgggactacaggcatgcgcctctatgcctgactaagttttaaggtttttttttttttttttttttgtaaaaacggggctttgtttttttccccaggcggttctcgatggagtgtctccttctcttataaggagaaacaaaaatgttttattagggaaagggagtgtatgatcttccaccatcagcataccacaattagagaggctgatccccccatatgttccaattgatctataaaacagggattaaccacaacccatgaaaagacggatgttaccttccaaaaattctaactatcatatctggtgaatataacaacaaacaaaaatgtgtaaaacacacaaaactcttatgaaatatctcatcttctgaaaaaaaaaggggagaaaaagggtaggcgtatggaggggcc

SEQ ID NO: 555181 - DNA, 315 bp, Homo sapiens
tatgtgttgttttatttctctcttgttcccactatatcttcctcatgggacatgagactccacaacctgctaaaaatgagccttcctaacaatgtgggacctatctgtctaggaataaacaatcccaaccatgagtcatcagacaaaacctgagaccagagactcaatttcttctaaaatgctttctcttaaagatttttttaaattgtgggagaaatgtgaaaggaaaattaaaactcaggaccccaattatctatgcccaaagaataaaattaagctgaaagctgagtcatgcaagaaactgcctttcctttt

SEQ ID NO: 555182 - DNA, 206 bp, Homo sapiens
tgttaccgtgctggcccgagttaggcgcaggtgtggtcccccacaaaaaaaccctcaaacacgagggtgcattcatgtccccattttacctgcaagcaaagtaaggctcaggaaggccagctgcctgcccagcttccctgttgcaaagaggcacaagcgggggtggggattgggggtcagcagcctaacccactgctatgacacga

SEQ ID NO: 555183 - DNA, 230 bp, Homo sapiens
gtacagaaccaacagcaatatgcatcccatatgtgtgaggagttaagtctgtatcgtaattacaacagggaccattgaatgatcagcatgtagacatcatatgtctagggctcacacaggatgtcaaataatatttctcaatatgagaagtatttactttagaaatgtacatgtaagtgcttgggtcattcgggtcgtatgggtaccgacgctcgaaatatcgtatcatg

SEQ ID NO: 555184 - DNA, 175 bp, Homo sapiens
gctagtattcccaggcaaagctctactagacatgctttggtgtatcagaacaccggagtctgagtaagctgacaatctggatgtgagatgagagtctgctgtggtatgtctattcaggtacctacagactccagtggattatcacgtagcagttagattatgagtttgagtaagg

SEQ ID NO: 555185 - DNA, 357 bp, Homo sapiens
gtctcgcttcaaactctatatacaggacactggctttccgatcgggagtcattacgaacggacgtgggacaaatatctcctacgaggcaacataaacggggaacaggtagggagaaaacataagttactaaattaaatgtcattttgccgtttatagaacctccctatcctgtacatcaattaatagtagcccaacagaatgaaagtagctccaacctccttaaattcctctcctggtgtggtagacatggaaatgcgctggccacatcccccttcaagggaagacttgttgctcctcctctcagcccttcctgtggtagctcacatccagactgagggaggccgagctatcaaagt

SEQ ID NO: 555186 - DNA, 364 bp, Homo sapiens
cttgcggggctcataaatgcatgtggcacttagtgtccatggctctccagagggtggcagctggagtctgtcagtgtacctaactgagacagcacagccacctagctagcaacatttgtttcagtctgaacaattatatacttgtagaattcagtccacagatacaccatctgaaacagcttcatggggtgaactctaacagtagttgctatggttcagaatgagacttactactctgctatctagatctgaactccttggcttctttacttagttcaagccccagcctaggaaagccagtcacataacagttggcccaggggtcttagagctttacctgaatatcagacccgcgagggagcac

SEQ ID NO: 555187 - DNA, 428 bp, Homo sapiens
  misc_feature (8)..(8): n is a, c, g, or t
atgggggntttagccaaggatctttgtaccaaaagcaccggtggggccccccccttcaatgtccctgtcaccaagactgacaaaacgctagtcctgctgatgggcaaaaaaggtgtccccggtggtttgatcaacaaaaaatgttatgaaagggcccccccccttgggggttcccagaattgacctggtttgtcccttccccttccccgctccccccagctttgcacccctttcctccccatacacccccaaaccattttattttttgggccattcccccataccccttattgctgccaaaaccccatgggttgggggccagggttggatggaaaaacccccccccctacccaaatcccccccggggggggttggaaaacttttgttttttggggtttttttttttctgaataaaaaagattctccta

SEQ ID NO: 555188 - DNA, 651 bp, Homo sapiens
  misc_feature (136)..(136): n is a, c, g, or t
  misc_feature (149)..(149): n is a, c, g, or t
gatctttagacaagaagcctcttaattagccagattgctttgaaaaaaccatttaaaaagccttccaaaggaatgtttcttccttctcacaagaaccacttcctgggtccctcaactgctttgtaatgcttctctncacctaaaaatanaataaaatcgagtgtccagtaacctttagttcaaacaggcatcatctttgaaaactaaaagcctactgttatttgttattgtgctttaacagctgatacaggtattctgttgacacacctgtgctggcttacttaacctaaatacactatttttttcgttgtattactggtatgtcattttttttactgttaagtacttatgtgtgaataagtgtaaaaaaatgattgcttatcggtaacatataaattcagaatcaggaatgatggtgatgccaaacaatcacagatcgtccacatgggtggcggagatgttaacacctttgctttctaatggttcagtgtatccacactttgtttcatgccgaaattatttaaaatattgtatcaaattaccttcagtctatgtgtataaagtatatatgaaacataaatgaactttatgtttaaactgggatcttatcctcaagctatctcattgtgtatgtgtaaatatttcaaacta

SEQ ID NO: 555189 - DNA, 277 bp, Homo sapiens
ccggcggtgggattgcggacttcttcatcgaatatacaaactacgccgatccatctattccatatggatcaatgttttctgtgttggtgggcgttatttacccctatctcgatagtgacaatttcttcttcggctaagcgagggagcctcggaatcacggctttcggagatagtgatgcgttcgggttttacatacaccggcttgttcgagaccaaggaagacggcacgactatctactattacggtagacgggatggtcatgcgctcggataccgc

SEQ ID NO: 555190 - DNA, 238 bp, Homo sapiens
tccagcagcgggttctaaaggctgataaaaagcatcctaacttaaaaacagataacaacagctaccacataaaagacagaaaagtggcctgaacttataatcaatcaatgcgaaggtagattcataaaaataaaatacaaactggcgaccagtccattaaccatggggataatgcctcgcctgaaggaagatgtgtacgctgcattcacgatccagcaagcgcggagctgctcttggc

SEQ ID NO: 555191 - DNA, 242 bp, Homo sapiens
  misc_feature (17)..(17): n is a, c, g, or t
tttggctaaaatatttnctttagaaataaaaccgtttttcttccgctctgtcacttgacttgcatccttaaaatgcagccctttataggcctgatggtgggtgtcattttcccatggtctttgtgacatttttttttgcgttggctttcatctgtcaattgtggtttttttggttgggcccctgttcatggccccatgccgttagtgctttcgccctttcccataaaatattaaaagttcca

SEQ ID NO: 555192 - DNA, 272 bp, Homo sapiens
gggtttcctgggtgactcgcactttccttccatcggcatgtgatatcaggttattcgtactgagaacattgagattacagaaggaagacaccctgaaatcttatgagtacgcataccccaaccacccctctaactagctagctagtttgtactaggtacgacctgattcactctctccatttacgactggctacgctgtgcggtggaccgactcttagacactggcctgcctcacttggctgggaccaccctcacgactacggacacgtggc

SEQ ID NO: 555193 - DNA, 272 bp, Homo sapiens
ttaaatgggagggcctcatccataaatgatttctggcaacgtcttcttcaggtggagcttgacgtctttttaatgttacttggggagggagtgctcattaagggatgccagggccagctgtggtggttccaggggaggctggatactcacctgctgattcattctatgaggcatgagaaaagattccttgttactgaaagatactgaatacgtgtgatacggctgatattgcactttctggctgaacggaaacgtaatgaagggcgtattct

SEQ ID NO: 555194 - DNA, 317 bp, Homo sapiens
tgttcctttcgtttaattaaagcccccccctaaactataggggctgccagtaacagactgttaaattgtggtttataaactttttgccttgtaaaaagtctttgttggcccttgtcagggtaataaaaacaaaatctttgtatatccaaatcatgtagtttgtataaaatgtgggaaggatttatttccagggtgttgtaattttgtaaggccccctatttccaagttttaaaaattgctatcatgtatatttacccctttgataaaaattaaatcataacttggtaaaaaactcctaattaaaaggttttttccca

SEQ ID NO: 555195 - DNA, 180 bp, Homo sapiens
  misc_feature (39)..(39): n is a, c, g, or t
  misc_feature (58)..(58): n is a, c, g, or t
  misc_feature (77)..(77): n is a, c, g, or t
  misc_feature (96)..(96): n is a, c, g, or t
  misc_feature (134)..(134): n is a, c, g, or t
aggtgcgagggctttatcccgatcatctccaatgcagcngagtatgagaacattcccntccggcaccatgaagaccntctcctgaggcagttggcncagaaggtcccccacaacctgaataaccctaagttccntgatccgcacgtcaagaccaacctgctcctgcaggctccacttgtc

SEQ ID NO: 555196 - DNA, 180 bp, Homo sapiens
cggccagcatctggttttatttattgttttaaaattccctttgggccagacgtgtggttcatgtctgtaattgcagcacttcgagaggccaaggtggtagatcacttgagcccgagaggtcgaggctgcagtgagccgagattgcgccagtgcactccagcctgggtgacagagcgagag

SEQ ID NO: 555197 - DNA, 741 bp, Homo sapiens
cctggacccacctttcagtatgtagaatgtgtctattattactaaaaatggggagtctcctgttagctcagagagagcccacgagcattgcatgttagtagccatatcctgcaatagggtatgtgctctaagatctgcaacaagatagaaatgctcacctttaccaacgttattcaacatatagctggtaatgctggcgagcgcactatatcaagagaataaagggcgtacaaattgaaaaagaagacagattctgctgaagacatgagcttatatactctatatcctaaagactccacctgaaaaccgctagtactgaatgatgaattcagtagtgttgcaggatacaaaatcaacatatcatgatcataacatttaatatacactagcagcagataacctgtaaaaagatatcaaggtcagcgatcacacttaagaagctactaagagtagacaatagctacaaagtatataaaatacctaggaatcaagttaaccaaagaagtgatagatgtatatgaggaaaactatgaaaaactggtgagagaagttcaagatgacacacataaaaggggaagacatttcatgctcatggattagaataagtaaaatgacaatactactcagagcactctatagattcaatatgagctctatctgccaatgacattcttcatagaaataggaccaacactctgaaatgtatgtagaacacatgaccctgagtagccgtttctgtgc

SEQ ID NO: 555198 - DNA, 118 bp, Homo sapiens
tgtttatcgatgcacccagtcaatgagttaccataaatgttcattcatggacggggtgggatgtgaatggaatgttagaaatgtggtgtgaattgaagttctgtggcatcgataaaca

SEQ ID NO: 555199 - DNA, 432 bp, Homo sapiens
atgtaaattactaaggtggtgccagcatagtctcacggtccagtatataaggctcataagtgatgccaatccatatcagcatagtactccataggtacgtcagcagctctagtacccattgtagatccagtgtgatcatatcatgcagtcatgaatatctgtgtctgttaaaaactatccagtgaaaagatgctgcaacaggtatcactatatggtacggatatgcgtcacatatactaagttcacgatctggataagcggctaaagcctgagttgccagtacatggttcgttataagcgcgcgcatcgctacagatcagaagttccagcccactaagtgcaaccttggtgctgatccaggcctgcgatattaaccctcagttaacagaaaataagggctaagtgggcaacgaggtgcaagccggaaatagc

SEQ ID NO: 555200 - DNA, 428 bp, Homo sapiens
acttcctattagggctcacagtacagctctcactttctagatgcagaaacttgattttagagagatttagagacctaaatacctaaatggctagtacaaatgtacacagaaaggaacatttcaagagactgcacaaagtaggtatgaaataaatattattctggctagctaaaatcatagagaacaagcccttcacattccagtaaacatatatttatgttggttgttaatggtgtaatttttttcttacctatcttgttaagaatattagtccagattttaccacaggtgatcagtttcttgatattttctttgaaatatcaaggatattttagggtatttcaggatatcttcctgacatgtataagtgagtcaaatgacagttttaaaatgtcattctttgcagtctatcaaggcagaaactaact

SEQ ID NO: 555201 - DNA, 231 bp, Homo sapiens
ctcagtcaggaacagggaggcatgtgtctttggcagtcaggccagatgggaattggtagctgatcaggtacagtgctgggtcatgtctacacgtagaacagctaaagcttcactgcacggtggctgcttacaatttcccagtgactgctatggtatatgccccaataccaacaaccttgtcatcgctcattcggaccagcaggtatttgagtacagcatcccagacaaaca

SEQ ID NO: 555202 - DNA, 849 bp, Homo sapiens
cgccgctcgagaaagctgagtcggaaggcctgtccagctcctgtcaggccctcctaagctggtcccctctgctgacctgaaacgtctccccactccatggtggctgcatttgactacaagccccaggagagttcccccaatatggtacgtggcaggcatgagctgcccttccgtggcaggggcgatgtcattactgtgatttggggcccatggacgatgacggtttctactatggggaacttaaatggacaaaggggcctggttccatccaacttcctgagagcggccctgggcctgaagagcagtgcgagcctgtacagggaacccatggacaccccaggctgatgatgtcaggactgggggcttgcaaccacacaaaggtccccagggcccccatggtgggccattgtacacccgctagactctggcagcagcacctccaggatttgaacgtggggacgccccatgggccacgaaagcgaagaaggtcgtggaggttgcgttctccaaaggggaacgcagctcctcaggaggctggggctcttgggaatgaaggacggtgaacgctgtgtgccatcctgcaggcacgacagaggccctggagaggcccacacagatcactggtctcctgcttgcagcaggggaaggctcaatagctggtgcccagagcccccgtactttctcggcgttaagcacttgtgggcattccagatgggcacattgaccaggagcctttggtgaagggtcacaggctaaactggctcgttaaggctcgaactctctagagcactcacccttactcctaaaggaggggaacacgtgagcgccgagtgactatgtacttgaaca

SEQ ID NO: 555203 - DNA, 677 bp, Homo sapiens
  misc_feature (12)..(12): n is a, c, g, or t
gggggggggtgnttgcccaggtgcttccccctcttgtacacaccccccccggggggtgttgtccccccaatttttttttctctttgggggcccggggccctgttttacccggggggcgcccaaaccccccccccttttggtggtggccgcccacctccttctgggggggggggggccccccccaccccccccccccttaagggggggtttttttagagggtctttctgggggtggggccctctgggttgggcccacgggtgggggggtgggcacgggtttcccccgggggcccgggggccccggttttttttggtttgtgggttttttgggtcccaaacccattgggggggttttttttttggggggggagacccccccccccccccttttgggggcaggttttggggggggggcccccggggggccccccccccaaatgtttttccccgggggggcttttcttttttgggggttacccttttccggggggccccgggcccccccctcccccctgggggggggggccccccgggggccccccccccccctggggccaaagttccccccccccgggcccccggggggtttttttcccccccccccttgggggttttttttttttttttttttttggggcccccccccccccttttttcttttaggggggtttttttca

SEQ ID NO: 555204 - DNA, 274 bp, Homo sapiens
  misc_feature (141)..(141): n is a, c, g, or t
cccccccccaaaaaaaaggggggggggggggcggttgaaatccctttattcgggttttttcccaaaaaaaaaatttttgtcccccttttttttttaaaaaaaaaaaaaaaacccttttgttttttttcccaaacccgggancccccccccctggggttttggggcccccaacccccccctttggggggcccgggttttaaaaaggggcctttcccccccccccccccccccaggggggtggggtttttttttaaaaaaaacaggggttttggga

SEQ ID NO: 555205 - DNA, 118 bp, Homo sapiens
atccccagagtccaacagtgcttcattcacttcaccctttcagatacacatctttaatctataaaatgtgagaattgaatgaggcactgtgtggactctgggcactgtgtggactctg

SEQ ID NO: 555206 - DNA, 215 bp, Homo sapiens
ccccaccgcagtgacctgcgccgtgcaagcagtagacgctcaacgacttcatccaacctaagtgtaggcgcgaggcacgctcaatgattcgggaggcttgggtccctaggctgcactgagctggcagctgctgagtaagtaactggtcagatgagctgtctcaacatcagaaccaagactcactgtagagagagatgacacacacactcgtgaac

SEQ ID NO: 555207 - DNA, 235 bp, Homo sapiens
cattgagcccctgatgcccatccagactttcacaatgacattgtccagcacatagcccaagctttgagtgtttttgctgctcaagtcacagaaaagagcctctagagtaatggacagcaaaatcatgcgtgaactcccattcacaattgcttcaaagagaataaatacctagggatccaacttacaagggatgtgaaggatctcttcaaggagaactacaaaccactgctcaatg

SEQ ID NO: 555208 - DNA, 350 bp, Homo sapiens
cttgccaagacctcaattttttccacaccatttcaaacagaccctttcccaagatttatttaaaagatgggcttcaggaagatagcagatattcataaaatagccacactcctaatagtaagcaataagatgttacctacttttaagaaatgaaggtgttggccgggtgcagtggctcacacctgtaatcccaacactatgggaggccgagttgggtggatcgcttgagctcaggagttcgagaccagcctggggaacatggagaaaccccatctgtgcaaaagatccaaaaattagccaggcgtaatggtgcatgcctgtagtcgcagctacttgagaggctgaggtga

SEQ ID NO: 555209 - DNA, 675 bp, Homo sapiens
ccaccccggagccaggggccgttgggccctgttgttgggctcgcgggggtgggggggctcgggcctttgttggtcacagatggcccggggatttcctgggatagaaatagccgccggctccggccccttaaagctgcttaaggggcgggatgcggaggggagggtccgggcacaccccacacgtccccggccgagaccccagcctccgcgctgagctcccacccgggagacgccggcagcggcgcaggcctccggttgcttggggcggaccgcggaacccgaggccatgtcccatgaaaagagttttttggtgtctggggacaactatcctccccccaaccctggatatccgggggggccccagccacccatgcccccctatgctcagcctccctaccctggggcacccttaacccaacagacgccctttttcgcagacagtagacgaacaatacgggtacaaggcaacacaggggtaaacaccccaaatgtagcgcccaagaccccaggtaaagccaccagaggggggaatcgaaccaaaatgaaggatacaagtgaacagaatcgactgagagacaaaagccacagaggagaaagacacaaacaacaataagagagcagaaggacacgagagagaaccgaaaaaacgaaaaagcagagatgaaaaagcaagga

SEQ ID NO: 555210 - DNA, 565 bp, Homo sapiens
  misc_feature (224)..(225): n is a, c, g, or t
  misc_feature (564)..(564): n is a, c, g, or t
ctgtgtcaccaggctgggagtcatgtggtgcaagctcactgtagcctcaactttccaggctccagtgatcctcccactgcagtctcccaagtagctgggactacaggcgcacaccaccatgcctggctaatttttgtatttttttttgtagagacagggtctcgccatgttgctcagactgtactttttcttacagtattttttaataaacagaagttgctcgnnttaaagtacttgagtttttagttctttctctttgtggtctatgcttttggcatcttgtttaaggaatctttccttaacctgagaccgaaataattttccctataatttcttggtaagctttgtcatgctgcctaaggttaactttccattaaaatatttcctttaggtgctccagctgctgctcctgcccctgcctcagtcccacagatatcccagccccccttcttgttggatgggctttcatcacagcctctcttcaatgatattgctgcaggtacgatgactgttgttaccatcattacatggagcactgagtaatgagatgtggaaattatattna

SEQ ID NO: 555211 - DNA, 206 bp, Homo sapiens
  misc_feature (11)..(11): n is a, c, g, or t
  misc_feature (30)..(30): n is a, c, g, or t
  misc_feature (77)..(77): n is a, c, g, or t
  misc_feature (163)..(163): n is a, c, g, or t
  misc_feature (181)..(181): n is a, c, g, or t
  misc_feature (194)..(194): n is a, c, g, or t
ttttattgttnttttactgtacatgttttnttctctttttagagacagagtctcattctgttgcccaggctagagtncagtgacatgatcatagctcactgtaacctcaaacttctaggcccaaacagctctcccacctcaacctcccaagtagctaggactncagacgtgtgccaacagntatggctagtttnttttttgtattt

SEQ ID NO: 555212 - DNA, 421 bp, Homo sapiens
cacggcgccgccgtcggttctcacgcgcttctccgggcccaggctccggggctccccacagcccggggcaaggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccttggcaggcctgcccgctagggtcaggcaagggtagcccatgggctagggcgataactatacatgggggcaaaccaaggagattcctaggggcaaacgagggaaaccagaggtcgaataaaacgagcgcagataaatgaaagggaaaacaagaggcgaaacgcagggaaagaaaaagaaaaaaagaaac

SEQ ID NO: 555213 - DNA, 450 bp, Homo sapiens
tttttccgcccctttttctccccactccactgcaaaacgtcccaagcggtttccccttgtggcttcaggtgttttcaagcccaacccccccaacaagcaagtgcattttcagtcgttgggcttttttgttttgggcaaacgtcttactaatttaaaaatgctgtcggccccatgtttatttatttccagtggtcatgctcacccttgttgctttgggtggcgcaggtgccatgcctgctccctgtttgtgtcccacccccccagggccatcccttgtgaggtcggccgaccaggctggaccccctttcccgagtaatgacgtgtgtggctgggcccttcttttttttgtgttaatggctaccctgttcccctgggctgggttgggtagggtgttttggcttttttgtggggtttttttttttaaaaaacccccccttcttcctcccccta

SEQ ID NO: 555214 - DNA, 5344 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 555215 - DNA, 5232 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 555216 - DNA, 519 bp, Homo sapiens
agtcttgctctgaagccaaggctggagtgcagtggtacgatctcagctcaccacagcctccgcctcctgggttcaaatgattctcctgcctcagcctcctgagtacctggcactacaggcacatgccagcacgcccagctaatttttgcatttttagtatagatggggtttcaccatgttggttaggatggtcttgatctcctgacctcatgatcctcccacctcagcctcccagagtgctaggattacaggcatgagccactgtgactggctggctattaacattttgctcctcttatgcaaatttctacagtaggcttgagttcctccccagaaaatgtttttttcttttctaccacatggtcaggctgcaaattttctaaacttatatgctctgctttccttttaaatataagttccaatttcagataatcactttgtgcacacatattagtgcatgctgttagaagcaggcaagtcacatattgaacactttgctgcttacgaatttcctcgtgc

SEQ ID NO: 555217 - DNA, 5142 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 555218 - DNA, 5433 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactgtgagtctcaggaagggaggggtggggtggccgggagggcagggggaggtgcttgtgagtggcgctgacccagcctgtctgcttctcagcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 555219 - DNA, 1068 bp, Homo sapiens
agcggagatgcactgtgcgaggttgctggttcccagaccatggtttcgcgctgctggcgctggtggggctggtcggcgtggcctcggacccggcatgcctcccgccggggagcaccccgagcagttctgccaatcaactgttcatcacaacaacaggagaagaaccacacagatctgctggtggtgggcagtgacccagctggcgtacgtaccacggggccaacgaccgtgctaaagcagccccaggccgcacgatgggacgagtctaagcagaaacgaggcctgatgcccgtttgtgcctggtgcagctcttgagtgatggagcctgaatcagcccgacggtgaacgaactgtcatcagacacattgtacccaggacaggcacctattcttggcacgcgtgtgtcttctgggggcaagcgtggaggtgggcagggacgtgacggtgccggagacagcgggaggcctaccaggctgtggtgctgagcttacgggggcagaggaccagcgggccctggaaattcctggtgacggagctgccaggtgtgtgcgtccgccgggcctatcgagggcttggttacaacgggcttcctgagaaccaggagctggagcctagaccatgagctgtgacgacaggcgtgatccgtggggcaggggaacgtgggtctggaacgtggccgcatcctactgaccccaactgagcaccgtgagagaacggacatgacgaaggcaggccctgggcgtgactgaggcaggagtcagagtgaagacacgtgtggctcagttgggccggatgtggaacccatgcgacgtggaacttcaacatgacggagcctccgggaagaatgacccaggtacggacagcccggaccaatttgggaatcctgttggagtacctgggggatcacccaggacagaagacttgaggaggtccccacgaccgatgacaagagaggacagaaagggattgaaagggcaacagaaaaacacaggacagggaaaacataccacaacagaaacacctaagataagtgggacccaataaccaaaacccaacgtaggcaaaaca

SEQ ID NO: 555220 - DNA, 5473 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgcaaacccctggtcaaaaaaaacacaaaaaacacaaacaaacaacgacagcaaccaacaaaacaaaacaaacagggcgggggcgccgccagacagagaccaaccacgggggccgcaccaacacgaaaccaca

SEQ ID NO: 555221 - DNA, 5345 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcactcgctcaatccttggagtcgtgggctatgtatacaatagtgatgcggatcatatccgtgatcatatcacagatgtatcatcgtatggcatgtttcaggggagggggaagccttcctctcaatttgttgtcagtgaaattccaataaatgggatttgctctctgca

SEQ ID NO: 555222 - DNA, 251 bp, Homo sapiens
gaattcccccccccccccccccccccaatgggtatatgtaagtttcttctggtccccacggggaccttcattggtgccatccctgctctctggaagccgttagttcttaccccttcccatgtttctgacaaatcctctgtaaatatgtcacatcctccgaggggcctccccgatcacccagggataaaacactctcccctctctctctcagatcattatggagatgggagactcgctctagtcaacccagg

SEQ ID NO: 555223 - DNA, 5425 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttggaggaagggaaaggacagaaagcctgtcagatttctgcaggagagggacggtcgctgggtctgccagccccactcaccttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 555224 - DNA, 528 bp, Homo sapiens
  misc_feature (458)..(458): n is a, c, g, or t
  misc_feature (477)..(477): n is a, c, g, or t
ggctaatcattttattattattattattattattattactatttttattgttgtagggatgggttctcactatgttgcacaggctggtcttgaactggtttcaggtgatccacccacctaaccttgccaaagtgctgggattgcaagtgtgagccaccacatctggcctgacgttctcgttgcatcaagccatcatccaccgggcgcccctggacgcgcgttctctccctctctctctttctctctctctctctctaatgctgacccactcagtagagcaggggccagccagagggggacgaagtcaccaatccaggcaccaccttcccacatgtccctgcaacttctctctttccagtgtgctgaagaagggaggtgccacccctcctccagataaatggccccagaaaacgatccaaaaaaatacccagggagcgattccttatgtaccccctccncccctctctttataaaatntgatgattacaaaagaaaggaatgggttttttgtgggcacacattatggag

SEQ ID NO: 555225 - DNA, 585 bp, Homo sapiens
tgccttcccagatgaaattccttttattaagccctcccttttgtagcagtaaatttgttcacatgtgatttgatcagtttccgtcataatactaacacagcagagcaggctgggtgtttttactcatcacatacatcctcaatgctctgcagcggtgcacagtagtaggtacctggttaactatttgtgaaaaacatgaaaaatgggaacaatggggcagagtcaagttaggaagttcagtcatccaagaatcaaggagttgctgcactgaggtattgcacgatgatgggggcacttaaatttttaggaaaacgaattaaaacattgaattaaacaataatttcaagcaattcccaaaccaattaatgcatagattaggttgtaactgtccagatatgtttggcgacacaattctattagcatcaagactcatctaagtacctgaagtagtggcaccaccatcaggctcagcagtacaaaaaggcacatcattcttgtcctccctaatctcctgcagtatggattttgccaaaccatttcgattagagctttcaaaggccagtttattcgggagaaagggtccat

SEQ ID NO: 555226 - DNA, 5317 bp, Homo sapiens
ttttttttcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggcgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacacgaacgacgcggatgctgctgcgggcagcgtccagggtgtcgtagaaggcccgcaccacctcctggaactccccggtgttctctgccagacgctccaggttgttccagggccccttcagcgtctgccccgccaaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcgcctcctcctctggctgctcctgaggcccttcctcctccagctcccgaggcagccagtcctccccgtctaggtctaggccctccagggtggccagcagttctcggacctcctccaggctcacgtcctcctggtcaccacctgtactgtctggggtccacagggtgtgggcgttgccagggagcactgggagggcctcggtagggtccacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccggcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggacacggacatctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccattccccgtggccgctaggcagcctcaggccatgagctcagccaggactcctgtgcctgcccctcagcaagcctaaccccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgca

SEQ ID NO: 555227 - DNA, 378 bp, Homo sapiens
  misc_feature (308)..(308): n is a, c, g, or t
  misc_feature (327)..(327): n is a, c, g, or t
ctccataatgtgtgcccaggctggtctcaagctcctcctgccttagcctcccaaagtgctgagattacaggcgtgagccttttcttttctctctctctctctctctaatgctgacccactcagtagagcaggggccagccagagggggacgaagtcaccaatccaggcaccaccttcccacatgtccctgcaacttctctctttccagtgtgctgaagaagggaggtgccacccctcctccagataaatggccccagaaaacgatccaaaaaaatacccagggagcgattccttatgtaccccctccncccctctctttataaaatntgatgattacaaaagaaaggaatgggttttttgtgggcacacattatggag

SEQ ID NO: 555228 - DNA, 579 bp, Homo sapiens
  misc_feature (9)..(9): n is a, c, g, or t
  misc_feature (12)..(12): n is a, c, g, or t
tgattgacngantgatgagcatgcagattccccaggtcagacacctcacattcaactagatcacatttcttataatgtgatgttagaaagtctggtcattctgtttgaaattcgtgtgcaaaaggaagattcagggaataaagaaggcatgtgaaagtattacaaaggagaggtaataggaatataatttcttggcttgaaatgaattctggtgctagaccttggatatgcagagtgatggacagaatttcctaagaaataaataatcccctagcaagtcttgttctaaaattacactgatataaaaataacctgattagaataatgaaagtgtgaattaggttcacacattggtgcctttgctgggacaaaaaagagactttcctgagggttgtcttgttccagtttctcagccactcaccatgtgatacctctgacttgtcctcttggatcatttcctacctcttgcctttggcagtgttaatctggtgattttcaaagtaaagaaatgaacagctgatgacagaagaaatttggaaataaattgagggtgactcatcctcaagattaaaaacaaaa

SEQ ID NO: 555229 - DNA, 210 bp, Homo sapiens
gcttggtaccccagcgccactatgcctattattagcataattcctttactattttttaacccaatcaaccacaacctatttagctggttcccaaccttttccttcgacccccttacaaccccccttctaatactaaattactgacttctaccccttaccattatgggaaggcaaccccacttattccatggaccaattttcccaaaaaaa

SEQ ID NO: 555230 - DNA, 1280 bp, Homo sapiens
  misc_feature (661)..(661): n is a, c, g, or t
  misc_feature (900)..(900): n is a, c, g, or t
agcggggatacgggaaggagccaggcaggatgcatgggggaaagcggcagggggcttgacgagcgaatgagctgcagctgagagcactggatgtcagggtagaccaggggtcggtcaccgttgcgtagattcaagtcctcgttgagtgtaaggagagcgggagaataacagtggaggcgagtcgtcggtagctcgccaacgcacttagagcaggagctcgtcgagcgatggacgagggcgcgggatctgagatagagagttctagcctcaagaacagtcgcaccgtagggcatggtgcgaaggacttgtgagaaaaccacactcatcccagtgaaacaaggaaggagtggccttcattggatggctctgactatcagacagtgccacgttagtcccctatacgcggggacacgtactatggagggggcacttcttgcatgggtaaagctcggaagatttacacaggtggcacaaagcacctaccttgcgttgcccctttcgcgaccccccaagaactctctcaatatacttaccagattgtgcccatttgtgccagacgacaattctctggtgtgagcggcacgccctacaacccaggattacgtttccgtatacaagccacgcccagctcctggggcctcctagttgtcacaacgccacnaagaggctgagaaaatcctaggagttagacgccaattgagacccaaattcctttggcacgcgctggcgtacagacacagagagactttgtgaaggcatctccctaaggcatagaggcaaatctcttcccccttgtttcttgaccttgaaagctacaaagcattgcgggcacgagggcggggtttcgacagcgaacaccgtttgcgcactagcggcacctaagggaggatacacttagcnttccttatatctatgtgcgattcccaatatcgaaaattccacaaagattgccgaaggtgaaaagaggaaaggctaggcaaagctatcatagtccgcacatcgtggagcggatttcaaactctacaagaatttgcctcaaccagactggaggatattcttgaagtcccgctagtaccagcgcgccagtatcggcataccatcatcagcaagttggtatcaccacgaagagcgtaggaaagaggtagccgtaataggggggaaggggcaaaaaagacgaaagacatttccttggaagactaaaccagtaaataccctggatattgccgcttccgcactcgaaaacctgggcaccaagtacctcccccgtggatccgcccgaa

SEQ ID NO: 555231 - DNA, 1345 bp, Homo sapiens
  misc_feature (881)..(881): n is a, c, g, or t
gtgctataatacccgggattaccatgtattatttgccggggaggtgttattatttacacagggacagttggtgcactcgcctttttgggacactataaacaggtgtcacaaaagccagcgtgggatccgtctgggattttcccggggattttgtaggcaacaagctcttcagaacatatcggtgttcccggcaatatgggcacggcgcaaattatcccagaaaagggaaaattttttccgcttggtatgggacaatttttcaaaaacgttgacacgtgtatagagggtttttctttaaatcccggggagaccttgggccttgaaaagatgggcctaacttcttgggaaatttgaagagttggccgagggtttaccccccaaaccacgcggccacggaaaattcatttatttcttttgtcccccccgcggaagcaccagagaatgggtttcttggtgtcaaaaaaaggggccccgcgccgggaatttttcggggggaatctggtgacttctctggttaggatttcacgaaaagagaaggttttgggcctttttccacagaaggggcccaagttgtaaggagccttttatttgcctggaaaaaagggtgggccacacactaagaagggtctttgtggtggcacccaatttgccccccaaggccatgaattcttcttggcgcgtgtaccaaaaaattccctataggaagggctctttcctgtttcgcgagagggcccctgcgttatgtgttgttgcctctccggtttcatatcacatggaagaagttgtgggccccaaaggccctgcgataggctttttgtggtgttttttgtggaaaaacttctcgacaggaacacgaaggggctataaatccactgaaagtnttgttggaatgtggcctcgagatgagttccaccacggcggagggaaccctcgggttaaactatatctatacgcgttgagaacctgggctgtggcgcgccacacgctggttgtgctcacaaccacggagttttgctgggcacttacaaggtgaaagattcacttcttggccctcgggagaccccacactggtaaagaattggcccttaagagaagcccctcgcctgagccacacgtggaggcacttttgggagaaccccaaagagttaggagtatctgcccacccaccccccactttcacgaaacacgaaagggtgggaaagccacgaagccgcctgccacatgccccacagccacgtccccaccacgcactataaacgggtttccttggcacagctgtatattttggaggtttggagatgttgcttttcttaagacccttttataaaattttgtaccaagacca

SEQ ID NO: 555232 - DNA, 271 bp, Homo sapiens
ctgattccaagtctgactctgacctgtggggggagcagggcacaggggcccgtgcaccattaagcatacgcaggagctaggatggaggaaatcctgccctattgggtggcaggattactgtggcaaatcaggcagaagccaaggagatgctgtactggtgtatagggccctgggcccaaccctgtttctgagagacccaagcagaggatcagagaccaggatgataactaaacttggggcaaacaaggaagctcactcactcagacaccct

SEQ ID NO: 555233 - DNA, 863 bp, Homo sapiens
accgtgggagcacatcatatatttacagtaggaatagacgtagatgcacgagcatatttcacctccgctaccataatcatcggtatccccaccgtcgtcgaaagtattaagctgactcgccacacgtccacggaagcaatatgaaaatgagtcgtgctgcaggtgctctgagccctaggattcatctttcttttcaccgtagtggcctgatttggccattgtattagcaaactcatcactagacatcgtactacagcgacacgtacctacgtttgtaggctccacttccactcatgtcctatccaatagggagctgtcattgccatcatagcgacggctctcattcagtgtgattccccctattctcaggctacaccctagaccaaacctacgcccaaattccatttcatatcatattcatcggcgtaaatctaacttatcttcccacaacactttctcggccttatccggaatgcccgagttaactcggactaccccgatgcataccaccagatgaaccatcctatcatcctgtggggttcattcatttctctaacaagcagtaatattcactaacttccatgattctgagaaagcttcgcttcgaaggcggaaaagtcctatagtagaagaaagcctccataaactggggtgactatttggatgcccccacctaccaaatcgagacccgtattcttaacatctagacaacaaggaggatcgaccccaaggtgttaagcacaccaggctcctgcttttagacgacacttgcaacacacagcacaacacttgtgggcgcgcgcagaggtttacacctggcggggccacggaaactgcccgtccaacacggacgcaggggccca

SEQ ID NO: 555234 - DNA, 153 bp, Homo sapiens
ctgtgtcctcctcctgctgctgtcctcctcctgctgctagagaaatgaatgagcctacagatgataggaggtatcatgtggcgcatgcatcagggaggaggacagcagcaggaggaggacacgcagcaagaggagctgcctctagcgagcatc

SEQ ID NO: 555235 - DNA, 139 bp, Homo sapiens
tctggggggacccaaaccctctcctctcacagaagcccctaattcttcatctcagccccttcccacaaggtcagctgaagatctacagcccaggaaaagcccactccaggctccatcgcacatgagcagcttagaagac

SEQ ID NO: 555236 - DNA, 621 bp, Homo sapiens
  misc_feature (33)..(33): n is a, c, g, or t
  misc_feature (119)..(119): n is a, c, g, or t
  misc_feature (122)..(122): n is a, c, g, or t
  misc_feature (151)..(151): n is a, c, g, or t
  misc_feature (168)..(168): n is a, c, g, or t
  misc_feature (176)..(176): n is a, c, g, or t
  misc_feature (189)..(189): n is a, c, g, or t
  misc_feature (217)..(217): n is a, c, g, or t
  misc_feature (225)..(225): n is a, c, g, or t
  misc_feature (227)..(227): n is a, c, g, or t
  misc_feature (248)..(248): n is a, c, g, or t
  misc_feature (250)..(251): n is a, c, g, or t
  misc_feature (258)..(258): n is a, c, g, or t
  misc_feature (271)..(271): n is a, c, g, or t
  misc_feature (280)..(280): n is a, c, g, or t
  misc_feature (282)..(282): n is a, c, g, or t
  misc_feature (285)..(285): n is a, c, g, or t
  misc_feature (298)..(298): n is a, c, g, or t
  misc_feature (366)..(366): n is a, c, g, or t
  misc_feature (415)..(415): n is a, c, g, or t
  misc_feature (448)..(448): n is a, c, g, or t
  misc_feature (500)..(500): n is a, c, g, or t
  misc_feature (544)..(544): n is a, c, g, or t
  misc_feature (546)..(546): n is a, c, g, or t
  misc_feature (581)..(581): n is a, c, g, or t
aaaaagcctagagaaaatatgcttagcaaatantttacaaacagaaaacagaaagtcatcaactccacaagctccaaaatgaagcagtaacatgtgctccaatactatgaggcaaagtnttntccaatcgtggctgcattagtgtccatcngcaccagcacccttggnagtttggnaataccttaatgntcctcaagaatgggcaagggttcctttntacaatgngngccatgggccacaccaccccngnncattttntccatgattctgnttttgacantnttntcccttgtttgtntaggtgtgccctggaaacccaggtagcatttagtccctaaatttgtgaatgtcattgaacagcctgtngaagggaaaggctgcttcattgggatgcgggcagttgtagttgcatttncaggactggatcatcatgacgttcttggaaaanatctccccatcttcgcagcggaaccgcatcttcacagtcctggtcagctggngcgtgcagcatcggccgtccacgcaggaaccgcagtacttgggncnggtatttcttcacactcaaacatccagcgtaagtnaacctgactggttcgggggatttcttggtcttgctgcatt

SEQ ID NO: 555237 - DNA, 798 bp, Homo sapiens
  misc_feature (430)..(430): n is a, c, g, or t
  misc_feature (615)..(615): n is a, c, g, or t
  misc_feature (631)..(631): n is a, c, g, or t
  misc_feature (693)..(693): n is a, c, g, or t
  misc_feature (703)..(703): n is a, c, g, or t
gcctgcgccgcctttctccgctggcaagggccgtcccgtcctcctccccagccatgggttcacgtcgcggccttctgctacatgctggcgctgtgtcactgccgcgctcatcttcttcgccatttggcacattatagcatttgatgagctgaagactgattacaagaatcctatagaccagtgtaataccctgaatcccctgtgtactcccagagtacctcatccacgctttcttctgtgtcatgtttcttgtgtgcagccagagtggcttacactgggtctcaatatgcccctctgtggcatatcatattggaggtatatgagtagaccagtgatgagtggcccaggactctatgaccctacaaacatcatgaatgcagatattctagcatatgtgtcagaaggaacggatggtgcaaattagcttttnatcttctagcattttttttactacctatatggcatgatctatgttgggtgagctcttagaacaaacaagaagaatgtggtccagttaagtgcatgcaaaaagccaccaaatgaagggattctatccagaagatcctgtcccaagagtagcctgtggaatctgatcaggtactttaaaaaattgantccttatttttaaatngtttccaccatttttggtggtggacagactgtttcatatgtatactcagataagatttaaanggattacgtntaattactttaaagggtactttggggttgacaggtggactgggctttaggaaagcaaactttgagtggtaaaaggggctagattgggttgttagc

SEQ ID NO: 555238 - DNA, 389 bp, Homo sapiens
ggaccccgccaatggagagaaaaaagatattatacttttaaaaagagggagataagagagaataagaaaaataaaaaaaaagactaattattaaaaaaaaaagggatcctcaacctaaaaagagattttacaaaaaacaaaaaaataggtttaaaaataacgtggagaattttaaatgccccccacagaaaaatatgcaaaaaaagcaatataaaaaaaaaacacggaaagccacctgaaaaaaaacttcccacaaagaaaaggaatttttcctaaagggagaaaaaaatataaaaaagcaccgagggataagatttcccaaaaatgtatttaatgaaaattagggaaaagaaaaaaaggagggccaaaggcaaaaataatttttcacc

SEQ ID NO: 555239 - DNA, 400 bp, Homo sapiens
ctcataccttgtctacacagtccttgtacagggctcctaacctgtgatgagtaaagaatgtcactttctaacaggtccaggagccccaagttatcttgggacctcaagaagagaggaatttacccaactcataggtattggagggtacaaacccattgctgggcttgacttttaaaaagtcttttctgatattccttatggaacagaattccatcagagccaattttaaaagcatatgtgaaaaataattattcttgctgtactttatgcaaataatcaggccaagtataagactaaagtttattttgcaaacaatcctattatgatttgtttttaacaaaaatgaagactggagagtttcaaaacttatcacacttgtcattaaattctagttttatta

SEQ ID NO: 555240 - DNA, 1132 bp, Homo sapiens
agcggttggagaatgccctgctcacaatgaggacagttgccacggtagagaattcgcttggcctcaagaggcccgttcaggaaaactagcagccataagatgtagtgatgaaaaggatagcacctggaagggattcatccactgcacgaaggaacatgacagcaagtgtcgcaatgttccattctgaggtctttggtggtctgcattcttcagataaggaatcacgttaacccaacactcgttccatcctgaacgatggctcgcgagacatattatttctagcaagtgctaatggtcaagccatcgtaatgcgcatgcacatgaagaactccctgtggcacggaacatcctcagggtcgctgtgccctctagcggctggcttcaggaaccggcgctttttaacctgcttgggaggccgacaagacaccagtggatatctagagactcaagagctcatgaaggggtacctggccctccatattactccttgatcaacagatggtatagaaacagcaatgaccctaatgatcgagaggaggcttattcattcaagcacacgttacacgtctcacccgccaacgaaggatgcagacctttgcgagcgagactgcgcaaacagaatcgcgctgggagccaaaagtgcacacagtgccctgctatttcccttataccagattagcggataaccgggctgtcaatgggggagccgatgcttacatgtgaacatgggcccctgaatgactgggtggcggtagactggcgcgtgggggttactcaccacgtgtatcctacgaccaggcaagaccgtggacagacccccaggaacaaaccccgagcagaggggacacaggcgacacacctccacgctgagggcactttccaacagtggcgtcccccccattggccgaggaccaaagccgcaggacgacctcgacaggcccccattggggccccataacacggaggaacgacgcaagaactggggacacaagcaatactaacacgtagtcaccaattcccatcggatggcgcccgtttccaaatggtgctggaaacagagacccagcgtcaatgacacccagcgaggaagaccacagcaactaggggagaaatcacactacgacagctgggc

SEQ ID NO: 555241 - DNA, 145 bp, Homo sapiens
cacgaggcggcagaccgccccagggtgtcactgacgccatcactgctgctacgccccaggcaggagccctatgttttcaaacccgctgtgcatcccgggctggtgctggggagcaccagccaggggccatgtcggggcggcggcc

SEQ ID NO: 555242 - DNA, 111 bp, Homo sapiens
tgcagtcccagatctccgacacatctgtgtgtgctgtccatggacaacagtctgctccctgtgacctggacggcatcatctgctgaggtcaaggcacagtatgaggagatg

SEQ ID NO: 555243 - DNA, 488 bp, Homo sapiens
gcatcttggtgaagtctacttggaggtcttcaaaggggtctgctccacaggcttgtatgccgggcgggacatttgcacttggcctacctttctgctgccagcaggtgacacactgatacaccacggttttggctagggctgccggatgtgagttgtagaactaccggcctaacaacttttcaagtgactctcggcctaggtgggtggtctcatgaacagccagtacgactgcagctcctagcggttgtggcatggctattcttctatctgataactggatccatccctcttcaatcacctgccctccctctgcctggagaaagtccttctcttctttagaataagtaggtacaaggtcaggtgcctgaaggagcagggggtgctgtgactgatgcccggtagggggtggatgctgcttttcaagcctctgagtcagctcgggagttcccaaggcaatcaaggtgaaagattgtcgtcgtcctctgcag

SEQ ID NO: 555244 - DNA, 343 bp, Homo sapiens
gggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcacttacctgcataaatgg

SEQ ID NO: 555245 - DNA, 537 bp, Homo sapiens
  misc_feature (295)..(295): n is a, c, g, or t
  misc_feature (466)..(466): n is a, c, g, or t
  misc_feature (516)..(516): n is a, c, g, or t
ccacgtctccaccctgaggctgggtccctgaagaagccccttgtttctccttcattctatagtgtgtgttgctccaccacccagaagccatgattggtgtaagtaacgggagagattatgcacatggaaatggaattacctattttcggccacattatctgaagtggaatagtagacctcagttgagaaagctggagggaaattgccccagtttgtctagagtctcctccgtttctcggagtcctcccagaactaagtgaggggcttactgtacgaaagaggcccagcctggcangtccttgtgtttacgatggggagggttaattctgaggcttcctgtaataaaaaggcttggggaatgtggagacgtataaggatgaagcatcaatggggagactcctcctcccttgaaatcctaaaagtgtttgaggagcaaggactctgggggttcctgcagtttctgtcntggcaagtgttccacacagaaggggctcaggaaccaggattaaaaatccnaattgatgcccaaactccata

SEQ ID NO: 555246 - DNA, 302 bp, Homo sapiens
ctccctccaccagccgggaagctgaggcaggagaatcacttgaacccgggaggtagaagttgtggtgagctgagattgtgccactgcactcagcctgggcaacagagtgagactgtgtctcagaaaaaaaaaaaaaaaagggcacagacattagaattgtggaatgcaagcgtttcccttggttagagtctatttttaagtgcttttaataaaaagtaataagattgtggcttgagctggagggatctaaagaagttgggtttagaatttggaaataaggagtcctactgaagatcatggaa

SEQ ID NO: 555247 - DNA, 319 bp, Homo sapiens
  misc_feature (43)..(43): n is a, c, g, or t
  misc_feature (98)..(98): n is a, c, g, or t
  misc_feature (224)..(224): n is a, c, g, or t
  misc_feature (244)..(244): n is a, c, g, or t
  misc_feature (255)..(256): n is a, c, g, or t
  misc_feature (273)..(273): n is a, c, g, or t
  misc_feature (295)..(295): n is a, c, g, or t
  misc_feature (301)..(301): n is a, c, g, or t
  misc_feature (306)..(306): n is a, c, g, or t
ctagtaatgactagtggcttctctggagctgacctgacagagntttgccagcgtgcttgcaagctggccttccgtgaatccttcgagagtgagacttnggcgagaccgagagaggctgactaacccatcagccttggaggtagaataggatgatccattgcctgagatccgtcgagatcactttgaataagccatgttctttgcgcgccgttctgtcagtgacnatgacattcggaagtatganatgtttgcccnnacccttcagcagagtcngggctttggcagcttcagattncctccnggaanccccttattgggt

SEQ ID NO: 555248 - DNA, 215 bp, Homo sapiens
  misc_feature (151)..(151): n is a, c, g, or t
ctacgaggaatacgaattggtatgtcctaaaataagaaagctaataaaggagggaaatccccttttgtctgctataagaatagtgtatcgttcagatttaatttatagttgtgttgctcttagagttttaggcatttaacgagaacaaagnaaattttataactgctagttatactgttattgtaatataattaagtataaagaaaatagtgtgc

SEQ ID NO: 555249 - DNA, 270 bp, Homo sapiens
agcgggagcacaatcacttgaggattcgttgttataaagcaaacacggagcacttgctctcagccagacagacatgttctaggaggtggaactagagcagaggaacaggacacggccctcagggcgccaaatgctggtggtggcagataggtcgcacaggagcctgtgtgaagatgcgagatccgggcaggcacaggagtaatgggggcagtggaatgttgttgctgcatgctagatgtgccggggagaggcctcctctgaggaagggac

SEQ ID NO: 555250 - DNA, 944 bp, Homo sapiens
  misc_feature (26)..(26): n is a, c, g, or t
  misc_feature (226)..(226): n is a, c, g, or t
  misc_feature (879)..(879): n is a, c, g, or t
  misc_feature (908)..(908): n is a, c, g, or t
agcggagtgggtcatcagtcggcgcnagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgaggtgagtcacttcccggccccctcactctcnagctcttgggggtcgtcctcctcgtggggcagccgcccctctcctcggccctagcctctgttttagctggacgctggtcaccccccgactcggggaggcccagaggcggctgacaatttccgggggaggtgtcggcattgggagacaaggacactgccgtcaccgcgccagaaactggaccaagggataatcagggtcagtgagctttgctggaacttttgtaaagttctctgttccagagaacgcaaccatttgggcctctttgggtgttcacagtccctgccgtacatcgaggaggaaaacgtggcagattcgttgacacatctctcccccatatggccatcagctgtttgtggagtccctatcatttgccaggtcttagggatacaacagtgaacaagggagatacagacttcgcatctgcagaatttatggtgtagaggacagtattttcgagacttgttgaacttaacctgattcctagtcttaaagttggagagggcttggacaagtcggtaattctcttccaatcttctcgtgtttagtaatgcagctgagatttaataatgcgtttaatatgcagctgagatccagcaaggggaagggtgacttgtccagcatgacacacttaggctctgaaacttgtcttttgnttcttatacgtgatgatccagcctctgtncaagcactacactgagcactacctttgtgggagtca

SEQ ID NO: 555251 - DNA, 625 bp, Homo sapiens
  misc_feature (255)..(256): n is a, c, g, or t
  misc_feature (305)..(305): n is a, c, g, or t
cactatgatcaagtatggggggaactctggtgaagggttctgcacatattttccgcacttcatccaccttcccgtagatatctcgcgaatcactttattctcagttggcagcttattacaacccacgtttctcatacaatcatttccatcgatgtgtatggcttttacacacacatacatcaaatccaatagtgtctaaagcacaaaacgcattttttaattatcaattgcgaccacgttgcatagcctggggannaaaactcttaaagcggtcggtgctgccttattatatgtttattccatanttttatatgcgtacgctttttaaatttttgtgggtcggccatattattaaagcgggcaaaaacgttagaggttaaaattttggcctaagtaaatttcccaactttttgtgcctctttcgtagttacacgcttgacatactaaattactcacgaacctgggtttcattctttgattgggggccccctaatgggagaaattttctggagcaactattatacatttctattcataagcttcttaaccccttttccatattaaatttaaacttttccatgggacccacaagaaatgttttgcctggaccccttttaaacccaaa

SEQ ID NO: 555252 - DNA, 498 bp, Homo sapiens
  misc_feature (26)..(26): n is a, c, g, or t
  misc_feature (313)..(313): n is a, c, g, or t
  misc_feature (410)..(410): n is a, c, g, or t
  misc_feature (415)..(415): n is a, c, g, or t
  misc_feature (417)..(417): n is a, c, g, or t
  misc_feature (438)..(438): n is a, c, g, or t
  misc_feature (444)..(444): n is a, c, g, or t
  misc_feature (454)..(454): n is a, c, g, or t
  misc_feature (461)..(461): n is a, c, g, or t
  misc_feature (475)..(475): n is a, c, g, or t
  misc_feature (477)..(477): n is a, c, g, or t
  misc_feature (489)..(490): n is a, c, g, or t
agcggagtgggtcatcagtcggcgcnagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcnaaaagatggacagtacattttagcaactggaacatataaacctcgggttcgatgttatgacacctatcaattatccttgaagtttgaaaggtgtgtnagatncnagaaagttgtcacctttgaanatttgngtctgatganctactcnaaagattgtcttcntnacataatgatannatacattg

SEQ ID NO: 555253 - DNA, 126 bp, Homo sapiens
aagttttaatcttacttccttgtccaaaattgctacgtgagtttcagtcgttgcattcttattctgcgcagctaagagaggcacggtattaaacacaggccatctcagtatcatcactctctttaa

SEQ ID NO: 555254 - DNA, 200 bp, Homo sapiens
agaatctttacttacagggttcaaagatgagagctagaaaaatcgtggccttaacaactgaaagctataacagggtatcatgctactgaggtgtcaggcagtgcagcatgggccagcttgacaccatcgtaagcagccgtactcattctctcgatcttgcgtgcgtcctcgtctgtgcgagtcctcagatcactcatgct

SEQ ID NO: 555255 - DNA, 700 bp, Homo sapiens
  misc_feature (26)..(26): n is a, c, g, or t
  misc_feature (515)..(515): n is a, c, g, or t
  misc_feature (612)..(612): n is a, c, g, or t
  misc_feature (617)..(617): n is a, c, g, or t
  misc_feature (619)..(619): n is a, c, g, or t
  misc_feature (640)..(640): n is a, c, g, or t
  misc_feature (646)..(646): n is a, c, g, or t
  misc_feature (656)..(656): n is a, c, g, or t
  misc_feature (663)..(663): n is a, c, g, or t
  misc_feature (677)..(677): n is a, c, g, or t
  misc_feature (679)..(679): n is a, c, g, or t
  misc_feature (691)..(692): n is a, c, g, or t
agcggagtgggtcatcagtcggcgcnagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgaggtttactctgttgcccatggctggagtgcagtggcacaatcatggctcatcctacagccttgatttctctgggctcaatgattcttgcacctcagcctactgagtagctgggactacaggtgtgtaccaacatgcctatcagacatccaagcggggatgtcaagaacacagttggatacacaagtccagttccagagtagagtggctttctgataggaagaagagagcgctacagaagaaagatgtagatgtccgtaggagaattgaacttattcaggactttgaaatgcctactgtgtgtaccactattaaggtgtcnaaaagatggacagtacattttagcaactggaacatataaacctcgggttcgatgttatgacacctatcaattatccttgaagtttgaaaggtgtgtnagatncnagaaagttgtcacctttgaanatttgngtctgatganctactcnaaagattgtcttcntnacataatgatannatacattg

SEQ ID NO: 555256 - DNA, 462 bp, Homo sapiens
  misc_feature (1)..(1): n is a, c, g, or t
  misc_feature (229)..(229): n is a, c, g, or t
  misc_feature (236)..(236): n is a, c, g, or t
  misc_feature (244)..(244): n is a, c, g, or t
  misc_feature (253)..(253): n is a, c, g, or t
  misc_feature (350)..(350): n is a, c, g, or t
ngtgccaccgactaattcatcaagccaacttaatacttcagaccttcaaaactgtggcctgaaagttgtatatgttaagagatgtacttctcagtggcagtattgaactgcctttatctgtatatttttaagtttgactgtattaattatcagtccctcctgaagggatctaatccaggatgttgaatgggattattgccatcttacaccatatttttgtaaaatgtancttaatnataatctnacactgaanattttgcatcactttccctattatcattcttttaaaaattataccccaaaaaaatttaccccttaatgtgtcattatatcccattccttaaaagaantgcaaatattggccgctcggttctcaccttttaacttgaaagccatatgctccccgatactgcatttaacaatatttggtggcaaatattcaataaatagtttacatctgtt

SEQ ID NO: 555257 - DNA, 979 bp, Homo sapiens
gtttcaacgtgttggccaggctggtctcaaagctcctgagctcaggtgatccagtagcctcagcctcccaaagtgctgggattacaggtgtgagccagcgcagccggcttacaaagagaacttttaaggccaggcactgtggttcacaccttcgggaggctaatgcaggaggatcgcgtgggcccaggagttggaggctgcagtgaagtatgattgtaccatctgcgtctccaagccgggtgggacgagagccaataatcgccaatctcaaaacatgaaaccaaaatgtggactggacttccgtgtccaactgctcctccctcaagtgtcaacatggcccctgcacacctgtcttgcttgccttgtgtccctggggcagggagacctatcgttcgagaattggaacacgtcgatttgccctcctctctcctctgcaggagcaagaagatgcgctggggtccttggaagggttcggggctctcggatggagtagtgcattccctggccggatgtggagggagccggacaccgctagaccggcgtatggactgagacgacagactgttgtacaataggccgctccagattatgtctagtgggaagcccgcttgtggctcgggaaggactctgaatcgtgagggcttggagtcccaggtgttggatggcctaggaggtataccttcctgatgcagtccgcttgagaagtctaaagtaggtgagttccactcatgatggcattctgcagatgggcctgaatgcggtgcaggacatatgttacgagggccattatcaacataacttgttatacattcagggacaaataaattagaaaagaggaaaaacaaggattgttgttagaaccatgaaataaatgaaaacaaagataggaaccataacggactgcaagagaaaaaaggaaaaaagagaagagaaaagaataaacatagacagaaatataaagaaaaggaaagaaaaaaga

SEQ ID NO: 555258 - DNA, 218 bp, Homo sapiens
gttgctagtgagccatgattacgccactgcactccagtcctgtggtgggcgagctgatgactccgtctcagaatccacatcaaagcaaaacaaaaaaccctgttcttgtgactgtgcgtggtgactcacacctgtaacccctgcactttgggaggccgaggcaggtggatcacccaaggtcaggagttcgagaccagcctggccaacatgatgaaacc

SEQ ID NO: 555259 - DNA, 404 bp, Homo sapiens
cggggaaatcgccccgagggcgccccaacccgaaaatggtaatgcaggtttggtagtctaggacctggggggctgataggtactgggagcattaagaaattaaagctccatagggacttctcggcttgctgtgacatgcccgacacatcacgggcaggcaaacttcactgggtaaaagtaccagacaagctgaaccctagcggggccattcagacggggccctgcccttgaaagtaggaaagaggtgcctgaagaccagacataaaatgtgccattgcatagaggacaagctgtcactgctggatgcagctaaataagtagcttggaggaattctgggtaatagacatcagagggaaaaggcacatgagaagaagatgcggttaaaggattccgtaagagagta

SEQ ID NO: 555260 - DNA, 360 bp, Homo sapiens
cattcacagaagaaacaaccaagcattgcaaagagacgtgcataaggcagtgagtcttgctttataacaacccactctcatgttgactgatccagccccatgacagctagaactctctcaggagacagcactaatctattccggagggttcagcccccatgacccaatcacctcccgctaggccccacctcccaacactgccatgctggcagttaaacttcaagcaagagttttggtggaaacaaaccacatccaaaccatagcacctgtcacactcacaagccctaaaaacatgaattctagtgctatgggccagagctttcatcatgtgtgtaatgaacctgcaaacacgctcaagtg

SEQ ID NO: 555261 - DNA, 629 bp, Homo sapiens
  misc_feature (35)..(35): n is a, c, g, or t
cggggaacttggcggatggccccgggcttttccanacatctccctgccttattgggcgtgcaaggctgtgtgcgaggttatccttaggttgaagggaagtccctggcatgcctttcgtgttccccccttgccacgtgtcagtgggggccttgccctcccgtttagaaaacctgccccaatatgatgacatcaagaaggtggtaaaccaggcgttggagggccccctcaagggcattttggggtacaatgagcaccaggtggtttcctttgatttcaacagagaccccccctcctccccctttgacggtgggggtggcattgccctcaacgacccctttgtcaagctcattttctggtttgaccacgaatttgggtcacgccacagggtggtgggcctcatgggccacatggccttccaggaattagaccccttggccccccgccccccgcaagagcccaagaggaaaagagagaccctccctgttggggggtccctgcccccctcagtcccccccccccctgattttcccctcctcccagtttccatgttgacccctttaaaagggggggggcctagggagccgcccctttttttgttccctcaataaagtaccctgtggtccccccga

SEQ ID NO: 555262 - DNA, 181 bp, Homo sapiens
gatcccctgcagcagacacagcactacttggtcagacccctcttcaatagcattcttccagtctcttattaaataattgcttttgagatggctggttgtggtggcgtcacacctacttccgagtaggcccacggcgtggccgacctgtttgagtgccgtgtagttcactgatcagtcctgg

SEQ ID NO: 555263 - DNA, 161 bp, Homo sapiens
tgccccaaatcatctgcctgtttttttttgatacttactgaaataaaaggttttattgcagggtttattttggtttgtttaaatctttgttgtgaaagaagcttttttgtatttattaaaatccaattcccttatgaataaacttgatcatgggaccggga

SEQ ID NO: 555264 - DNA, 322 bp, Homo sapiens
aagtattagttagacacttaataagtttaagaacacttctcacagaataaggtaaaacttccatggctatcattactatttgtacaacagccctagtgttgtcaattaaaatgtgtttgcaggccgggcacggtggctcacacccgtaatcccagcactttgcgaggctgaggcaggtggatcatttgaggccaggagttggtgacccgcctggccaacatggtgaaccctcatctctactaaaaatacaaaaattagccgggtgtggtggtgggcgcctgtaatcccaactacttgggaggctgaagaaaagagtgcttgg

SEQ ID NO: 555265 - DNA, 125 bp, Homo sapiens
  misc_feature (91)..(91): n is a, c, g, or t
gacgtagcccactgatatggtttgtcgtgtctccacccaaatttcaccttgaatgtaataatctccacatgcaaagggcagggccaggtgnagacaattgctttatgggggcagttttccccata

SEQ ID NO: 555266 - DNA, 115 bp, Homo sapiens
  misc_feature (15)..(15): n is a, c, g, or t
  misc_feature (54)..(54): n is a, c, g, or t
  misc_feature (62)..(62): n is a, c, g, or t
tataatagcaagaangtcaagaacaagaagaaggttaatgaaggcaagcagttntaaggaanaggccaaaagttggcggcaaagcccaagtgcaatttaaatgaacctatatagg

SEQ ID NO: 555267 - DNA, 566 bp, Homo sapiens
ttcggctatagggcaggattcagaaagtagagtttgaacaactgactctatgataggacacaacctataccttctctcgtctagtgtagataacacggcaaatgggcctctagagggcagtattatacgccgactacatccaccacgaagcacttccatgcacataccaggtctagcacccacctggaatggaggccaatggactacccctctgctatctagggtacggcggacctagggtgtctagtctagcacaacgtacctaccagtggcctaggacctagcccatagaagtgtggtaggacatagtataggggtagctgtttagcctagtgtagcgctagtagaactatcaagatgtatcacatagagctaggtagaaacattgacgaaccatgtgcctggtcttttgaggactcaggagagaacctggcagctacagctgcagatactatttctcaaactatacctgatcctgcgggcaagctaacaccagttccggaagaacctgcggcagtcgcagcagctccaatgggatgagagctgggagcgacagtgctcccttt

SEQ ID NO: 555268 - DNA, 241 bp, Homo sapiens
  misc_feature (159)..(159): n is a, c, g, or t
  misc_feature (181)..(181): n is a, c, g, or t
  misc_feature (193)..(193): n is a, c, g, or t
ctacaacgccaaggcgatccgcacatgccgtccggccgaacggggcgtgtaaaacccttcttgctgtcctgccacagccgcgagtagtcgccacggccatctttcatccgaatcgcggctgcagatggtcggggagcacgacgtaagcaaggacggcangcggaacacgttcgcgcgccgngcgccatgcggnaaaaagcgaatcgatttcacggaccagaagatcgccttggcgttgtag

SEQ ID NO: 555269 - DNA, 321 bp, Homo sapiens
  misc_feature (263)..(263): n is a, c, g, or t
agagacaaggtttattgtcacccaggcactggagtgcagtggcacaatcatggctcattacagcctagaactcctgtgctcaagtgattctcccacttcagcttcctaagtagccaggactacagatgtgcaccatacacccagccaatttttttactttttgtagagatgaggtctcactatgttggtctcctgggctcaaggaatcctctcatctcagcctcccaaagcgctgggattacaggcatgagccaacgcatctngccaggagttctaacattatattgcgatgatggttgcacacctctggctatttaaaac

SEQ ID NO: 555270 - DNA, 396 bp, Homo sapiens
  misc_feature (90)..(91): n is a, c, g, or t
  misc_feature (107)..(107): n is a, c, g, or t
tgctgaggtcactctacgaggatcccggtcgacggggattgcaagatggatatgaaaggaatcttttttctgtaagtcctaaaaataagnncttatttatctgtacnatttggtttaaggacaaagataggggatggaacaggcatctctcaagactgcttccaagtcacttctcctatctgaattatcacttccccaaatgatggtagagccaaggtaaaatcattgggatgctattatttctttcctattatttattcaatttctccaaatatatggatgaggctatcagagttcttaacagtaacaatatcactctcatttgattagtttacaaagtttaataataatctgcaaggccaggtgcagtggctcactcctgtaatccccggtcga

SEQ ID NO: 555271 - DNA, 181 bp, Homo sapiens
  misc_feature (167)..(167): n is a, c, g, or t
tctagagcatccccgtttagatttttaaagcaaaaaaattttaaaaagaaaacatttggccaggtgcggtggctcacgcctgtaatccctgcactttgggaggctgggactacaggcgcccgccaccacgcccagctaatttttttggtagttttaagtagagtcgngggtttcaccggtg

SEQ ID NO: 555272 - DNA, 414 bp, Homo sapiens
tgagactaacagcaacatacatagtattatactatcagaggactaaagccaagatgtaagttacaaggtaacagactggtggcatcagaatatatccttaacacatgtgtcctgctccatcctccctacaccaggctacttacctgcccttccccagccctgaagaaagcccaggtaaacccagagggttactgaaacttacaccctttccaaaagccttagttaaggctgatgagattaataacttagagactgagtcatcccagtaacattaagaatttaatctacaaacaccaagttagcagggaaagtgacccctgccagtcccttccaatatattcttttttttcttttaaagaaaatacctataagcacaatatattccatttagatgatggggggtcagtatagata

SEQ ID NO: 555273 - DNA, 201 bp, Homo sapiens
tggaagaggtacttgctttgaagtgcacttcggcacattagtatagccacttgagctatgtttcttttggtttctgcatgaaatatgcatgtctatcctttactttttacacacacacacacacacacacacatatttgagcagagttttcatacataggatatacatatatttttatccaatctgacaatctgtgctgat

SEQ ID NO: 555274 - DNA, 706 bp, Homo sapiens
ccgatgacgcagacctgattttcggcgcgatctgcgataatcagcttatcaccgccagcaagctggaccgcttgcacaaggacatgatgatcaagttactgtcggctatctagatcttgtccgtgtctatcaaggagatcgcgagcattggtatctttgtagtaccatctgtaaagcttagccgagtgatgatcgtgcgagagcatactcagacccgtgactatgagtgaaccaggaccatagtattagttgatatcggctacaacaacgttcacgtgactctagtacacattggataatcctatgtgtacgcctaattctgtctacgacatcatcttgggcacgggctatatagtcatgctcgcaactgtctcttgaggtccacagattctacgatcccgccgtgaggccatcgacgcatgccgggcctctccagtttttacgctgttacgatcagccattcatccatggcgcagaactggttaccacaatatggccaatatgcttattaaacagtgtcccacttgaaaccgtctttatccttcaattcgacctaccgttacatttgcatattatgctcgcccacctgctacattccccaaacctatctaacacaccctagatctcatccatccgatgcaccaactttacctttatcacctctcctcctctaggttctactcatcgcttcctccattggacctcc

SEQ ID NO: 555275 - DNA, 140 bp, Homo sapiens
ggatgatcaagttgcacctgttccattgaatgtcgttgaaacttcaagtagtgttagggaaagaaaaaggagggaaaggaaccaaagccttttctttaggagcaggtcatcaagaaggtacgatcaaagtttccgcaaaa

SEQ ID NO: 555276 - DNA, 283 bp, Homo sapiens
  misc_feature (174)..(174): n is a, c, g, or t
agagaacggaaatctactctggcaaggaaatcctcacttaagcttcagtggagccacaagcacttaaaacccatgaaccttcagctggatcgtccttagccagtccaatctctacgaggaactgggcatatggtcctggcggtgggtcacccgtgtagctagaattacttctcncatatcccgggatggctcaattacaggtaccattggcagggcaacactttttctttaaacggcctctcactaagtttcgtttttatctataatctatcagcagccgggg

SEQ ID NO: 555277 - DNA, 327 bp, Homo sapiens
tgtaacctcgggccggtagagcggctcagctgcagttctcattaatcttcccttactcttggttttcacaccacagagtttgtgccacataattgaacatttactcacatatacttccttgtacggatctgcttctttactcttccagtagatctcaaactatgcagaatttgcctgactgtgcaaaagcacttaagtggtggtcagtgaatgattgattcattagtttgttcctttttctcattactcatttttttctttaactgagggagaaaagtgcctggtgacctacatttccctttttttcctcgactccatcatttcact

SEQ ID NO: 555278 - DNA, 1091 bp, Homo sapiens
attctctcctctaggcaattttttttatttttttcctgtgttggcccaggtatgacctccaacgtccggtggcccaagcaatcctgcctcagccgtgccaagtagctaggactacaggcgtatcaccactggcgcccgcaaagtttcatctgggtcggtcgttagattacaaagttggtgtgactcacaaatcactaacctctgttatattggacaagctctaatttcctaatatcttggtctctagtaaagtcacatctgtgtaacccatggagctcaccttttatatattaccctctagaattaaggggcctatgtggtttttttacagtcttatagctggtggtcctggtaaaagattggtccaataaacgagcttaatgaatgatacatcagtcagatttaaggaaggcagtcaataatggatatttaaactgttgggaagaggccttaaggatcaaatctacaccctttcggcttctgaagtatgaaaatctagtcttttaaggacgggaccacaaggaaaataatctctaaactaatggactaaattccagtgcgagtctgatctgacgaacaattagatttaaggtcaaatcatttacagatacacggggcatgcaaattaagtcctccatttacagattaaggggcattgcacatgaagtctccaggagacaatcagatgttgtgggaatgtctagattatataaggtgacacggttgcacttttactaaacataacacctaaacattccaatttgcccactggggacatctcctatagaacatccaggtgaaacttggtagagaccgctaaaccctacaaataccgtcatacgataagttgcccaataggaccggggacacaacacacacctttaatcagattacaggcccattcctccagtgttgaggccttctaccaatgctttccatccgaggcattaagagaacccgtgtaaacaaaccacggtaccccaatgtgaccactttaaaaaagtgtcactccgaaggaagggggggataagcagcgtgtataaccacaaaaaacttcctagtggggattcccacaaaaggtaacatcttga

SEQ ID NO: 555279 - DNA, 333 bp, Homo sapiens
atgcgggatgcagagactttgtagatttcctggcattacgatgatcaagggccgggtgtggtggctcacacctatatatcccagcaccttgggaggctgaggggggtggatcagaaggtcaggagattgagaccatcctggccaacacggtgaaactccgtctccaccaaaaatacaaaaaaattagccgggcatggtggcatgtgcctgtagtcccagccacttgggaagccgaggcaggataattgcttgaacctgggtggtggaggttgcagtgagccgaggtcgcaccactgcactccaggctgggtgacagaacgagactccgtctcg

SEQ ID NO: 555280 - DNA, 292 bp, Homo sapiens
agcttttgactttttttttttgccctaaaaggtatttagagccccttttagattttttattttgactaatcatttaaaaggtaaactaatcccccatttaaataaaaaactggtttatagtgccccaaaattccaaatggccctaagtaataaattatcagctgtgtttatatgtataagcaggcccagattttggtaaatatgtacataaaaaattggtgcccttatttttttcatttttaactcattgggtagtttaaacgttggggaaaaaataaaatccaataatcca

SEQ ID NO: 555281 - DNA, 535 bp, Homo sapiens
  misc_feature (430)..(430): n is a, c, g, or t
  misc_feature (472)..(472): n is a, c, g, or t
acttggtctgataaacattcaagaggagtccactcttcatcatgtgtggagatttcagggtggtgctaagaaaatgaagaagtcttatgccatggccaaaaagaatatgcattacagaaagaagattaagctggctgtcctgaaaaactccaaggtgcatgacaatggcaaaatgggtggccttcatgggaagtgccttttagatgaatgtggtgcaggaggttttatggccagccacttggacaggcattatggtggcaaatgtggtcttatggcttcaacaaaccagacaagtaatcgtgtatgagttaataagagacatgaactaagaaaataaaagtcataagtggaaatagagatggttcagccagttgacataaggtagagcacggacaaagagaagctgctcacctttagtggtggttatgtncggagctagcagaaaggcctccggatttcctccaggactcanggaaggcaggggaaggaggactttgtggtcttagtcccttctcacctctttggcataactccc

SEQ ID NO: 555282 - DNA, 479 bp, Homo sapiens
gctgttaacattttggcatattttccccatatttctctgtccacttaacatggttataatgatattgtacatacagttttacgtcttatgttgtacatgaaattctacatctccatttttttaaaaacttaacatcataacataaccatgttcccatgtgttttaaaactctttaaaccttattttatatgaccaatatgatattccactcaaatataccctacttgggaggctgagttgggaggatatcttgagcccagaagacgaaggttgcagtgagccaggatcgtgccactgcattccagcctaggcaataacagaccttgtctcaaggaaaaaaaaaaaaggaagaaagaaatggaagttcagcaatcctactgcacggttttcttcatctcttttgaaaaacatttctcaaccgcattggtattaaaccaattaaactacgttatttattaaaagccaaaagtgacaaagta

SEQ ID NO: 555283 - DNA, 128 bp, Homo sapiens
  misc_feature (7)..(7): n is a, c, g, or t
gacgtantgccctgtttttactggccgtggtacttactcaaacagagggaactacaatcagaggtggaatgcccaacagggtggaactacaaccagaacttcagaggacgaggaaacaatcctggcta

SEQ ID NO: 555284 - DNA, 331 bp, Homo sapiens
  misc_feature (7)..(7): n is a, c, g, or t
  misc_feature (30)..(30): n is a, c, g, or t
  misc_feature (48)..(48): n is a, c, g, or t
  misc_feature (90)..(90): n is a, c, g, or t
  misc_feature (189)..(189): n is a, c, g, or t
atgaccnaaaagcagccatcccatagcttnagggtgagccttcacagnaccagatggataaagcagcagcactagtggaggtctgcaccntcctgcttttttacctatctagcgtctaaaatttttcaacactgattttaagcaaggtctcgctctgttgcccaggctggagtacagttgctcactgcnaccggcgcctcccaggctcaagccatcctcccatctcagcctcccaagtagctggcactatgaggtgcgccaccacacccagctaatttttgtagtttttgtagagacggggtctcgcgcatgttgcccaggctgatggtct

SEQ ID NO: 555285 - DNA, 127 bp, Homo sapiens
cggcaggttcgtcggacctgacgtctgtgaccgccgcggacacggcgtgtctactgcgcgagagattcttactactatgatactgatgcttataagaggactttgactactggggccaggcaatcct

SEQ ID NO: 555286 - DNA, 278 bp, Homo sapiens
ggcctttgcacctccaccaccagggaagctgatgccaaatcattctacgtatgtatatacgaaactccttaccccccccggggaatagatatagtacccaaaagggaaagatgaaaaattataaccaagaacaataaggaaaactggatatattttaaagttgaattttttctagggtattcgggaagtggcacgaatggaatatcttagtggactgataacaacgttagagtgtaaagagtcgggtgcgcccgtaaaatgtaatgttctctataaaa

SEQ ID NO: 555287 - DNA, 706 bp, Homo sapiens
gcattcaggcggcgccaacgtgtgttgggaacaacaaagtctgacccgccgcaaggaggctgctcagttgcaccttcccaaggtcatcatccctgaaccacccggggcaaaattagcgccgtgcatatctaccccggttcattagaattgccaacacagcccacatcgccgtggcaagtttgcggtaactgaaggagtaagattgaccggcgctctggcaagaagctgtaggacaaccccaagtacctgaagtctggagacgcggccatcgtaggagatggtgccagggaaagcccatgtgctctggagagcattctcccagtacccgcctctctggccgaattcgccgtgcgcgacatgaggcagacggtggccgtaggcgtcatcaagaacgtggagaagaaagagcggcaggacgccggcaagcgtcaccaagctcggcgcagaaggcgcacgaagcgcgggcaagtcgaagacgcgggcgcccgcggcgcgaccctccccggcggcgccgcgctccgaaccccggccacggcccccgccccgccccgcacccgcagcgccgctcacggcgccccgaacccccgcaggagatgtctgacctcagcttgcagaggccctcggtagcaactgatgctcgccataaggtccagtgtaagttcttcaagaggaaaggcgcacaaaagccccaggcttccgcgcccag

SEQ ID NO: 555288 - DNA, 136 bp, Homo sapiens
atcgctaagctgatagcctccactagcacgttgaagtaactctgcacagacataggcttgctcagcaggcactggggaccagtgaggggaagagcgtgaatggggcatagctcaccacctccgaggaagtgggctc

SEQ ID NO: 555289 - DNA, 1773 bp, Homo sapiens
cgtgttcgttgatgctctgagatgcttgcgtttgtgcagagtgccatcgatcgtctgattctgtgatatgtctgcaccctctgtgttgtgtgttatattacactctagtgtcttctgtgtggtgaggaacagacaaatcaattgtggggcttcacttcaaccagcgataggattgcacttgtaggagttcctctgcctttcgtttcctttcttcgcttgcgggataatgtctctgtttgtttctatttagtttggtgcgaccagcagacaccctcccctctgttgtgtggctggatcgactatgtgcgtctatctttccttgaggggagccatctctccttgtggtggaatataccactcacgccccccgcgtcttgtggttgggtgagatatgtcgtcgttcgcctgcttcataatatacttaccctcgcggggggaaaattatatgttggtgcgcccctgtttttgggtggtgttctgccaccacaccacgaagtgtgggtggtcctctcttctcctgctcttggatgtgatttttctctacgggggaatccacaaaaggtttggctggtgggggcgcccacagaataagagaggggtgcccccacgaacgtcgttgttaggccacaacactagtgacgatgtgggtgcgacaacccagatagggcccgcactaccaccaaggagtggaggaggagttctccacacctgtgagggtgccgccccgacacgcccacgcagggcaagaacaacagcataggggtggttctgacggagggggccccgcccgcggagtgaagtgtcacctccctctgcttgttgtttctccagcagagccttttttttaagggtgattctccccccccgacttttatgatgatatcttcctctccagagggcggcgcaccaaccaagatgtgtgggaaatactccttggtgagagtgtggatagttcgcccacagctttgtgtcccagaagaaactctggggaggacacacaaaaagagtggggggacacccccaatccgtggtagcgctcacacgcgggtctgtggaacacaatggtgttcacacacaaggtttgtctcccccctgttttttctcgcttctgggggctgtgtgtcaaactcccaccacacagaggttttttgtgaccaacaacatggcgacagacgaagtgtgtctcacaccccccctgagaagtgtctgttagataattcacacacagagagggaaatcttttctgcaatttgtccgcgtgttcctctggagagggtggtgcccgcacacagtgtttgtgccacagtgtgtgtgtctgtgtattccacagagtgtgtggcgtatacccacacactctgtgtgcgcacatcacaggaacgctccactctgttaattcattcacaaccgggtgagcacacaacgaggtttccttggcctctgttctctttggagaacccgggaggtaaaccctcttcccaacttttgtgtagaaaaggttccaaggcctctttttggggtaagaaccacactcttgcctcttgtggctgctgcccctcgtggctgctgccacaccaccaagctgcttcctgctgcttgctgcaagccccacgctaaaggttgaaacccaaaggagaagagattcgcgagaggaagttcggaacgaaggaataatgggaatttggtttttttgactaatacaccccaaagccacccaattagacccgttttatttgcccaaacacagggaataaaggcgttactttcttttaaaaa

SEQ ID NO: 555290 - DNA, 133 bp, Homo sapiens
  misc_feature (55)..(55): n is a, c, g, or t
gctcctgacaccctcccaagcgcaccgctcttcccatctccttctggggtctccncctgccccactaatggccaagactcatcggatctccttctgcagacaaaggagaaagtcctgtggagcctgcagagcc

SEQ ID NO: 555291 - DNA, 215 bp, Homo sapiens
tgatggctagattctagagcgatccccctttgatcaaaatctctgagtctttgctacatgacacgatgactctctgcatcataacatttcatgctctgcaggagaaccatcaaatctatgatccagagagcctatctgcacgatgcataatcccggaaccccattattgggtaccgatcctctaattctctaactctgtagtccttgccatgttt

SEQ ID NO: 555292 - DNA, 106 bp, Homo sapiens
gcggccgcctactactactactgctcgaattcaagcttctaacgatgtacggggacatgtactggagtatttatttcatctattaaaatgttatgtttcccaaaaa

SEQ ID NO: 555293 - DNA, 947 bp, Homo sapiens
ggccccgccacgttgacacgatacaatgaactgtcacgagttatcatcttgagaagtgcaaagaagccccttgatcctgcagtgcccctctaccaccactactgacaaagaacatggtgctatctggcatgggaccaaatgttcagtttgctatgcgtttgtatgtgtcccctcaaattcaaggtgttgccagttgtgacagcatcaagaggtggggtctttaagagatcactagcgccatgagccgatctcttaggcactgggatgagggcgcccataattaaaggaggtcacaggggagcatccgtggtagctagcctcctggttatcgtgaagcaacacccagtaacgaagagccctctcagtctacacaatgtcgccatgctccttgatgctttgaggatttacaccaatgcctccaaagaagtggttgaagaaacataccattttcctggtacctttacaaaagttaccccaggtctcccttgtacttccttgtggatacgccagcgcatcaataattgaatggatacccattaccttgaaacaacctagaggcatttctttccacaagggaggtcaagtcgcaaggggctttattctggtctccagatatgtcgtgctaaccaacgggacactgagaacgggtggctccagggacataggatgggacaagttcatttgcttagaccttctcaacaatgccgctaatggatcaggattgtctttgcatcatccttgtcccttcgggaggcgaaccacatgctatataggccctaataaatgttacaaccactttagtattggctaaaaatccggcgctggtcagacagcactcattcacaaattccagggccaagctatactcaacctcctcacttaatgccacccccaataacggcagcctcccctgaattgcaacccgaccatctaaccacagccgaaag

SEQ ID NO: 555294 - DNA, 160 bp, Homo sapiens
acagatttctcagcttacgagttctctctgatgcaaggaaagggattatatgacaaggaggagaccaggcatttaagaggtggacagtggcgtttgggctccccatggacatcttttatatttttttggggaggggaggttccagagaaagggggtaaaa

SEQ ID NO: 555295 - DNA, 556 bp, Homo sapiens
cagctaggctggtaccggccggaggttcgttgcatgtgatccgtctgccttggcctctcaaagtgctgggattataggtgtgagccaccgcgcccggccgctaattttgtatttttagtagagacagggtttcaccatgttggccaggctggtcttgaactcctgacctcacgtgattagcccgcctcgtgctcccaaagatgctgggacttacacggctagtgcaccaccaaacttggctacatttctgctttctcttctctttttgtccgtatcttctccagagacaacacgctcctcgcctctgttgcccaaggctggatgtgccacgtgcgcatgacccttcgcccacgtgcaacccattcactcttccgtgcgcgtctcacagtgcatttcctccccgtggttagcgctccccgagaggggctgggcatttcacggggcctattgcccacccaacgaccccagcccttacctccctcgcgccgctctctccacgtaacacgcacccgcagttttcacccatgcttgcgcccgcacctggtctcgaactccg

SEQ ID NO: 555296 - DNA, 449 bp, Homo sapiens
taacacagaattatttatgggtttttttaaaaaaaggacggaagcattttccactgccaatgaaaaatactgaaaataagctctaactgtttgggaagggagggccaccatatggaaattgttttacaaaagtcaattgacaaaataaagcacccaggaaataaagggcaggttcagggcgtaatcctgcccgttgttttggggggcccgaccctgcattattgaaggaaacaggggcctggggttaaattgtaaaatgcaaaggggggggctcacaaacacagtcgggggggagggcccaaaggcaaaacctaggccggggaccgggcccatgcacccatgtcccttaacaccgtttcccagttttggttccttcctggggggtgggttaaaactcccacctgttttccctggctggtaaaaaaggggggtcccaggcctgcaccctt

SEQ ID NO: 555297 - DNA, 108 bp, Homo sapiens
gtcatcaaaccctgtcataaaaccctgtcatcgaaaccctatacaaggaggccactacagccaatttacgcgggtgtttggggggccttcttatattgcttcgttgga

SEQ ID NO: 555298 - DNA, 448 bp, Homo sapiens
caaaatgggaaacccattcgggccgggggtccccctgtttccccccccgtcgaaggagctggccctgaacaagttggtgacctttaggtgcctggcacgcggtttcagccccaaggacgtggtggttcgctggttgcaggggtcacaggagttgccccccgaaaagtaccttatttgggcattccggcaggagcccagccagggcccccccccttttgttgtgaccagcattttgggggtggcaaccaaggattggaaaaagggggcccccttttcttgcatggtgggccccggggccctgccgttggcctttacccaaaagaccattgcccgcttggggggtaaacccacccatgtcaatgtttttgttttcatggggggggtggggggcccctgtttttgagccgcccgcctgtccccccccctgaataaactccttgttccccca

SEQ ID NO: 555299 - DNA, 342 bp, Homo sapiens
  misc_feature (56)..(56): n is a, c, g, or t
  misc_feature (253)..(253): n is a, c, g, or t
actacgatctgacggacggcatcagactggtcacgtggcttgtagcaggcagaggnaaccctttgctttccaaagaactgatataagctccaacgagtcacggcatgtgggaatgtttccatggacactggatcttaacagaattgctatagtgtttacaaactacacaccagagaagccaagaagctgcagctaagcccttaaattgcttttagagggctgaaggaaccaaacctagtttaatccgtgtttntggatattgctcccatgcagaaactttattggaagactccccagactagtgctatttttttagaccgcttccatgaatggtccgtgaag

SEQ ID NO: 555300 - DNA, 347 bp, Homo sapiens
tctctgtgtataccttcatgtgtctagcttccacctaccgaaagagtttaggttggcagacaggtgggtgcttatttatctgtgaaactgaagttttaaacactggcagaaaatgtttgattgccatttccacacatggaaatagttacattgatgcctaatttgccattttctgcaaaaagctgtgccatgctggtgtcaaagactagacagtcgctattcataatgtttatcgcaattccttcatgaatagatcgaggagtcgcttccccaggtcactcgtcgcctataaccatttagctcaagtcggtaagccaaatattcagcttgcttgcgtgttcctatca

SEQ ID NO: 555301 - DNA, 688 bp, Homo sapiens
  misc_feature (1)..(1): n is a, c, g, or t
naaaaaaaacttgaagcctttttgttaataatttgggctgtgaatgttacttggcccaattgttccgaagggtattgtgtttccccaaaaacaagagggttattcattcgggggccccggacacgccagggctatgtaattttcaaacgacgggtctgtaaagaaatcttttatgaaaatattggggccctgaaaaatctccctctgacctcccaggttagggttcacacacctgccttaacagtttttggttttggttcctttgccttatatgcaaagggcccatgtccaccggaaaatttacaaaagcaaaatgattacaaagtgctgttacctttcttgtgctggcccagccaagtacaagtgtacttgacttggcccttaaacaattttattacagattggacatttgctgttcagatgttttttaccagaggaattatctcgggatcctgtgacctacaggttgttttatcatctatttttctctatttaacattcctcagatagataggcaaataggacattccttatgtgtcacagaagtagcgtggtagtggcagtctacagttcatatgatccgttgtatctatgagataaagatcgaccagtcatgtggccaaaagtattacatttgatttgatgttcacttggagtttactttttgtacatccaagataaaataaat

SEQ ID NO: 555302 - DNA, 620 bp, Homo sapiens
agacagagtcttgctctgtcgccaggctggagtgcagtggtgcgatctcggctcactgcaacctccgcctcctggattcaagcaattctccgtgcttgaatcagcctcccaagtagctgggattacaagtgcctgccaccacgcccagctaatttgtgtatttttagtagagacagggtttcaccatgtgggcacaggatggtctggatctccgtgaccttgtgatccaccaccaccttggcctcccaaagtgctgggattacagatgtgagccactacacctggccattttttaattttatattgtattatagtacttctttagttatatatttatttacttttgacgaacggagtctcaacactgttgcccaggactggagatgcaactggcgcaaatcttggttcactgcaacacatccacactcccaggttcacgtgattctcccaccatcaggcctcccaagtagctgggatagcaggcgcacgaccaccacacccggctaattttcaggtattcactgtaatagagacggggtttacactatgttggccagactcgtcttgaactcctgaccttgtgatccgaccagctcagcctcccaaagtgctgggattac

SEQ ID NO: 555303 - DNA, 175 bp, Homo sapiens
aaagagagtggatgaaagcacatctactatggttagatctacaccccacagattagtcttcacaggacaatccaccaccaggaatggagtccagactcataaagtaagctatgggcaactatggaagactaactgctcattcactggactgaagcggtgttttcctttctttctt

SEQ ID NO: 555304 - DNA, 365 bp, Homo sapiens
acttgtaagcccccatgatccctctgaattgttttactttccgggaacggcttttgcttttaaattgaagaagttttaaacagggctttcatttggtcacccctgcaatcccttggggtctagtttggaatttgccaactggaacaaaaaaacccttgaatccggggcatgccttggttttggggctgctgctgcttcccaagatccccagcagggatttaaaaaggaacccggggtgcccaccagatccccgaaattggtgggcttgccctcctggcaaattgctgggtctttccccttgctgttcagggcccctaaatgctgaaatgtggatgcatccccaaataaaagccattccttgggta

SEQ ID NO: 555305 - DNA, 258 bp, Homo sapiens
ttaggatcagcggataaaggggtacaggcatcgtacgtcggaggttaagagattcctggcagatctcgataaccgacctcatcagcaggaactaggcggccgacatgagtacgggaaagctctccaagcgcaccacgatgcgggaagtgtaggcgaagtccaaaatgtccccaaataccttgcgagctgatagtgtgcatctccagctcccggctgcccccgggcccgccgcctggtgcctgccgtcgcgcccctcat

SEQ ID NO: 555306 - DNA, 813 bp, Homo sapiens
gggtcactacacggagggggcgtgggcgggtgtgattcgtgtcctggatgtggtgcggaaggagtgtgaaagactgcgactggctgcacggcttccaggctgaaccactcgctggggggcggctacgggctcactgtgcatgggtcacgttgctcatcagcaaggtgcgtgaggagtataccctgatcggcatcatgaacagcttcagctgttgtgccctcaccacgaagggtgtcagacgactggttgtgtggagccactactagactgcacacgcatgtcctatctcacgctagctgggtggagaacacgggatgaggacgcatactgggatccgagcatacagaggcggctcgtacgtactagtcttgcttccgaaggcctcaaagtctggccgacgcccacctacggggacctcgaagcacctggtatcggcaccatgagcgggagtcaacgagctccttgcgcgttcccggggtcagctcaacgctgacctgcagcaaagctagggcggtcaacagtggtgcccttcccggcgcctgcacttcttcatgccccggcttccgcccccctcacaggccggggcagccagcgagtaccggggccctgaccgtgcccgagctcacccagcagatgttcgatgccaagaacatgatggcgactgcgaccgcgtccagggacgtagctgacggtggcaccggtgttccggggccgatgtccatgaaggaggtggacgagcagatgctggcatccatgagcaagaacagcagtatttcagtggagtggatcccaacaggtgaaggtggcggtgtc

SEQ ID NO: 555307 - DNA, 167 bp, Homo sapiens
ggtgactctagtaggatcccagcaacaatcttcaggggtatggttctgttgttatgatcagaatttaacagctggtgatttgaagtctcctaaaataagaactaaaagtgaaaaattaaatgcacaattaaaacaaaatatctagtttgagttattgccctagcatg

SEQ ID NO: 555308 - DNA, 1016 bp, Homo sapiens
  misc_feature (284)..(284): n is a, c, g, or t
ccatctcaaaaaaaaaaaaaattgaatctatctcaatagagaacaggtgaactagccctcctaaccggaccatgcacaagacaagaaatttctagcctttttttcccctttccaagggtgcaaggtgaggacataagccacacgtggtattctgcctccaaagtgattacacactttggccccgtgctcattctatctgtgaggaggttacgggttcttttccacttacgtgttattgccacatgtgtttctagttaaaaggattttttcaaaggggtgtccanacacctttattgaattctggctcatatcagatttaaatatcgtgaagaatctacagggtgttttatacattttaattttaaatgtgccattcttagaaagggatctgggtcacaaagaaagccttttacattatgccccaccttgggtctcagaaagctagagttcatttatcaaaacttaatttccatttcatatagctcaaaatcttaaaatctagggcatggccaactaaattacttggattctggtttaccttctctgatgacaattccatcaagccttaaataggaaaatgtcgaatctagggtaatttatcactttggtgtgcatcttatctgagtccagccatctggtactgctgtgcattttggaacaccgggggcttaaacaattgggttgaattactaagtgaaaacactaataccagaagcacaaatggtccaggagtgcggttccaggcactactaaccgtatgactggtttttaacctcatttgggaccataactgtgacttggtgagccttcttcccgttccatttcaagaacgtgagaaacgtgcctcaagtggtgcacaaaacgggccaaggggactaagcggacaaccacggacaacatgcacagggcatacgcagacacggaggggcgcgacacaacacaccttccggcgcccgtccttcatcgaggcgaagcatacagacaccaccaatgggcagtgcgcacccaacaggctc

SEQ ID NO: 555309 - DNA, 1342 bp, Homo sapiens
gtcgggtcacctgccttgacctacccactacaatacctcttgggactgtggctcgatttgaggtgtgggcccatcgctggatggatctgtacagaacacggctttgggtcttggccctgctcaacgactgcaagtatggcgcgtcagtgcgaggcagcatcctcagcctctcgctcttgcgggcgcctaaagccccggacgctactgctgacacgttggcgccactgagttcacctagtgcagcgtgagtgccgctatcaaggagctctttccacggatgctgtgtcgttatccaatgtctgccttacaggcctatatagcttccccctgtttggcctctgctcagcccccagtcccatacgtgcgtccgccaaccttcctggagttgcgtttttccgatgtcttcaccctggggttcgtatttggagaccgtctaagcagtgcggtagaagtcagctccaccagacgtccagaatcagctggatccatgagggcgtgtatagatgtgcccgagcgtgttagaccaacagtgggactagctcggacatagacacatatgatacagctggccggtctcagggaggccaatcctctgacgatctcttgggaagcgaccagacccctggctggccagctttgacccctttcggggacaaaccagccatgaaagcttccacctatttctacccctttcgcaagtggcttggtccactgttgcctcgtgcttccaaaccttccgacacactggaagtcccttggagagctgagaggtaaaagtacgtaagaaagggctctaggagggactcccctaaaatttactggagttcccccaaggcctaccagcaagggggatcaagatactataaccattgatgcgagattaaatcccgtgggaaaccgggacaaacaaaaagagcgacacagcagaagaaaacagagcacacagcagagaacaagcaacagacaagaggagagagtcagcacaagacaagtcggagacgcacgaacatgacaagacaacaacgaagaaagatgagacagaagaggagacgcaagcaggaggagcaggaataaataacaggggggggggcatagatagcaaaaaggaatgaggatagggaaggaagataataaggaagaattaagaagactagcatgtatgtgaagaagagagaggagacattacgtaatataagaagggaaaatatatgtggtaaaagaggaacgagagtcggggtaaaaagtggattatatctatagaaagaaaatgcttaaaaaacagacacagaaaaagagagagacagggaagaagtaagagtatgattagttgacgcccccgtag

SEQ ID NO: 555310 - DNA, 316 bp, Homo sapiens
ctggagcagctcctcgtgtgggtgtgctcccagctgaagtgagaataagtacctgattgtggtgaccgatgtggcaccccctgtgatgtggctacaatggaaccctgtgggggtgctggaggatgctgtgaactgatggccaagcgggtggtgctgtcaaagtcttctcgtgtggccatcacacccgaccaactggagccgcgtctgagcatcatctgccacggaccacacgtaccggcgcaacttcacggctggctgactggggccagagccgcgacgcagaggaggccatcagccaggccattcaacgcctccg

SEQ ID NO: 555311 - DNA, 332 bp, Homo sapiens
acctgggctggcagttacgtgcggaagtgaggtcaggtcctttaccagcacttatagaaatgagaaacgatcgctctcataccatctcttaatcactgtccccctcctaagcggtaatgggctgatgacttggtcttgagaattgtccttgctacacccaccccttctctctcatgttacttcaattcaatgtacttgccttgacgtctcggaccttttcgggccgtatgtgatcgtgtttttgtaccacatttcgaggggaaaatgttggattgatggtttaagggcaagagaggaggggctgagtgggttcaccccgaacggttatcaca

SEQ ID NO: 555312 - DNA, 207 bp, Homo sapiens
gccccaaggctggggaggggggcccttttcaggggtggcctggggaccgggggccccccttggggttaggccttggcccccggccccctgggggggttttttcctggggggccccccttggccctggcccccggttccaaaccatttcattggttttttttttggggccaaattaaacccccggtaggtttggccatggcctttgga

SEQ ID NO: 555313 - DNA, 314 bp, Homo sapiens
ggcggatggcgaggagccggagaagaaaagaaggagaatagaggagctgctggctgagaaaatcgctgttgatgggtggggtgtttgggacactttgagactttggaaggtcgcttggaaccatgtaaagaagttcctcgcgcgatcttggaccccttcacaaaacccttaattttgaacccaggcacttaatctcttccagttctttttagagacatgtaaagttctagtcatttgagctcgcggcttaggatgtgagctcctcaaaaatcttggcctttcttgttttagacagattcatgttatagatatgg

SEQ ID NO: 555314 - DNA, 123 bp, Homo sapiens
acgccagtgattaagctaggggacgccgatccaactttgacaggttaactacgctgaatgccaacaactaaaggaagacagacaggtggaacgcctgaatgaggatgtcctcattggccaatg

SEQ ID NO: 555315 - DNA, 305 bp, Homo sapiens
gcacgagatttttacaagtgaacatcaaaaagataaacaacttagttaaaattatttatatattgtggatactagacccttatcagatatataatttacaaatattttctcctgttctgtgtttggtcttttcactttcttgttagtgtcttttgatatacaaaagtttaaaatttttatgaagtccaatttatttttcttttgttgcttgtgcttttggtatcatgtctaagatactgacaaatctaatgtcatgaagattttcttctatgttttcttctcacagtattatagttttaatgctt

SEQ ID NO: 555316 - DNA, 1069 bp, Homo sapiens
gacagtgctgacactacaaggctcggagctccgggcactcagacatcatgagttggtccttgcgcaccctggaatttaattctctagttctatgctcttttatttcatctctttcaacatgtgtagcatatgttgctaccagagacgactgctgcatcttagatgacaagattcggtagtgcattgtccaactacctgtggcattgcagatttcctgtctacttatcagaccagagtagacaaggagtctacagatctcttggaagacagtcttacatcaagttgaaacacgagaagcatcagaagtctcacagctgatataggcagtccagagctcactgataatcctggattgaatccatctagaaccgggcatatgctagacgctgctacttctgagagatcctaggaaccagtgttagactgaaagttatgcaaagttatgaacggccagtcgaattttacacacagtgagctcaagctattcggaataattatgccatgggaaactactagtaagtttcaaacagtacgaatccatatgagaacttggatatggacccgtgacagcggacagacaatggtaggacccacagcatctggcacgcaagcagatgcgccaggacacccctttgcccgacaggaccacagggatggcggacatccatttgacttattcgaccatgggggacaaaggaattgagaccaagagacacttgggcccaaatgaaacgggggaaggcttagaaccgaccgccagaccgggagccgcgaacagactacgtaaaaagcaaaccctccctgaaagagcgcacaaagaccaggcaactacccctgaaagcacactaacaccggacacccaccagccacgccacagcgcgccccacgggacaacatcgcagacttggaaccggcaggcatcccaagcaacacaagcaccccgtcacaacacagccacaggcgtcaccaaaaccacccacaggcaaccaaccccgggcatcgccgccgactaccgcggacagcgaaccccgggcacccccaccggaccccccctcagacggccacagag

SEQ ID NO: 555317 - DNA, 196 bp, Homo sapiens
  misc_feature (55)..(55): n is a, c, g, or t
  misc_feature (192)..(192): n is a, c, g, or t
gctcttcgaccccatcatcgaggaccggcacgcggcttacaagccagcgattganacaagaccgacctcaaccccgacaacctgcagggcggcgacgactgggaccccaactacgtgctgagctcgcggcgtgccaccgggccgcagcatccgtggcttctgcctccccccgcactgcagccgcggggagcnctga

SEQ ID NO: 555318 - DNA, 132 bp, Homo sapiens
tcttaatgtgtgtctgactctcctctgtacctcttctcccatttgagagcctctgctcttaaattctctgctgtactacctccctggtaatgtccctcagctagaattcagtatgtaaaggtagggatagga

SEQ ID NO: 555319 - DNA, 134 bp, Homo sapiens
  misc_feature (65)..(65): n is a, c, g, or t
gacctaaatccccatgagcgatgaaatgtgcagacgtcatgctctgatatgacaaaggatatcancatgagactgcctcataactttttcttggtagatgaactagtctctaaaaacacagcaacacaacacac

SEQ ID NO: 555320 - DNA, 143 bp, Homo sapiens
atccccttataccccacgatcacggcaggcagagacacagaagcaggcacaatttatctgtggtctacatcagagtcatcataactctcatcactatcttagtgatcgtggggttgtaattacaaccccacaatcacatagta

SEQ ID NO: 555321 - DNA, 160 bp, Homo sapiens
ggaaattcggcctttatggccggaatggtggtaataatttggaattaggattaagggttaaccattcttaattggtttggagggctggattttaattggtaaaaatggttaattttcattccttctttaatttaaaattaaggttaatttttaaaaggtc

SEQ ID NO: 555322 - DNA, 138 bp, Homo sapiens
taggaggataaagccaggcgagtagaggaactagtagccatcgctagaacgctgggaggagaacgccacctactagctaggagccagggagaagcatccaccagccacacttagaggcataatccgtgaagcggaaaa

SEQ ID NO: 555323 - DNA, 212 bp, Homo sapiens
ctctcacacatcattctcatttcttcaacagatatttaggtaccaagcacacagtgatgcctatgttatatctcaaactgaatgactcacaggcacccaaactcaacatgtgcaagactagaaatatatatttacataactctactattactctttattctatgttacccaatcagaaaccgtgtcactgacctgactcacctacttcatat

SEQ ID NO: 555324 - DNA, 1336 bp, Homo sapiens
  misc_feature (1250)..(1250): n is a, c, g, or t
agcggctaagctcctcagaatgtgcttcagcccaggagtcggcaggttgcgatgatgacgtccagtatgcgccaccagcttggcgacattgcgacgatgaggtcgttgacaagcacgcgcaacgtatctcacaatactcacataggacaagacagagacagacgatgaacacacagatggattcaaaccagtctcgaggtctctgttaacgactccagctaggaacgtaaaggactcccggtaaatgccaaagggagctgcctgggttcgctcatctgcgccctcccgtggtacagcgcgtacctcatacctggtcccaatcgattgctgcttgacaccattagtgtcccgagtatacagcagcggacaggttgcagctgtccgagccttggggctttcaagaccctggggaagcgaagcgtcccacggggttgtgcccggcgccattttgcaacgaatggaacactgttgtgtctcgcagagatggcatgtcgcgcctatttattctttgcagaggaatactctgaagagaaggagtccgtggatatcaaaaagatactcagcgggatgtttcccctggtgcagagagacacaaaccgtgtggcgaattgtcgcgcgcctgtgagaaaacgtgaatggtaaatcctctgtcatcacacgagaggagtctttccaattcacccttatcctatgcctcaactcaaggggagaaattgtggcgaccttccttggtgggtcgcggcgcaaattccgcaaatttggggcaacgaccatgggtgttctttgggcttaggaaaaagaggaaaaacctttttggtaaccagaagcttagagtggcccaccaaacctgctgctaaatggtcattgtggtaatcgctcaggtgggaaacgcccagggaggtctaccaagtttttggccctccccgccgactaactcctggtggaaaatgctcggttacctaattttcctcgtggacaaaccacgaggggatggaacagaaagcgcggccttcccgaggaagggttttaccaatctctccctccttcttttagaacacagtcaggcaacactcgtaaaggaaaaggggaaagaaatacactattggtagaagaggcggcccccttaataccagggctttccacactgttaacgcgtacaacccggagtcaaattatagagccccccccacgggttatggcacacacaagatggttgtcggccgtccatcctggtagccttctaccttgtntgctcggaggcccgatttataatcctggtggtgggccacacacgcgccaacaacgaggaagggtccgccacgagtcgggcgaaacg

SEQ ID NO: 555325 - DNA, 300 bp, Homo sapiens
gaggatccccaccggatataagcggtagccagatgctgtggcttatacctgtaattccatcactttggagggccgaggcgggtggggcacccaaggtcaggagcttgagaccagcctggcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgggtgacagagtgagactg

SEQ ID NO: 555326 - DNA, 112 bp, Homo sapiens
  misc_feature (7)..(7): n is a, c, g, or t
gatctancagatcccttcattatttcatgccatatgtcgcatagactgtattattattattactgcaaactgcttttgttttaataataataatacagtctatgctacatat

SEQ ID NO: 555327 - DNA, 225 bp, Homo sapiens
gatgaagctggcagaccctgatcttggacttcagccttcagagctgtatgaaaataactctctgctgttcatggccacgctggtctacggcagccctgagcagactaatgacacactgccactctgggagagtcatgaccatggtcatggaatgaataggcctagatgctcagtgatacttgaaggtcccaaccctggtgctggaccagaccaccccgggaagcc

SEQ ID NO: 555328 - DNA, 350 bp, Homo sapiens
ccgacaatgtctgtgcaagactcggtctcagaaatatgacagtatgtactgttgggagtagtcgtctgatgacagggcatcccaaactgaggtttattcaataagctcggtcacttttgctgatatcattcagggtctatgtgtcttctatcgcttggtacactgatccccattccagcacactgtagctttattgccttctacacttccccatctgatcagtcttgcagttcactcagggggcagactatttcaattcgatagttcttcccgctcgatctcccagctctgcatgtagttcggtgatcacagctcatcgattctctcgtcttccgaaggggggcccttgt

SEQ ID NO: 555329 - DNA, 174 bp, Homo sapiens
gcggagaatgcgatcacgcgctgatgtacttcaaggcggatggaaggccttccttcagacccagctgacctaaacgacctgggggagaaaagacaccaagaacataacacatcgttggttccacgttaactttccataggaatataaaactcttccttcctgttaatgcgacgt

SEQ ID NO: 555330 - DNA, 784 bp, Homo sapiens
  misc_feature (177)..(177): n is a, c, g, or t
ctctgactcttctctttaatctggacgcctctgtgcacccaaatggacactttcacctctcccgcagaaactgcttcgtcacacagtaacttctgacgatttcccccctattggtccgcaccaacctgttgaacagccgtccacctggccagccccattttccttgcggagcccccnttgagaaaaatgttcccatgcccaaaattctctctttgaacttggttacacaccccaaggcaactgaggagaaggaggaggagattatttggaaggatatttttcccttcatgggccagccctgggatacccagggtacccagctaccagtattaggtggccctggctgggcccaacccctgggagttgcaccaagatgcctggcgaaactgtttggcccccccccctgcagacggccctgcccgagacccatgcttcctatcagcctgctggaggaggaggatgaacccttgaggttgaggcccctgtctgaaccctccctggacatctgcaaccctcttgtgcacaggaaagtccttggcctgaagccctggtttctgccaactgggttccctgggacctcccgggtgggggggttcgcggaggcacctagggtaccctcccgggtcctaggagggaaagccccggattcccggagggatccccggactgtgggcaccccatttttgggtttccccgcccctttcccctcctaatttgtcaaggaaaaattttgtttttccccgggtgatttttgcccctccaaattaaaatttgagactcgtta

SEQ ID NO: 555331 - DNA, 300 bp, Homo sapiens
gacatttagaggatcccccggcacgagcacagggctgtagacccagctacttgggaggctgaggcgggagaatcacttgagtctgtaaggtttacactgcagtgaaccaagatcacaccactgcactccagcctggaccacagagtgaagaatttttaatgcttaattccaggccagacaaggtggttcacgcctgtaatcccagcactttgggaggccgaggcaagtggatcacttgaggtcaggagttcaagacgagcctggccaacgtggtgaaactctgtccctactacaaataaa

SEQ ID NO: 555332 - DNA, 1854 bp, Homo sapiens
  misc_feature (2)..(2): n is a, c, g, or t
  misc_feature (683)..(683): n is a, c, g, or t
  misc_feature (1435)..(1435): n is a, c, g, or t
  misc_feature (1618)..(1619): n is a, c, g, or t
cntttattgaatgttatgttacggtttcgtgtcgtcttccgttctttgttttgtgttgtgtttgctcgtcgtggggtgtgttgtttttgacgtatgcctccgctgtgttcctggttgctcgcatcatcgacgaggtggttgtgtgctcgtcccggtgtgcgagttgtttatccgactcggactcattgtgtggtgcgtggtccgatggggcggtggtgtgctgcacgagtggtctctcatccgcctcggagttgtctctgcccgtgtgtctttgtttcctagtctggccttcatgctgttggtttctactcgcggctcatacatcagggtgatgttccgctgtacatggtctgccttgaacacgtgtcgcctccgtgtggcctctcttctttcaacgttatttttcctcggtgccctgtggatgggtgtttcgtgtgtgcgtcctgtctgccacgatggtttgcctcgctgccgtaatggtggctcgcacctggtgtgccgcagcagttggttcctccgttggaagtggcttcgtccgctggtgtgccccaccacagtgtttcggcccctgtgctgatgggggccagcaaccccgcccgcgggttcgtggttcctaagttggtctgacacctgtgtgcgcctggggcctctttcgtggagcggactactcgccttcttttttnagggttttctccggtaaattgcgggagagcctcttgttaaaggggtggcaacacacaaatttgtggccgcgggcccttgttgagataggtaatgtccctctcctctccagagggtgtgtccacacaccatgtttgaaccagccttgggggacagccgccccctctcacaagatgggggtgtatagagagcgcccctcctcggttgttttccacaagagggggcccaccactctcgggggcccgcgtgggaaacactcctcgtcgttggggctgttggctttatacaccggacgctggttgtcccacgcgggttgtccctcgtttcggcgcggctttttggtcccgaggctcccacttgggggacactcctcgtgggagaaagaccccctctgtatccgctgtgtgcaccctttgagtgtcgcctattttcccccccgagtgtgtccctcaagagtctccccgccctgtttataccgccccatctcccctctgtttccccaatatttctccgcggatacacacacacttttctcgcggctcccgagagggtgtccacccactcgttgctgtgtcacgccccgcccctctttcgcgagagggagagtctcggcgcacccctcgtagtacacgagaagccctcgcgtggtgagaacccctcgagacgcttggcctcgggacacaacgcgagaggctgttcacagcccacacacaggagttttgtgctggttgttctcctcgggcttcacacaggngggttcacacacgcgagatctgttccccgccgagagagatgtgagctctcgagactttgggcacttccccgcacagagagagcccacagcccacagggcacccaccacaccctcttcgcctgtggagaccacgcactattctggcgcgttggcacacccgagaggaactgtgagaaaaagggnnggaccaccctcttttcctcgcacttggtggggccacacgagggaccctcgccacctgcgcctttacacaccacagagaagagccacttcgagccccttggccgggtgtaacccaccccacagtcacacagtgtttgttgttactggcggaggtggagcggcaccctggtaactgaggccccccccctgttcccacaccccctggattaactcccagcgtccccccacggcccaaa

SEQ ID NO: 555333 - DNA, 1699 bp, Homo sapiens
gagaagatgcaccaaactttgatggcccagcagcagagggtcaaccaggacagaagcaaagcaccacattcgagacgcctcctcaatttccaacattcacaagcatgcaatttgcaaaaccgcaactcagcacaatgtttgcatgtctcatgcatcaagcgtgcaaacatccccgtcctccccgcaggaggcaggcaacagcagagccatttgcctcacaggcatccaagcattgtttggcgcacaaccatcacaagattccatttggcagcagctttggccaaagcgtgcatcgttcattccaacgacatcttatcactgtccatcaagtgcgatcaaacaaccacgttttgcgacaacagcaagcacagcagcagtcccaacagtcgaaagcatcatgggcagcaggcattcatgggcagttgcctcatgataccagcatcaaatgcagtgcacagctcgggcaacgttcaggatataagaaccgattgcaaccgcagccgaaagatccgttgaagtggagcatgcaagagtagatatgtgacaccaggaaatcgattgcgtacacgtttgaattggttgacaccgtacaagggacacttatgggcaggaagaacaggactatcggtgttccctcgcgttggcaagggactactcggtacagaaggatttgccggatggaagacaagccaacataatgggagtgtcccagtcaggacaaaagggggagataatatagcagttatggaaccaaacatgcggaaaccaccacgacagggaaccgggcaggacgaaaggatcacaaagaactgaccgggagcgcaaaggcaagtgccaagggcaaagaaaggcaagtccgtaacgcgagagagaggataaacaggtgctcacatggacagtcaccggacatgggacgattccacaggcgcgagaatttgaaagacaacagatggacagctagtactctcagccattggggacacagtgcgaagccccaggtagaccaagtgggacaccaacggccccacggggacattgaacgacacaactgggggaggacaaggagagagcacaccccgaagcgaatctgaaagaattgacaacagttcgacgcaggcgacaaaatagggatgcgtggggcaccagcaaaagcagtggcaccaagagagataggacagaggcaacagatcggcgaaacaagatgaagaccccaaaggggcaggatcagaagacaccgaaggaggaaagagacaaacagagcacacgcgcaacatggtaggaacggagccagacgagatacaaaaaagttaaaaacagtgagaacaacggagaccacagtagggggagacaagacgaaggaccacaccgagcaacagcagaactcgaaaggaggtgggcacgagagaagggaaagggaagagaccgcgtggcacgaaacatgcgcagtggtggcaaaggagcgcacactgaccaaggataaacgagcggacgggagaaaacgatagacaccggacaggaacgcgagcggtagagtcgagtcggtacagacgtcgagagacagcaaggatgcagacggaaggagagaaagaaaccaggaggcgagtcacgcaccgagcgcacaacgaggcagccgcgcgaccaggagcagacggagagcacagacagaaccgacgagctgggaagacgagacagggacaac

SEQ ID NO: 555334 - DNA, 88 bp, Homo sapiens
gccataatcacgatggggcgattctagcgctgagtacgtcgtggagtcacctgcgagttcaccaccatggagacggcatgggcagcaa

SEQ ID NO: 555335 - DNA, 149 bp, Homo sapiens
  misc_feature (18)..(18): n is a, c, g, or t
  misc_feature (56)..(56): n is a, c, g, or t
cgagcgctgtaccccgcnggccaatggcaaacctcatctctactaaaatacaaaanttagctgaacatggtggcgcacacacactccattcactgtctccatgactctggagtaaactaacgtctcgagttgccatttgggccagcggg

SEQ ID NO: 555336 - DNA, 340 bp, Homo sapiens
ctacattccagttgttcaccttccatgatgccagtaagaagagagtcaaaggctgacaaatgcacaggtgttttctcacttttcttacatcctaccccctctcagttattcattatggtaatggcactttgtgatgtgcaatttctggatttatgacccattcttgataagcatgaatctggactgcctgtgcatctttgataaggttctagttggatagcagtgacctttctggatgtaattctgggaggaagattaaaaagcagtccagaaagtgacaggtttgggacaataacgtatgaatttggctctgctggcaggcaagagatgtaagccgtga

SEQ ID NO: 555337 - DNA, 331 bp, Homo sapiens
  misc_feature (32)..(32): n is a, c, g, or t
  misc_feature (86)..(86): n is a, c, g, or t
  misc_feature (88)..(88): n is a, c, g, or t
  misc_feature (117)..(117): n is a, c, g, or t
  misc_feature (119)..(119): n is a, c, g, or t
cccccccccccggtgattaaaaaaaaaaaaanattggggcgcccccgcccccccctttactcctccgggggtgagggttggccccngnggggagggggcccctcccccccccccccntnttttccccaaaaatttgggggggggccccccccgggtgttttttttttaaaaacccccccttttaaaaaggggccccggggggggccccccattttttgggaaaaacctttttttttttttttccccaaccccccccccccaaaaatttttttccccaattttttgggggggggtttttttttttttaccccaaaattttttggggggggga

SEQ ID NO: 555338 - DNA, 348 bp, Homo sapiens
ccacggtcagacagctgaaaacagtagagctgggattcaactctggctctgtctgatgcccagaaaacaaaacaaaaatccttaccatgaccttgggattcccgtatgccaaagtcccatcgctaatgctgctcatcatgaccaggtttggatgaggagaattgctgcagcttcaaacaagccaaggaggacttgcgccactttaacttgataaaggattgcatcttaagtgttctggttggtgtatctttttggagacggagtttcactcttgcccagcctgggcaacagagtgagacactgtccctgtctcttaaaaaaaaatagtgacaggaatggtttggcgag

SEQ ID NO: 555339 - DNA, 722 bp, Homo sapiens
taaattagtagatctatgtgatagtatatggtattttatccagaaagtacttgctcaatgataggttcaacttcagcatataattcatatacttttataaaagccttttcatggcattacatagaaggcctttccttggaaatatttccataaaataaacaaagcacttaaatcagtccattcaatagcattgttttaggattattaaagaaatacagagtttgacttccgcagtgtgctaacatggattattctttcatttgctgatccttgtatgtgcagtaggatgttgaacagtgggggtggtggcagcatatttctacatcaccttggactttacctttctgagaactcaacataggttcctaacttttttatgggccctgactggtgcttcagtaaacccacgaataaaaagcagtactccaatctgcagagactctagaagaaaatactttctatgaaccaaaaaacaaaagcacggaaggcttccatccatcttacatctttgacctgctaagaggaacaccattctacacatttctccacattctttctcatatcagaaatagggggattgttcacagcattttgtggaccaagaaattacacatttcctggcactcaacaacggagcgagttcgaaactggagcctatacttatactttcacttatctctgggatccataacatgctccactacccagggatccaagtaaag

SEQ ID NO: 555340 - DNA, 417 bp, Homo sapiens
cccttagttgccaatccacgccaacatctactgttcttgattctttgattatggccattcttgcaggagtaaggtggtatcgcattatggtttcaatttgcatttccctgatcattagtgatgttgaacattttttcataagtttgttggctatttgtatatcttcttttgagaattgtctattcatgtccttagctcactttttgattagattatttgtttttttcttactgatttgtttgagtttgttgtagattctggatattagtcctttgtcagatgtatagattgtgaagattttctcccattctgtgggttgtctgtttactctgctgactgttccttttgccatgcaaaagctctttagtttaattaggtcccagctatttacccttgtttttattacatttgctttcg

SEQ ID NO: 555341 - DNA, 1296 bp, Homo sapiens
ccctccaccagtgctcgtgctccgggcattatggatggcaggctgctgcccgcctactggtattttgtgtgtgccctggggatgtggagtctggtgttcagtggtgctccagtgctccctgccctgctacctgctgcatggacagcactggctgctgcttgtggtggacttggtaaatgtaggcccagtactgcccgatgctgctaggaggacctgagaccgcttttgaactaactggggacaactacaccaccagaatcatgacacctgtctgagacgatgggactccatacctgcagctgacacgaccggacatacgtgaccctgacctgactctgggcatagcccacacaacagccattgtatcccacgcgagaccttgatgcatagcacattgccatgaccatagcccccacaggcatcgcctcccataagaagtatacgcacatcactcaagagtggttcccgtcccaaccatctgtccttgccatgagtgtggctacgcgccttcccgtaatgcgaatagcctctccccaagcatccaattgacgcaatgctcaatccaagacaaagggacgcacccatatgttacaaaccccggtttcgtatcaccctagatagagcacattggcacccttcatttcccacaccaactaggcctgaatgtcgcagctccccaaaatattccatatccccatatgccgttcttgtccccttcccaaacgcgtctcgtactttacgtaccttggtagtccatcgcatgggacatgtgacaaaaccgtttttaccccttccttatcgggacccgttctttctaaccccatcctagggtgcaaccatgcttggagggttacgacccacgacgcaggcgcgacctcttagaagtacaacaagtccttctgcatacatagcacaaagtttcacacaatcaccttcgccacatcccactgcacaatccaaaaatcgcctacatcatctcctaattccttgtaccctatcccaaccacatgcccttgttagcacaataattccctagaactctcaacaccttatcttagcccatcataccaaccccttcccagcaatcacaaaactattgaccaccccttaatctctcttttcccccgaaacaatgaccacacacatccaacccaacagacccaggagactgtacccatactctaacctctacacagcccacatctcccctcttaccctactactgccacagatcaaggaacaaagatacattaccatacacaacaaatttctatcacacaactctcgatatacttc

SEQ ID NO: 555342 - DNA, 987 bp, Homo sapiens
gtggcacatgcctgtaatcccagctactcaggaggctgaggcaggataattgcttgaacccgggaggtggaggttgcagtgagccgagatcatgccactgcactccagcctgggcaacagagtgagactttgtctcaaggaaaaaaaaaaaaaaaaaaaaaatctgggggatgaaaataaccaaaatgaaaatagctagaaaactcagcaagcaggaagcgtcccttttctcacccttttggtcccctggcggataaaatcagtcactattacaaacaactgaaagacgctctgctttaacaccaatgatgcacagcagtacttacttatgtattccgaggtgaccttatatagatggagaagaggctgcattgggcagaactgatgtataggaagacccattggttcaagcttctccctgcgagggacaaatgctctcggtcattatagcctctttaccacagactgggccattctagtgaacccggtgggtaccccttggggttgcccaagaaaaccattcttatctggtttccacttacctcaggagcggaacgataacgcgggtcatccaaaatctgtattgcaacgctatctcatctcctccccaaaccttctcctcctgggaaacccaactgcctatctcatctgaccaaaggtctagcaggataacgcctgacacgactcggcagggcaccctatcgcgcctgggcggaagccctttgcctaaaacccaagaaggccggccggactaaacaagggaggccccaaacgggcgggccggcatccaagcactccaggcccccccccggaacggacggttgcacacacctggctaaacggaggcctatccagcctcttctcccctgccatccacccgcacccgcactgccgcgacgcaacacctacgcctgaaagacccacagacagcccgccaccaacgcgtacgacagaacacaactccctgacaccgtgcccggcgcgacc

SEQ ID NO: 555343 - DNA, 274 bp, Homo sapiens
aatattgtttataaggccgcaatgggtaacccacttatcagaacataggtgcaaatggccactcgtagtttctttgtaaaatggttgacaataaccacgttctttcacatgatttatcttgcctagatgtgtgtctcataaaaaaattaagtggtaaaactttgattaaaactaatgcactttaaactgttaatgtaagcttaggcagggcgatcttattctgagaccgtgcattagtggggccggcaccagtaggcctcataatgattattaa

SEQ ID NO: 555344 - DNA, 182 bp, Homo sapiens
cgtggatttggtcagtagacagtaaatatcactctgttcatttttcctgtccaaaattttgactgatgggagaaaaggatttgtgtgaccagtgctggtgtattgactatggtgtactttctggtactttgtggtaagaatcatattgtttcatccatttcctcctagagtagtcttttctt

SEQ ID NO: 555345 - DNA, 158 bp, Homo sapiens
agttcggcacggggcgggggagcagagggaggtgggctgaggcatcggtggggcaggtgcgacgaggcgttaaggagctggaggggttcctaatacacatttaattcagtttctcttccctaagaggctgccggagttggggcctcctccagcagaga

SEQ ID NO: 555346 - DNA, 1666 bp, Homo sapiens
ccactcgtgctgtccgtgtgtccactggcatgtccgtttatggacgcttatatgtccccccttcttgatcttcttctacttcgcgtctcgtgttcctcgtcgtcaccccgccctatttgctcggtgactcgattgattccaggtgcgtcgtcccggtgctatccattaagtgctcgcgttgtcgccatgccacttgtctcggtgtccgtggtgcctacttgggttacggtgactaagctgttcctcccagtgacacacttacaccgcgatcttttctgcttgcgaaagttctcccccctttctgtgccgcgtttctttcttccgtcggtgtgggaacttccccatcggtgaggcgttcaaacttgttatggatcccgttcggcgagttttccctcacacatgtgtggtcccctattttaatgggatcgctgtgtcttccgctgtacctacaagcctggatacgtggcgcatcgcgataactgagtcgacactcctatgtagggcccctgtttcctgtacccaacgtatcccacataacgggtggtaaagcaaagccccagggtctagagaggcactctgggaatgtcccccatttcctgtgtgatcctccctccatgataagctcccgcttgtcagatgaataccaatcttgtaaaccgcctgggagatcttcatgccttccgtgtggcggtcctagggtgacgcccacggtggatggaaagcacaagaacttgccatttgttctgggactttcctctggaaggaactaccaaggtctattgcttcctgatgacaaggccctaccctatcaacccagctggttccccgttttcaatgggggaccctcaatgccatgggcttccccagtagctcttcgctcaggagatctcgcgccatttctgcttaggatattaatttgcccaccaatcctgccatcggccgtcccatgagatgaagcctctctagaacgggtatgccttgtattagatcacgtatacgtcttcgctttcaacacacagccgtcgtccgcggttcgtttcgcacatccaggtgagtctggcgtctcttgcagtgcaaccggtgtctggttacggtgaggctgcatgaatagcatcgcaaacgtgcgtcgttgattacactcgccgtgacacccctaactctctacacgtatagccgtgcgtcgcttccatgatgtcacacggtgtgcctatcgagaatcactgatacatgtgtgcaatgaagccgacaggacacatacttccatgcctatgctatgtattcctggctctgctcctacgaacatgatgaatgacacgtcctatgcgatagcttggaaagccccatatctaaagaccaggccaggcacttagtgaactcacagcctcgaaagaggcccaatagaacgactcacatagcccccctatgtgaatgtagcaaatgaagtgcacccttgagagatgtacgatgctaaacctcttcgcactagacagattctctaacctggcagtccatgccttcagacctcagtggttgtttcagtaggacctttgacaaacacgtcaaggccccttgttcactctccagatttcctcctacctaatggcctactgacctcccctagacgggatgtctttgggagggaagaaagataccgaagaaagattga

SEQ ID NO: 555347 - DNA, 310 bp, Homo sapiens
taggaatgtctctatttcaggtaagttatctaatttgtcactgtaggccgggtgtggtggctcacccctgtaatcccaacactttgggaggccaaggcaggtggatcacttgaggccaggagttcgagatcagcctggtcaacatggcaaaacctcatctctacaaaaaaaaaaaaaaaaaatagccaggcatggtggtgcactcctatagtcccagctacatcagaggctgaggcagagaatcacttgaacccgggaggcacaggttatagtgagctgagattgcaccactacactggagtgtagtgca

SEQ ID NO: 555348 - DNA, 1061 bp, Homo sapiens
tttgttttgttgtgttgtttttttgttttttgtggtttgtggtaggtgaggggaagggagggaaaaagcggagatgcaggagaacagagaagacaaccccccccggtggaggagtcttctgtgcttatgcgatttctgtttcgagaagtctctgttgggtttttttattgtcgcagtgtgtctcgttcgttctacgatggggtagagagttgccccgatggatcacactctcggtacacatgggggcccatctgccggacaataagggggtaaaaagagaggtcttcctctgggccaccacatttgactcccccggttttgtcccgccgatttatggccccccttatttgttgtgcctcacgctggggcccccatgtgggggaaatcagcattggcccaaaaaacttttgggggccccttatgcccccaccaagtcgcagagtccccccgttgcgatcccgggcacgcacttatggagattctggggtggcgaacacaacaaataggtcggagggttttcgctcttgggcggaataaatctctcgctttccctttggagacaaggcgtccccgggcatatgtgcggccccccgactttggggggtgcacgcagagcttcctaaacctccggctttcacctgcttaaccgcgcgcgcctctcattgaagggtctactgccacttactctgggagtctttatgcagtatgtcgttgtcccccagagggggagacaaggaaactctgttcggtctactgccataggctgaatataaaaagtaattataatatgttaccaccattgtttatttttcacacgtgtcaaaacacaagtattccgtctcgtattacaacccgcacccctgctcccggcgacactcccccccacgtcattcggcgcatacccccccccccacatctcttctcatatatcattgttacacaatcccacaccgccctaccttctcagagtttaataacaacgaagagttcataacaccactccccatttttataccaaactatacccccaactccttatatctttccgatcaaaatacaaa

SEQ ID NO: 555349 - DNA, 427 bp, Homo sapiens
atggcaggagaatggcatgaacctcagtaggtgaagcttgcaggagaatggtgtgaaccccacagggcgaatttcgcgtgaaccccataggcaggctgctgtgcagagcccagatcgtgccaatggattccattcctataaggtaaaagccactgtactccagcctaaacgacgtattgagaccctgttcctaatataattgtcttttaatataaaacataatgtgatccatgtctgagccaattccaactgtagagtttcgatctcttacttcccaggtatctgggctcgtgttctgtctttcccttattgcctcttacattctttgttcccctcatctctgtttgccttaattacagattggatgttttatagggatctaaggtccacttcttttgtctctgggtatatctcgagtttccttatc

SEQ ID NO: 555350 - DNA, 333 bp, Homo sapiens
cgcagagtgggaagacgagtaccggcttcgggtttcccttgggatcaattttacatttaccgtgtacctttcccatttgtggtcttgccatttggcagggggaaaatgggaggcttggcctatcatttgtgaggcagtgtgagcagaactgatgccagcatgtcactggtttgaaagggatgagcccagacataatgtttggggattgtccttatttaaaccctcaaggtctcgcatggtggggcccctaaccaacctacacaatttccctcccacaagtggacttcagtttcttctctgtaaggcatctggccattcgcactccctagtgtg

SEQ ID NO: 555351 - DNA, 433 bp, Homo sapiens
tccgggatactgttacgtaaccttagattttaaatcatgacactggggatatgcacaaggggacagggtaggatatgtgaccaaaatataaattgctttttcccaagggtagtcattttctttaaattcatcctatccactttggcccactcccccaggtacagattatcctttagtcatacaaattcactctccaattccacatactttctccccacttgagggtaattatccaagagggcaacacaatacagctggttgataaagtaatttaaactattggtaactgaaataacaagaacgtaggtaataatcacatagtgtaaaagataccaaatgggagtacatatggatgtcaatctagtcttatatttaccaaagtacctcctaagggtctgagcaggagagtagaagggcaggagctcgagggaaa

SEQ ID NO: 555352 - DNA, 363 bp, Homo sapiens
tgcattctgttggtcgttctagagtatccccctctggatgctaagtgttcgctttgtcttaataagctgtatttaatagttgcagccagctgagttgagaggcaactatgctcactgctattccaccaattgccacattatgtatggctgaattgtgaacagaagaaactgtatcaagttttgtagcattttagtatgaaaaaaaatacagatcatctaagcaataatgaaataattagtaattcacattatttattctactacaattataccagactgagaaactgactatccattatgatatccttcccaaaatacctattaactgacttggggatttaccataaaatccttggtctgagg

SEQ ID NO: 555353 - DNA, 316 bp, Homo sapiens
ataaacaaaccacatagccattctcttccttcactccaacctaccaaaatccacattctctgcctttatccaagctatcctcacgtacgattattcacataagaacattggtaccaccgccggacgcagaggctcacacctgtaatcccagaacttagggaggccgaggtgagcagatcacctgaggtcaggagtacgacaccagcctgaccaacatggagaaactccatctctactaaaaatacaaaattagccgggcgtggtggtgcatgcctataatcccacctactcagggggctgaggcaggagaatagct

SEQ ID NO: 555354 - DNA, 261 bp, Homo sapiens
cacgaggagcacttccatatgcttttctaggcaggacatgccagcgattagattatgagacagcttaaagacagaggtacatttaccagagaaaacacgcctggtagctcggccggccccgcccatgctggctcagttcctgcccctggcgggaaggggccgaggggtttcccgtcccagggacctcccaccacaggagttctgcacaccggactggcctggcagtcagtcccaggaacactgaccatccccttagggagg

SEQ ID NO: 555355 - DNA, 496 bp, Homo sapiens
  misc_feature (27)..(27): n is a, c, g, or t
  misc_feature (226)..(226): n is a, c, g, or t
  misc_feature (296)..(296): n is a, c, g, or t
  misc_feature (344)..(344): n is a, c, g, or t
  misc_feature (390)..(390): n is a, c, g, or t
  misc_feature (460)..(460): n is a, c, g, or t
gctgggattacaggcccctgccaccangcctggatcattttttttgtattttagtagagatggtgtttcaccatgttagtcaggctagtctcaaactcctgacctcaaatgatccactcgtctcggcctcccaaagtgctgggattacaggcgtgacacccgtgctggccaggggttttatctgtaagtccctgactggggctgctgctttttttcagagatggcntgcccagagaagaggaatctagagaggacgtctgggcacagaagcctttgctgagctgtggtggggctcnacccagttttgaactttccctggaagcttttgtttaaaactggttgangggtaaaaaccaacctacttcaaagcctcaagcaatgggcgggacnaaccccttcccaaccaaccaaagctcaaagcatcccaaggttcgaacctaagaactggctggtgctgggnagcgaagaattttcaaggccagttggattcttaagg

SEQ ID NO: 555356 - DNA, 179 bp, Homo sapiens
gtcgacctgagtctgtccacatgacaacttcactgctagcataaccagcattcaagaaaaccaatgtactaaacaaaactgcaaccaaggatcctcacagagtccatttcactcccctgctacctccaccagagcaggtggtggtatccacggctgagagacctgaagatagatcacat

SEQ ID NO: 555357 - DNA, 466 bp, Homo sapiens
  misc_feature (2)..(2): n is a, c, g, or t
  misc_feature (61)..(61): n is a, c, g, or t
  misc_feature (289)..(289): n is a, c, g, or t
  misc_feature (374)..(374): n is a, c, g, or t
  misc_feature (380)..(380): n is a, c, g, or t
  misc_feature (387)..(387): n is a, c, g, or t
  misc_feature (409)..(409): n is a, c, g, or t
cncccatgcccagccctgaataaatcttatgttgaataaaaacccctacgcccagttaccngagttcatccaaagaaatatagctgtattttcaaatttgtcaggtagctggtaccaagctaacaaaatactccttgagaatatagtttcattggttcacatcaatggctagagaagatttgacttccaactatttagtcaattaagcaagtgagcattccaaaacaaaggatatgtaaaagttagataaaaatacctgcagggtttttgttttgttttgttttttganatggtcatcttgctgtgttgcttgggctggtcttgaactcccctactcaggtgatcctcctgtgtcaaggtacttttatttaacncaagtntattatnttggtttatatggacatgtcanatgcagactttgttataatgaaatccttagtgctcaataaaatggtcattgaatcta

SEQ ID NO: 555358 - DNA, 114 bp, Homo sapiens
atgcgatactttgcctgactgtagtatctcaattaatttaggggctgtacttcggcattgtggtcgtgataagcccaagttttggtgggtatgttaaagtggttgagcagttag

SEQ ID NO: 555359 - DNA, 484 bp, Homo sapiens
taacaaatacattaaaaagaatattacctcacagtaggcaattagacaatgccagataatttatacttcagtggctacaatgtctctaaaatacagccactgatgggctggaaggcagtttctaatgtgctcagtaataactgggtgaggacaattttggccaagggcaggagaatgctgcaaactgctgtatgctgcttatgtgaggtgtctgttatcagagagcagaggcacaaaaaagttaattcacaaggttaactacaggtgatttgggtttactatcctagactcacaaggatgtaacatcaagttgaaccttttgagattaaaaacagcatccatccttgattcctaactgcttttgttccttactcttgacaggcaacccttcctgctctattttcatatcctttttttttttttttaaaccaagtctcgctctgtctcaaaataaataaataaataaacaaaaagttggcggccg

SEQ ID NO: 555360 - DNA, 759 bp, Homo sapiens
gtcagagagggtcccagttagagggggttcaggcgtccgtcgctgccttcctgcgctccgtgccctactggtaggagcactgccccgggccgatgcgtcgagcaacttgcccaagcctcgcatgtagtcctcaccccgttcgcaagaccggagtactactctactgcggccgtcgttaatccgcgttgaccctgaggaactgatacgggattttagaaatcagctgagtattaacacttgaaaggccttattcaagtgctctgtaaattggcttttcatttcttggctgcttttttgtgttgatgcattttgctcttcagagagatctctttctaacttaggggtctgtcttcgcatgtattacaagccagaatacaggtgtttggaacctagaatgctgtttgtgcgtctgtcatcaaggagggaacagttgtgcctgtcactggaggtgatgagaccctgttcgagtgaaagtggacgactatgtgccaagtcaacgttaactgtgaagttacacacagtagctgaacttcaaagtgcctgttctgtaaagtttcattataaactgttaccagtagtccttaagttgtttatgctttatcagactggctaatgtgaaagcataatattatgaagtcttattctgccttatgagaccttaacgaaatggatatcatcttacaggctaatgtgaactgatcagtcgtgtaaatatcatcctgtaacgtggggtgttgtttgtgctgcggtggggggggt

SEQ ID NO: 555361 - DNA, 495 bp, Homo sapiens
cccgcagggacgcccgaaacccccgtcgggctaggactaagacagctgcgctgagcacatcccaaaacgtgtgcagccagcaaacagcggggccgcatcaacccaacttaattatgctgggccccgccgagacccgcttgagtaagatagcaggtgccacaaaatgggggcgcgccccccgggggccccccaagtaggagggcaggtgcgtggcaaacaatgggggccccccccaacgcccaaccacaaggtgttccttagcaactctctcacccagcacagatcactaaaatttgctgcttcatgcaagagagaaaagagcgaatggattctgcctgctcagtcacaataaaagcttggcactacatgcagtggaaactttggaggtgacttttccaacgggggggatccgctcatttcagtaatgtaccccatatcaccatccgcaaagttaagtttttggccaaaaaaaaccatttgagaggacaaaaaaca

SEQ ID NO: 555362 - DNA, 105 bp, Homo sapiens
ccggaacagtcgatggctattgaggagtatcctgaggcatgggggtcacgggttgaggtcttggtgagtgtattggtggggttagcgatggaggtaggattggtg

SEQ ID NO: 555363 - DNA, 151 bp, Homo sapiens
ccccaagggggccccccccccctttttttgggtgggcccaaaaaatttgggggggccccccggggggggggttttttatttttttttaacctttttttttccccggggggggttttttttttaaaatttaaaagcccctgggggcccccta

SEQ ID NO: 555364 - DNA, 167 bp, Homo sapiens
ctttccgggtgacaaccctcccctcgtattcaaacacagatgatatataaggaatagacacaaaaaacaatcaggccatgagagtaccaactaaccctctcccacccctatccggcccaatacactcccagaatcaggcacacagcgcttgactgtttgactgttta

SEQ ID NO: 555365 - DNA, 135 bp, Homo sapiens
gttacagactgactgttcagaaagattcttcaaagcttatcccttagaggattcactaccaacctcttagccggccagccgttgatgaacattacaatcccttttcgacaagtgcaaattggggcgtttgccgga

SEQ ID NO: 555366 - DNA, 263 bp, Homo sapiens
actctagacgatcccccgagtgggtccctgcataaatttgattttgccatggctgcttagaaatagtctaattataaggaaagaagtgtacagagagagaaaatattactacactaaaacagaactgttttctacctattttaaaaaatttaggtagggatgttagccatcatattctataattagttacgttaaacttctaataatactgttctcccactcgcacatggatttcatgctatttaagcacatgattgatcgta

SEQ ID NO: 555367 - DNA, 185 bp, Homo sapiens
gcttttctaggacttgtgcctttccatataagatttagaataagtttgtctatgtctaccaaaaaccccagcaaggtttttggtagacatagacaaacttggggagaattgacatctttaccaatatacagtgccttccaattcaggattcaggaacacaggatcaggcatggtggctcgtggcc

SEQ ID NO: 555368 - DNA, 146 bp, Homo sapiens
gttcgctgctcagcaccttgacacgtagatggagtagctctctttgtcggctgcgcttgcgcttcttgccgtctttctggctggttttggtgacggattgctatgagcccttatagggaccgacagcggattttgccgggtcaggc

SEQ ID NO: 555369 - DNA, 702 bp, Homo sapiens
tggtgacaggtgcctcacagaaaaaagaaaaaaaaacaacccgggccacggaaaagcaggccctgggtcccccacgatgaaataatgccttcccattcagcctcctgtgctctgggcccttgttggacccttggagaccctgtggtttcaagccacgggttgggccctcgagcccgcttaggggtacccccgtgcgcctcttctgcgccttgcgccggcgccctgtgcctttgcgagggcggagctgcctttctcctcagcacagacccggaaagcatttgccagggcggacgcttgagtttcctccttctgtgcacagactttcggaaattacagcgaagcggagcagtgtttcctccttcagcacagacccgggcgggcggcccaggggcaccgcgagggcggacctgcgtttctgctcagcacacacccgggagacaccgcaaaggcaagagcagccttctcagcacagaccttgtgggcactgcctcgcttggggactactcggagccgcatcaatggtgaataaaatccttcctgtttgcagcccttaataatcagggtcagagacccgttagaagggttcagtgtggaaatctgggaaaccaaaagcccctctgattcctacccaccgaggtttccccagccaagtgaggcggcgcagtggcagtcaaacggagctcggaaaaagcggcgaatcct

SEQ ID NO: 555370 - DNA, 81 bp, Homo sapiens
  misc_feature (74)..(74): n is a, c, g, or t
gatttgctggtgcagtacaactaggcttaatagggactcgaattcaaaaaaaaaaacgttagaagcttgaattncgagcag

SEQ ID NO: 555371 - DNA, 660 bp, Homo sapiens
ggcctggcccccagtgcccacccggtccgccggacagccatgatcaaggcgatcctaatcttcaacaaccagggaagccgggtctccaagttctaccagccctaggtatataactgggagtaaaatggccaaatcatatgagtgaagatacacaaagcaaatcatcagggagactttccattgtggtatctaagagagatgaaaatgttgtaatttcctagaaggaggattataattggaggatctgacaacaagatgatttatagacattatgcaacgttatattggtcttctgtgtggattcttcagaaagtgaactgtggcatttagatctaattcaagtattgtgtggaaaaattagacaaatgtttggaaaatgtctgtgagctggatttgattttccatgtagacaaggttcacaatattctgtgcagaaatggtgatggggggaatggtatggagacaaatattgaatgagatggttacacaacattgtgcacaaaataagctgaaaaatctgaggctggttagcaggagctccagcccgtgctgtatcagtgtaaagaatatgaatcttcctgagatcccaagaaatattacattggtgcatcagtataaaagtgcaaaacttgtcctctttaaataaatgttaaagggctc

SEQ ID NO: 555372 - DNA, 641 bp, Homo sapiens
gcgcgggcgcggtggctcacgcctgtaatcccagctctcagggaggctaagaggcgggaggatagcttgagcccaggagttcgagacctgcctgggcaaatatagtccgagaccccgttctccagaaaaaggaaaaattgaagaatcaaggggatcaagaaatatgatggaatgacatgtaatagaaaaaatgttgttggtcacgggtccgtcgcgcccccccagaaagagttcctttagaaaccgccttgcgtgttggcccgcggcggggccccccattgcggtaactgcgcatacatcgtggcaccagcctgtgtccccaggaggagagcacgccggggagacaggaagccacgggcgggtggggattccctcagcaatgaaaacaagcacccgggcggggaacacgaggggtgtttgtggaccaagcccccaaaggttggctccacggcaggccacagcgagaggggacttattatcagcgggaggcccagagaaggagcgcgtttgtttaaaatattacccccccggaccgtcggggtgtgtgcctcttaagagacttaagacttaacccgtacaggaaaacccctggtacatccaaaggcccgatttttgtaccttgtacaatggatggtgtacaa

SEQ ID NO: 555373 - DNA, 220 bp, Homo sapiens
atgatgagacgcattctggtggctgctggtatgcttacttgaagacgagtacttttctaggtgggcgaacgagtgacattggctgacatcacagttgtctgcaccctgtctgtggctctaataagcatggttctagcagccttctattccgccaggacctttcccaagtaccaacacgctggttcctacacgtgcattaacccagcccccagttccaggg

SEQ ID NO: 555374 - DNA, 595 bp, Homo sapiens
gaagggatgggagcacccttccgaccagtttcatttctttgggctctgttccatctgtgcagggaactaccttctctatggaaattggacacgattttaaaaataaagcattgcatttactaatgactgtcagtattaagatttcatgtagatcttgttgcttctcagaaaaaagtttcatatacagtaaggttttaaagataggcaaataactagttgtgagcaggcaccatcctttaacttttattaatttgaaatcatttttccatttttaagcagaatagaatgtcccagtaggtgtaagggaaatttcagtagcctccaagactctgtggagattttgaaactatacacgcttctccatctgtcgcctgccccctcctcccagagcatagacttcaaggctggactttgctccatgttaatgatcactgttaatgaaaaagataataggttccaaaaggctgaccacctgtttttggtatttagggtaatgctgctgtcaaagtgaatgagatatattccttcctctgtgttctgaaagtttacgtagggttgggtgtgtaatgggttgaattgtgtcctgcgtctccac

SEQ ID NO: 555375 - DNA, 360 bp, Homo sapiens
caggggagtattttatatcaaaacgaagagcagtttatgggaaagaaagcagcatgtttttatttgaattattcaccctcatgatcctgaacttgttttcatcatgatgtgagtgtactaactaggtaatgaaagttaatgaatattaacttagggaactttgaatgctgagcagccccttagtcccacctggtagtttcaggtgcatttatttttcctaagtccactctgttacatgaatcagacttcctcatttgttcttgcttgactgtagattgattatcgatccagggaaacaaaactagggaaattacctgtaaattataataacttggttaattaattctctccagaaacaca

SEQ ID NO: 555376 - DNA, 113 bp, Homo sapiens
ggttccacgagtcatgtcaacacagcgttttgcttaacacatcaacacagacattgggtccacgtcctgcagctgcagccgcttgcagttacttcctccttgtccgaccgttc

SEQ ID NO: 555377 - DNA, 1288 bp, Homo sapiens
ccccccatccccagcctaccctgccaacaggggcggggcacaacggacacgcgctacagcgctgggtgccagcacgacgggcagcgccccctggctggcaccgaggcccagcagggaacccctctgggctgaaggcagaaaggactgagccttgaggtcagcttcgagtgccaacggctcagactgccagctacctggcaagaggcctgactgcacctggcaccacagctgaccccatcacctcgcggacccatactgggctccgcttatggcccacggtgcgccaaaaacgctttctctcaccttcctgcaggctgagccacacaactcacttgcgcaacagccagcctcgcgcgtctcagcctcactgctgcatggccctcgctgacccccagcccctcccttagctgcctacagccctgcccttgccccagcggcgctgggactggccactgcacacggccagccagcacaggccctagcgctggcgcgcagcggctcaccggcctggcccctttaccctgcctcagcgcccccccatcctcctggcgcgctgctcctgcgcgcggctcacgggcagccagggcagccacctggcccgcgcgctctacacgcgctgctggtacctcagcacaggttctacgcctgggccccagggcccaggctactcgcgccctgccttgggctttctgccactgccctggaagcatgacccctgagcactcgctgaccaccaccttgagctggacacttttcccccgtgcttccctctttttacccctcttacacttcgcgacttctcccccgactcctctgaacatacccactttgcaggaacacttcgcgcttaaccctgccttctgtgcgactagccccctcgctcgggccgtcccctcggcgggccccgcccccctgcacgctcctcccccgcgggggggtcccccgactctatttgcagcgctttcgccgtagcccttttctgggttacccacggtgtgcctcgccttaatctgctgagggccgccgttctgtccggcctgtgcccctctcgcctggctgttccctctaacgccgcttcgtgcttgtgggaacacgcgggtcgcgcctgccgccactcctccgcgcgtacccgacccccatcccttcgctggctggcgcacctatcctcggcccgccctcccctcgcccgcctctaccccccccgcgcccttctgccctccctcctctgtctatagtcgctccctcccgccgcctttgctggccgacctctctgctcccgcgtctgtca

SEQ ID NO: 555378 - DNA, 232 bp, Homo sapiens
tttttttccccccccccccccccaaattgggggtttgggggggggggccccggggccccccccttctttttttttttaagagagggaatttttccccccctttcccccccttaaaaaagggggggggttttttcccggccccccccgggggttttttttgaaaaatttttttttttttggggggggtttccctttttttttttaagagagaaccccccctttttccccccca

SEQ ID NO: 555379 - DNA, 1028 bp, Homo sapiens
ggccaaggcgagtgccgctgcgggccacattgtcacggacgagctggccaccaagctgagcctggcttggctgcagatggagggctgaggtgcggctggcgagaccccggagcagcccgggctgaactgtggcagcggcggcgtgcggcgtggggcacccgactgaggcggccgagtgctgctgggcatgcagcggactgcgaggcttgagcgccaagcctgcttgctggctgctgcagaacctcaagccatgggcatctggcggagccccaagtcgccccagaccgacgacgtcttcaagcccttaaaccgagttcaagggagttctccaggaagcagatcaaggacatggagaagatgtacaaggcagtatgatgccagggctggggacggcttcatcgacccttgatggagcttaagacctcattgatggagaaaccttggggcccctcagatccaactgggaccttgacagaacattgatcaaggagggtggatgagggactttgacagccaagcttagacttacggggaagtatccatccgtggatcttccgaaaagggcgggacggtccgggggagctttccaggaaggaacaggcgagggcttgtgcggttgcttggcgcccggcgtcttcttgagaattcggagggttcttccagtgaaggggtggtcaaggggggtacaaaggaggcattcttttgagggccaaggtccaagtggcgccgatttcacacgttgttcccagtaccccggcatatccgggagggagaggggatggatttccgcagggtgcacaagaaagtccaggggaacggggaaacaagggggcacacggaagagcgacgcggccggggaagggaagggaagtagaagagccacagccggggaaaagcggtcgggacccttcccgacaggggaggccattgcagacgtcaccaagccgttagtaaaggatacgcacagtgggcggtcattggcagagcacggaggcacgagcgcgttgcgtccgtggaccccccccagt

SEQ ID NO: 555380 - DNA, 649 bp, Homo sapiens
  misc_feature (165)..(165): n is a, c, g, or t
  misc_feature (176)..(176): n is a, c, g, or t
  misc_feature (201)..(201): n is a, c, g, or t
  misc_feature (210)..(210): n is a, c, g, or t
  misc_feature (216)..(216): n is a, c, g, or t
  misc_feature (292)..(292): n is a, c, g, or t
  misc_feature (308)..(309): n is a, c, g, or t
  misc_feature (312)..(312): n is a, c, g, or t
  misc_feature (320)..(321): n is a, c, g, or t
  misc_feature (350)..(350): n is a, c, g, or t
  misc_feature (373)..(373): n is a, c, g, or t
  misc_feature (376)..(376): n is a, c, g, or t
  misc_feature (379)..(379): n is a, c, g, or t
  misc_feature (397)..(397): n is a, c, g, or t
  misc_feature (402)..(404): n is a, c, g, or t
  misc_feature (408)..(408): n is a, c, g, or t
  misc_feature (430)..(430): n is a, c, g, or t
  misc_feature (446)..(446): n is a, c, g, or t
  misc_feature (448)..(449): n is a, c, g, or t
  misc_feature (462)..(462): n is a, c, g, or t
  misc_feature (488)..(488): n is a, c, g, or t
  misc_feature (499)..(499): n is a, c, g, or t
  misc_feature (518)..(518): n is a, c, g, or t
  misc_feature (535)..(535): n is a, c, g, or t
  misc_feature (645)..(645): n is a, c, g, or t
tcaaacaactacactttgcagtctgtcccaatgaaatcaaactggacttctcaatccaccactgcaaattggttattcactcaacctatacattcatcattgtattctgcttcatgatagctatttcattttacattttacataaaatttaaaaaaatgactgcnatttataaaantgaaaaggtaaattgtagaaatacncctttttgnccagcnaaattttactaaacaatctcagcaaatttcgtaattcatctttcaatatcacagtcttttaatgtcaatggaaacnataatttatggcttannacntctttttnnacctgccaggaaaatatatgggcgcggtngcggggtaggggggggggggggnggngcncggggctttggtgcttcnttttnnncggnggacaccgtgccagccatcgtnttggttccggtggatngnnagttaagattaantttattaatcaactttggggtctggngccgggatggncctttggcagcgttgccgngtgggcggggcggtgcngcaaagctaatcataatgccaaattttgaccaaatgataaagtggctctgttaccatagtaccagagtctgtctttttgttgggtttctgtttgccataacaaccaaggnttga

SEQ ID NO: 555381 - DNA, 908 bp, Homo sapiens
ataagaaaatgtatttatataacatttactattttgaagactagtgagatttctgtaataatttaaattctttaaaaagtgaaagcttgttgtaaagatatgtctttgtgttattagaaggaaataccaagagaaaaatttctttctttcatgggcattgataatttcagtctttgactgattgtacagcctagaatatactaagctgaataacagctcttggcctcagaatttccagcagccagccactttctgattcactaagtcgaaactcttattagaaccttcagctcggtgatatgtatctagacgatatccctgcgcgcttcggcttcactctcagtttagaaatttatcccacaggctcacccgatgtatatcatacatatacttctgtgtgtctatcataccacatatgtgtgtctgcagcgcgtcagcttctctctacgacattcctcttaccggactcttctcaaatgacaacgccacagggcgtcacagctgtctcatctcgatctcgctccaccaccccgtatatccaccaactttccacacacactgactagtccaccgtgcctaacgtccataccacgttcggctacctacttaacacccttcacgacatcgacgttttacgcccaccacacacaataacccctgtcactactggtcgcccgtccggtctcctcccaatctactggtctggcccggatctactcgaagcacgcatcctcccaaccactgttcactacttccacggcaccaggcgcgcccacaaacacaacaggcacccccacgattccggcacacgccccccccgccaccgccaacgggtcgcgcacccacaacgagcggcaacccaccccacccacacaccagccgcaccttgtacccacccccccccccac

SEQ ID NO: 555382 - DNA, 224 bp, Homo sapiens
gggttcattattgaggtaggcacgatggctcacgcctgcagtctcagcactttgggaggctgaagcaggtagatagcttgagcaccaggagttcaagaccagcctgggcaatgaggtgaaactctgtctctacaaaaaattaagccaagtgtggtagcacgtgactgtagttacagttactcagaaggctgaggtgggaagaccaattgaaccggatagcttgg

SEQ ID NO: 555383 - DNA, 135 bp, Homo sapiens
tgagccggtgaaagccaggatttaaatatacaaatactaatttttatgtatctttcacgtcaaattagaaacacatacttggaaatttactgctggcagtctcaactgtgcttatcatggtagtggctgaaactg

SEQ ID NO: 555384 - DNA, 889 bp, Homo sapiens
  misc_feature (282)..(282): n is a, c, g, or t
gatcccaaaaatgcgctgtcacaacaaacgaagaagatgacgatcgggagatgcggttccagcaggctgtaacaatagggcgcccagtgggtcccgtccagactgatggacacgtcaaggggtggccccccctcgcccggtcggggacccccctctgcggggtcctcccctttcgggggaactaccctcgaggggcccatatcaaccaatacatgggggcccactgcgccggtgggccgcaaagagaaaacggtgtttggcacatggccaaatcaagcgttnatctggcccgggcacaaccccttcctcactctaaaggaacctcccttgcctcttttcaaaagagcccccccccgctattactaacaacactagaagccccagtttcccttgccgaaacaatggggcataaacactgtccccccaaacaaagcaacaaataaccccccttgcccggctcaactttcctagacccctggatttcaccccagtatggtcccctcgaaattccacttttcctgaggcattcccccacaccctctgaccaaaaaccttaattatcacgtcagtcggccaccaaacccccccctttattcttttccgcgtaaacatgcgtgttttccggatccccacccactctcgttacagtttaaatgcaagcgtctccgccattcattacagtcttatcgttaagaaattgttataagataccaaaacccttcccaaattacggggaaaatctaaaactcttgttttatataaatgggccataccactttgaaacacattgtggcaccacatgttattaaaatatcgtggaagctatacaaaaataacaagagtttacaaaaaacccaaaaaaaatttagcgggttcgggccccaaaaca

SEQ ID NO: 555385 - DNA, 310 bp, Homo sapiens
gcggccgcctactactactacctactactactaaattcgcggccgctcgacgtggacactgttacattgtgtaaaaactctctgcaaataaatggagaaaaaaacaaatactctagtataaacatggattaatatgggtttagtttatgaacaggtgatttacagaaggaactacaaatagctgataaacccatgaaaaagccccaagttttgtagtaccaattacaataacaagatactgttttcatctaggaaaatggcaaaattaaactttttgcagtattaagtgttagagatgtaaaataattgg

SEQ ID NO: 555386 - DNA, 283 bp, Homo sapiens
aaacatattcaaatccataacatggggatagatacacggagccgaagatacagcatcagtaaagacaagatgaggtcctgatctgggaaccttttgccaagggaagatagccgctggaaatgagactactaatgccccaagaagtgactgatcctataatggaaaagggaaaaaagaaaaagagaactgcttccttcttcaagggacaaccacatcaaagcacaaatgcactcctgcgtaagtatgtgagatgaaggtaccatctcagccactgtaagaaacc

SEQ ID NO: 555387 - DNA, 388 bp, Homo sapiens
  misc_feature (2)..(2): n is a, c, g, or t
gnacgacgcgatttgaggctgtagtgtgcaatgttagcaccatgactaggcactggactccagcctggggaatgtagtgagaccctgtctcttaaaaaaaaaaaaaaaaaaaaaaggccaggcacagtggctcacatctgtaatcccagcattttgggagtccgaggtaggtagatcacttaaggtcagcagtttaagaccagcctggtcaacatggtgaaaccctgtctctactaaaaatacagaaattagccctatgtggtggctcatgctggtagtcccagccacttgggagtctgaggcgtaagaatcgcttgaacccaggaggtggaaattgcaatgagctgggatcatggccctgcgttccagcctgggtgacagagcgaga

SEQ ID NO: 555388 - DNA, 128 bp, Homo sapiens
  misc_feature (10)..(10): n is a, c, g, or t
tgtaaagtgnctgtgaagactaaaagagatatgtaacatgttggaaatagtgcctcgattgtagtaggtcctctgtggtattatggactaaagctggccttcatcttctacagataagttgcaaagtg

SEQ ID NO: 555389 - DNA, 1369 bp, Homo sapiens
  misc_feature (602)..(602): n is a, c, g, or t
tacaaacaaaagctggccacaggtttataaagacattactgggctactataagcacaggcgtggatctaataaatcatttctccatattatttactcacattattctcgaggaaagtttctcgtgagaagtgactatactcaagaacgagggctatctctgggtgacctcaagcgtggcactctcaaagtagtctctcttatatagaagagttcgtgagtataagtgggtgcagaccatatatacatctcgaggggccttgtgccctttttacattctcccacaaggacaagagttactccactttcttgcggagaaagaaatccagtggtagtgaaccagtgagaaaatatctctatatttttataatgtgacgcgtgggcaaggttttgtgaaacattagcgtggtaccagggagaggcaacgtaggataccccaatgtcgtgagcgtggctctctattcatgtttattctcgtgaagccaatgtgtgccaagaatattctcgtgtatagctgaggaatgtgcaaggtctcgagaagaagagttaaacgcacgcgtgtttaaaccagagtgtctcatataatagcctattatagtgtggnctagggggattggggttctcgtgggagagaacaagaaatcttgggaggggttattattatttataccaacttcccaacaattataagaaaaccgacagaggcgaaacaaatagcgtggtcacatttccataggagtggtggggcacagtggccattaaattccaaataataaaagggtgggccttttcatccaaacaaaaattcgtggttcaggggcccacatttccgttggaggttccaacatgtccccaaaaaacgattaaaaagctgttcttccaatccccgcccgaaaaggagggggggttatatactttgctgttaactaatctggcgaaagagaacatgtgtgggggttgggcttggaacccccttttcccatttagactcttcgcatggtgttcccacaattcccgaggtctcggggggcgcctccactggggcgtacgccatttgtgcgcaattatcccgagaagtggcctttttttagcgcaagagggaggcccctgggggggggaaattccaagagttccttcatataaattttccttaaaaaccgcctctcgtgtgtgagcggaggaataatcttccgcgcggcgggtcttatcaccagaaccctctggggggacccctgggcacaaatttcccccaaagggaaaagaacgttaaggaggggggcgacgcacacaagctgatcgagagggtgccaccacgaaggtagcatgcagttacgaccacagggcggggggggggacacgacaagcaagagt

SEQ ID NO: 555390 - DNA, 103 bp, Homo sapiens
  misc_feature (63)..(63): n is a, c, g, or t
tttatagctcaacgcgctgatagtaactctaatttcgccatatctgtctcatcatcccaaggntttcacattctaggtaagatggaagacattgtgcaacaag

SEQ ID NO: 555391 - DNA, 567 bp, Homo sapiens
gcctgttgagcgaccgggaccccaggtgcacactccaccacgcccagctaattttttgtgtttgggtagagagggggtctcactgtgttgtccaggctggtctcgaactcctgatctaaagcgatctgcctgccttggcctcccaaagtgcggtggctcacgcttgttgtcccaacactttgggaggcccaggcgggtggatcacgaggtcaggagttcaagaccagcctgggcacgatggtgagagcccgtctctactaagaagacatacaaaaattagcagtggcgagcacctgtcatcctaagctgcgttgggaggctgaggctgggagaatcacgtgaacccagcgggggcagacggtcgcggatgagcgcgagagtgcgaccagtgcacgtccagcctggcgcgagcatgacttgagactccgttctcaaacaacaaaacagaacaggccgggggagccctggcccaccccgggcaccagacgggcaccagggaccccgagcaacacccgagagaaaggagccacagaccagtgaccttccccaggacccggatgctccgac

SEQ ID NO: 555392 - DNA, 141 bp, Homo sapiens
  misc_feature (106)..(107): n is a, c, g, or t
gatgacagttcaagcaggcgtacggtccgatcgtgtcacagctcgtaagaacaagttggctctggtacgacaagctaaaatataaaactattaggagtatgaaacnngatgtctcgtgatctggtgtaccttatccctgtg

SEQ ID NO: 555393 - DNA, 758 bp, Homo sapiens
  misc_feature (10)..(10): n is a, c, g, or t
  misc_feature (266)..(266): n is a, c, g, or t
  misc_feature (440)..(440): n is a, c, g, or t
cctaatttgnctgttctcgtaaatcccctgaacaataaaaaaattccggtgctttgccaatccccaacccttggagggttcccctttttcctccataaaaattctgggaaatttggcaaaaatgcccgttggttaacaaggaggtttccctaaaaaaaaaagtaaaatttcccatgttactttcaaagctgtaaatctttctgaaagccttttttccccaaaaatttagttgatgaggatctggttaaaggttcaaaacagagcgnaaacccaagaagactaaagatcttcttcaggcaaatcagtggcgtctgatgtccctgaggaattaaactttcttggacctaaggcgggattcttctgtccaatttgttccctcttctactcaggtgaaaaagcaatggcaaatccctgcaagagttcccgtcataagccaaatncttagaaattcttggcccagccaaaaaaggaaaaggacccgaattaggcttaaaaaaaaagctctaggtgattgggggaaaggaaagaattccctaaaaatttgtttaggggcccgttgatttgtgtatttttgttatcctttaatttgtaattttcgtttccaaaaccaatattcgtgttggcccaatttttgattgccccaaatgtaaaaagactgatggggaaagtatgatgggttttatttttatatccaatcccccggcatggagaaatatcttttaaaagtgttaaaataaatgttccccctgtatttttta

SEQ ID NO: 555394 - DNA, 513 bp, Homo sapiens
atgaatatcttcgtgcacaggctgtcttcccagatgctcaatgtttattacgtggctagactaccacggagtgtagtggacttctttcccaacctcacaatgaaactactgacatacaaccatctagagggctatcttaactaacatacttgtaacaacaattgtgtctctccggatagagtagttgtgtgatcccctgtacaactgcacactcagccaagggataacacatgtccatcttgtgcccgtattggcggacattatcatctggctcaatattattttgctacatcttgataatgaaaactatagcatcagtgtttcagattcgcgcattatcactgacattctaagcacggtatgaacactctttcagtgtggagccgattcgtatttcctcctttgtgggattgtcagtgtcctttgctctatcttcatggggctcagcataaattctgtatgtagctcggttatatattacagatattaacctggtgtgtgtcatatttgctg

SEQ ID NO: 555395 - DNA, 265 bp, Homo sapiens
caggatccttggcatgggcgtaaacatggactttgctctctcccatactagggcgagatgcatcaggtcaaggaggctaagcacaggtagcgggtggcggagggctggctgagcctccccagcgtccatggagcaggagggcattgccctctggggttggcagctggctgttctctcccccaccctaacaagccacagacaacagactgcctcaccagacgatgacacggggtcagaggaagctggcacaacatatttctcaagg

SEQ ID NO: 555396 - DNA, 291 bp, Homo sapiens
gtaccgttactttgggccatgctgaggttgacatgcctgttaatatctcagcagatatgtctaaaccagcagttggacatatcccagcaaaaaatcagtggttcagatgtcattaatacttgtcacacaaacaaaacttgatgaacttcatggcagcaataaaaatcaaatacacttaactaggaataaacattacagtattagatgagaattagcctaaatgttaaaaaaggaaggctataatcttatctatattaacgcttcttccaaaatgtacgttctctctccact

SEQ ID NO: 555397 - DNA, 606 bp, Homo sapiens
  misc_feature (207)..(207): n is a, c, g, or t
  misc_feature (250)..(250): n is a, c, g, or t
ccccaacctcagggctccagggggttccctggctcctcctcagggcgtgcttcccatttcactggaaagaccttcttgcccaccctgactaaaagtagggggctttttggggcctagcgatctctcctggcctatccgctgccagccttgagccctggctgttctgtggttcctctgctcaccgcccatcagggttcttttagcaantcagagaaaaatgctccccacagcgtccctggcgcaggtgggntggacttctacctgccctcaagggtgtgtatattgtataggggcaactgtatgaaaaattgggcaggagggggccgggcgcggtggctcacgcctgtaatcccagcactttgggaggccgaggcgggtggatctcgaggtcaggagatccattccatcctgggtaacatggtgaaacccccgtctctactaaaaatacaaaaaaaatttagccgggggggggggcgggcacctgtagtcccagtttcttgggagattgaggcaggagaatggtgtgaacccgggagcggaggttccattcaccccagatagtgatattgcagtcccccctgggggacaaaaaaagactccgtctca

SEQ ID NO: 555398 - DNA, 224 bp, Homo sapiens
gcaagtctgcagttaaaagtacatctgatgtattctgcagctatgtaaagtgcatttgacagattcaaaatttctggttctatacaatcatttcaatctcttaggtaaaatccatctgataggattctgaattccttccctgtgttatctcgaattccattagggtttctcacaacagtgattgtgtcttttctgtctgaaaggtcgacatatctccatctctc

SEQ ID NO: 555399 - DNA, 943 bp, Homo sapiens
  misc_feature (41)..(41): n is a, c, g, or t
  misc_feature (46)..(46): n is a, c, g, or t
gccaagaggtgagggtgcacgtcttccctcctgtcccaggnaaccntggtggctgcccccagtctactcattgtgcatgagccctgtctgccagcccaccccaggactgggggcagcaccaggtcccggggagagggatgagccaagaggtgagggtgcacgtcttgcctcctgtcccagctcgcctacctgggcagcacgcagacacccctgtccacgaacgcgcacatgaccagccgtagccacatggcatcacccgacccctaagccccaaccctcactccaccacacccacacgtctcctccctctccctctccaccccccatccttgcatcctctatcccctgacactcaccccccatcatccccagcctcatcctctccactctcccctccccctcacaccccacccctcacaccacaccatcgccgcgcccccgcccctcgcccgccgcgcgctccgcctgccgccagctcgcgccaccacactcgctcctcccgacccacccaacaccacaccacaaccacacgcaccacacctcctccgccgacacacccgcccaccacacagcccaccacaaccgtcagcacgcgaccccgccgccccactcgcgcgcttgccctgtgccgctgctgttctttgtctatcgttctcgtcctctgctctcttatgtcctctcttctctcactccactctcctcactcctgctccacctactgcagccacgcgtccacgctcatcgcgcgcgcagcactctcgacgtctgactgtgagtgcgtccctcacctccgtcgggagcatgatgccgccgcttcgcctgtcctctgcactcgccgtctcgcccccccccactcactgcccaccctccacccccctcaccggcgtccagcacacaccaacacccagcagcctctcacggcgcgcttccgccaccctgtcct

SEQ ID NO: 555400 - DNA, 286 bp, Homo sapiens
  misc_feature (41)..(42): n is a, c, g, or t
tgaggtcctgatgtatcgccacacatgaatgacactacacnnaactctaccacagctgatcacgacaacttccatcatgggataagtgcaggatttatggagaagcagatacgtgacccggaaaaatatcaagaatacagactgattcttttggagacatacaggctatgtgatggcacaaatagatggcctctatgtaggagcaaagaagagggctatattagaagggacaaagcccatgaccctgttccagattcagttcctgaatagtgttggggataacata

SEQ ID NO: 555401 - DNA, 100 bp, Homo sapiens
  misc_feature (87)..(87): n is a, c, g, or t
  misc_feature (95)..(95): n is a, c, g, or t
gatcaccccaccctgtgaagaggcagttggtgctggcagtaagctggtttcctcctctccagggttttcctagtaataaaggtgttnctgttgangccgt

SEQ ID NO: 555402 - DNA, 888 bp, Homo sapiens
  misc_feature (68)..(68): n is a, c, g, or t
ccttcggctccgagctgaccctgatcagggccgagttgtctcggggcgctgcgaggcctccacccggngagggtggttaccgctgaggagctgcagtctctgtcaggatgatagaggtactgacaacaatgatctcagaaattgtacaccaggtgaatgccctgtgggaacaggagtctagatgtcagccaaaggtctgtggttgagactaatgtgagtctgcacacgataatggcctcagaatgatgaaggactaaggggactttgaagtaaaagatcttcttagtctaactcagttcttggggcttgtgacacagagacattttctctagctgtgaatttactgacagattccgttgtctaaaatgaaggtacagcccaagcacctgtggtggtgttggactgagctgttattgtggtgtaaaatcaatagaagaggaacaggaatgtcccatgtggcaatgactgtgatccgaataagtcaatataggtttacggtttcagatttgatgagaatggacaagattgtctgggacaaggtgtgtggaaaggtcaaagctaatatgctttcaatttctggaactgtgttattcactccttcaagagaacttgccctttgaagggaaaatagccttattttggaaagctagaggtcacctggaaggcagtgtcattgcaggacatattttaaaggaaactcgggtggggatggcttcatggctttaaatcccaccgagtgtgttgtgttccgagggagaagttgggacattcacgaatgggggagagacgttggggagggtccaggggggttacatgtgtgccccgtgtagaagagggtggtgtcgggggagagaaaaacatcgggcggtaggacagtcttgtctgaaa

SEQ ID NO: 555403 - DNA, 152 bp, Homo sapiens
gagatatataaggtgagtcagattataacagcagcctattttatgctataactgttcctataccactacttttgtaggtgacctatacttactagaccatttgctatgacaactccctctagagaacttgaaaggtccctgtttcaattttt

SEQ ID NO: 555404 - DNA, 454 bp, Homo sapiens
  misc_feature (68)..(68): n is a, c, g, or t
ctgaaggcaggcagggtaggacaatgtctggaggctcacggtttaatagaataggggtccccaacccntgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaaaaa

SEQ ID NO: 555405 - DNA, 362 bp, Homo sapiens
cccaccggatttctttgtctggttccactggggcgtaatgtagtaccctttatccccttccatcttcattaggcagaattcttcccctagatcctggaatgtttatggaggcaagttttaagacctctagcactgccctagcttactatagccaagatggagtaatttacagcccattaggcccttaaaattttgtctgcttcgggtgttctcttggagttctccagctctctttataagaggtttcaggaggctgggtcattatcttcatctgtaatctccaacactttgggaggtctagacgggtggatcacggttatgtttcgggagttgctgagatccggcctgtgtttcgtattggt

SEQ ID NO: 555406 - DNA, 396 bp, Homo sapiens
ccccattgcccgaccatacactctacgaccggataccaatcgttctgagggtacctttagaagcctccgttacacttttggaggcgaccaccccagtcaaactacccacggtacactgggcacgcaatgcgcgtgttagtagccaaatagtaaaagggccgtatttcaacagcgactccaagacaactggcgttgcccattctcagtctccggcctatcctacacatctaatacccggctacaatataaagctatagtaaaggttcacggggtcttttcgtcccgttgcgggtaatcggcatcttcaccgatactacaatttcaccgagctcgcggttgagacagtgcccagatcgttacaccattcgtgtatggacgggctctggggtaccgagc

SEQ ID NO: 555407 - DNA, 527 bp, Homo sapiens
  misc_feature (178)..(179): n is a, c, g, or t
  misc_feature (206)..(206): n is a, c, g, or t
  misc_feature (260)..(260): n is a, c, g, or t
  misc_feature (298)..(298): n is a, c, g, or t
  misc_feature (307)..(307): n is a, c, g, or t
  misc_feature (366)..(366): n is a, c, g, or t
  misc_feature (407)..(407): n is a, c, g, or t
aggaaaagcaaacacaattcaaacaaacactgtcaaggtgattcaagatcaaatatttacaataatcatatggagtatcagattttttttttccaaatcggataccacaaattacagagctggaaatctcttcttgtggctcctcctatagtgcaaaattgaatatagtcttacatgnngaagacaattatatatgtcaggttccnagatgcaaagaggaaacagccgttacaagggccctaaaggaacacagtgctccntacccatatcatttgggttctacccatatgcgcctggnaagtcctcngaatcccatgtcccgtgcatggtgtaggcgtgtacacattgggtacaggagcaaacctnacggcctggtattctatacgagcatgtcctggttattccanaagagaagggagcaaatctctctgttagtattaaccaattccgcactgggtaaccttgtctagtacagacagcgggggtcatttggacacctggggccacacacaaagaaagcagcccag

SEQ ID NO: 555408 - DNA, 333 bp, Homo sapiens
attcgcggccgcgtcgacatttccggcttctggctctgcgcggccctgggtttcggcatcatcgcgctgaacctgttcctcgccaaaccgctgcttaaactgaagatcttcaccgtgacccaggtcctggagaagcgctacaaccccatggcccgccaggccagcgcggtgatcatgctggcctacgcgctgatgatcggcgtgacctcgatcctcgctatcggcaccgtgctgcaagtgctgttcaacctgccgttctggctctcggtactgctgggcggcggcgtggtggtggtctactcggtcgacgcggccgcgaatttagtagtagta

SEQ ID NO: 555409 - DNA, 649 bp, Homo sapiens
  misc_feature (560)..(560): n is a, c, g, or t
gcaatgtgaaggcgaggacctgtgagaaggatgtcgattttatccagcctcccgtgctcctgaccctcggccctaaggttgggaatgtggagtgtggagaagggcatttctgccatgataaccagacctgttgtaaagacagtgcaggagtctgggcctgctgtccctacctaaagggtgtctgctgtagagatggacgtcactgttgccccggtggcttccactgttcagccaggggaaccaagtgtttgcgaaagaagattcctcgctgggacatgtttttgagggatccggtcccaagaccgctactgtaaggaagggctacagacttaaggaactccacagtcctgggaaccctgttccgagggtacccactactcaggcctccctagcgcctcctcccctaacgtctccccggcctactcatcctgagtcaccctatcaccatgggaggtggagcctcaaactaaaaccttcttttatggaaagaaggctgtggccaaaagccccgtatcaaactgccatttcttccggtttctgtggaccttgtggccaggtgntcttcccgagccacaggtgttctgtgagcttgcttgtgtgtgtgtgcgcgtgtgcgtgtgttgctccaataaagtttgtacactttcaa

SEQ ID NO: 555410 - DNA, 706 bp, Homo sapiens
  misc_feature (27)..(28): n is a, c, g, or t
  misc_feature (85)..(85): n is a, c, g, or t
  misc_feature (112)..(113): n is a, c, g, or t
  misc_feature (213)..(213): n is a, c, g, or t
  misc_feature (232)..(232): n is a, c, g, or t
  misc_feature (252)..(252): n is a, c, g, or t
  misc_feature (303)..(303): n is a, c, g, or t
  misc_feature (318)..(319): n is a, c, g, or t
  misc_feature (340)..(340): n is a, c, g, or t
  misc_feature (406)..(406): n is a, c, g, or t
  misc_feature (433)..(433): n is a, c, g, or t
  misc_feature (464)..(464): n is a, c, g, or t
  misc_feature (579)..(579): n is a, c, g, or t
  misc_feature (626)..(626): n is a, c, g, or t
  misc_feature (628)..(629): n is a, c, g, or t
  misc_feature (683)..(683): n is a, c, g, or t
aagacagcgccccggcggccccagccnncaacagccaggccccccggcccccagcgcccccaggccggcccgagcagcacacagngacccacaggggcaacccggagccccnnacccacgccccaaggaaggggaaagaaacgcgggaggaggaccggacaccaggcccccagggagccggggacgaagacaagaaccgacgccggccggccnggggggggcgggcccggcngcaaaggagccgggcggggncccggaagcggccgcggacccggccccagcgggcggggcggcggcaacccnggggacggcggggcnnccgggcccccccggcccccangccccgccaaggccgggccgcagcggacagcgaacccaaccgggacccacccaagaacccccacanccgcgggggcccccccggagccccccngccgggggcaaggccagccaaggaagggggnccgggggaggagaggcggggaaagggggaggcggagggcacccccccaccgccccccccccccaagccaaagacacaaagaccccagacccaaagccaagcccaccagaggggcngcaggccaggccgggagcccccgggggccaagcaaaggcccggacangnnccccccccgggcccccagcccccgaccccccgccccaagaaggagccggcaggnggaaaaaaacaacaaccaaacca

SEQ ID NO: 555411 - DNA, 331 bp, Homo sapiens
  misc_feature (1)..(1): n is a, c, g, or t
  misc_feature (75)..(75): n is a, c, g, or t
  misc_feature (106)..(106): n is a, c, g, or t
  misc_feature (116)..(116): n is a, c, g, or t
  misc_feature (120)..(120): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (158)..(158): n is a, c, g, or t
  misc_feature (169)..(169): n is a, c, g, or t
  misc_feature (203)..(203): n is a, c, g, or t
  misc_feature (207)..(207): n is a, c, g, or t
  misc_feature (236)..(236): n is a, c, g, or t
  misc_feature (254)..(254): n is a, c, g, or t
  misc_feature (260)..(260): n is a, c, g, or t
  misc_feature (269)..(269): n is a, c, g, or t
  misc_feature (305)..(305): n is a, c, g, or t
  misc_feature (309)..(310): n is a, c, g, or t
  misc_feature (322)..(323): n is a, c, g, or t
  misc_feature (331)..(331): n is a, c, g, or t
nctggaagttagggtacaaaaggcgcataagcatctacaagtgccaaagcatttatgaccttataattttatagngcaagagaaagggcaaagacagggatacaantaaattatantctnaagggttacatntaanangtccttgattatttgttaanatctgctaganaagtaacagggatgttatcaagcctttctagccntttngggcccaatctgacaccgttgcctttccnggttgtctcctcggcttngcgggngctgggggnggccggcttcttcaaatggctccatggccccctgcnggcnngcatcatcagtnngggtgggn

SEQ ID NO: 555412 - DNA, 1692 bp, Homo sapiens
  misc_feature (1496)..(1496): n is a, c, g, or t
tttggccgactgatcccaagtccccaggagggcttaattttttcttttcaactatccggtcctagcggcttccttggctcttttggcccgtatatgcccgaaagaagccggggcgtgggacagcgggccataacggaagaactaggcgaaggtcttgtaaaatttctttcttcttccctccaggtggatgaactccgaagctcttttctactctttctttatagaagcgttatcacgcggagagcgtggcctagtgaaacgcggttccgcggttcacagcttcgtgggtgtgtgccacagatattacagatattctctcccaacacagaaagtcgggtatctccccttctctgtgagtgggccccgagagaggtctatcctcgtgggagaaacagagaggatatagaatatctgagagatagcgcgagataaatctccctcttcacagacgcgcgactctagcaacaccgatagagtgccccgtgcgccatgggagaaaccctctcgcgtgtgagacaacctgtgtgtaacccgcgcgctctcaccctcgtcgggatatctctccaacaagaaaattattgcgcccctacgactagggggcgcccgcagtggcgccaccatctcatctcttcttgtggtgttggaggaatattcggcgcgccggcggtgcgccaaccctctcgtggtggagatgtcgtctcctctcaccacaagcggggtcttagtgatatccgcccctctgttgggaggcccgtggcggcgcgcgctcgcaaacaccataatacgcggtgtgttggcgtgttacaccccctaggaacacccccgtggtgaggtgggcggccattggtgtgacgcccacccgtagaatataggtgaggcgccccctcggcgtaatggtgggtgcaggcatccccccagaaaacacgcgccagtagtggcgaccagcccacgtagctgtgctcacagcattttcgcgcctccggtgtcgtacggcccgcgcctccttgtggggtcggcattgtttgtcgccgtcctgatggggcctccctcatccttccactcgcttccattagagcaggaggtacattctcctttctgacaacaaggcggcgcgccccctggtcgtctcttggtgtgctgctttagtagagtaccccccaagcgtgtgttttgtgtgggccccccaactcggtcagtcccccccgagttattcgcgtcctcctacagtcgtccccccctcttgctggtatcgcgcgcgaacaatgagtcgggtgcgaggcgcgcggctctcttatcccctagacgcgaaacctcaccgtaagtgtgtcccgtcaaatgtattctcccgtcagcggtagcgtcttggcccccccacagaagtgtgcgtctccgagccatcatcattcactccccgcgtggtgtctcacctccccgcggtagtcgccgtcgtaggttcggtccccaccctcgtcagtcagtaggcagaagtagtctcnccctcgtaagaacagcagttggcactcgtcattctatccacatcaacgcacgcatcctacttacgcacgacgagggtcgtcgccagtcgtcattcatcctctcggcaacgcaccatcatctgtcggcgtgcacgtactgggtgtcgaccacatcactcggtgtcatgtgctgtcctcctcgctggtgtgcgtatca

SEQ ID NO: 555413 - DNA, 218 bp, Homo sapiens
aaccccccccccccccccggggggggggggtgggggacccccccccttgggggcccttttttttttttgggggatttttttttgggttttttagggggggggggggggggggggtttttcccagggggggggggtttaacccccgggggctttttccggttgggggggttcccttggggcctttttttttttttgggggaaaaaaaaaaaccccccca

SEQ ID NO: 555414 - DNA, 102 bp, Homo sapiens
ttcgagaccgactgcgggaagtatcggaggaggacagcagagtcagcagaagttgaacggtgggcccggcggcatcttgtggggcgtggtgttgtacttctg

SEQ ID NO: 555415 - DNA, 703 bp, Homo sapiens
gatcatgagaacgagctggagacaaactcagaagagcaaaacagccagttccagaagcctggagcaggtgaagcgagcgcccaggtccacctcatggtccctcctgcagctacgtggccctgcagatttgagcctaggacaccctgcttttgctgtcatgcgatgccgacatgctgggctcactgggccccaaggaggccaagaaggccttcctggacgttctaccacagcttcctggagcaagacacgcgagttctccgggtgccggtccctcccaacgtcagcctttgaagcttgaccagcactagggctgacctcatctccgaggatgtccagacgtgcaggcttcgtgcacggaggtggtgcaagagcacagcagagtagaccgtggagccaggcatgctggaaggacattccagttccaagcggctcatgggcatgacgccctgggagcagcgagctggcccagctggaggctagggttgggcgggaccgagccagctacgaggcccgggagcggcacgtggcggagcgaatagctcatgcacctggaggagatgcaacataccatctctaccgacgaagaacaatgagtgctgccgtggtcaacgccattggcctgtacatgcgccaccttggggtgcggaccaggagtggacgacaaggaagtcgggggaggaacgtacttccggcaaaaaggtga

SEQ ID NO: 555416 - DNA, 100 bp, Homo sapiens
tgacccatcgagacagtggttcaaaaaaaaaagtactcttcgggctacacactttatcagctttagacctgaaggtccctccactctggggtcacattca

SEQ ID NO: 555417 - DNA, 266 bp, Homo sapiens
cacaggcggggtggtcggtggccacaggaaggaagcagcatctccgcatcgcatcctcgtccattagccagtgggcggttgccactctcctgcccctccctcagagacaccatactgccaaaaacaagacgcgtagcagcacacacttcacaaagccaagcctaggccgcccttagcatcctggttcaaacgggtgcctggtcagaaggccagccgcccacttcccgtttcctctttcactgaggagaagctgatccagtttccgg

SEQ ID NO: 555418 - DNA, 530 bp, Homo sapiens
agcggattctcctgtctcctcccaggtagctggggttacaggtgtgcggcaccacgcctggctaatttttttatttttagtggagatgggtttcatcatgttggccaggctggtctcgaaagcctgacctcaggtgatccgcccaccttggcctcccaaagtgtggggagccactgtcccggcatattattacttttagagacgaggtcttgctttgttttccaggctggagtacagtggctcaatcatagctcactgcagtcctagcctgggtgaacagggcaagatcctgtctcaaaaaaaaaacaatttagattggaacagtttcggtgaggtgcagtttgcttcgtctcatatttcacttttttaacaaagaacaagcagcgggagcgcggcggacctcatggcctgtaatccactgaggcttgggagaggccaaggcgggtgcacgattcaccttgagtgtcaggaagttcgagacacaggcctgaccagacattggagaaacctcgatctcatactaaaaacaa

SEQ ID NO: 555419 - DNA, 1350 bp, Homo sapiens
gctcaccttcattcgtgcagtgggaagccatgactctttcttttggaacagtgttatcacccagatgtttcgaacactaaatagagaagaaattcctgttaatgatggaatagagctattgccgcatggttctgcaacttatgaataccaaggagtcccctcatccatgtcctgcgatcctatactaagtgtcatcatgcacatctttccattttgtcacactacagaccagagattccatgccccacggtcatgtctctaagactattcttcactctgtcactatttgaaaacatgttgaagaaagtaaggcaccccagaacccgggacagctgaggaactgtgcaggaggcatgcatagataacatccagtcactccaagactgtgtcgatgaacttaccaacacagatagttgcatgcgccaattgttgacccatgcatatcatacaccatgtagcaagcacactcctatacacaaatgaggctactcgctgcacaccaacatggaagcaaagctgtgccccatccaatgggacaacgccccctgaagaccctccactacaacgccaaaccaaagggcaaacgaccaccacccgacgcagatccagcacagcgctgataaccataacaaagcgagactgaaatggagcacccaggaggaacacaacgacaatcaagcagcaagcacaacagacccacatccacacgacaccagcaggacaagacaccacgagcatggtaacgacattggagaacaagacccacgccgtacgttgataggcagcaaacagaaactcaaataagcccaaatgcaagcgcaaccaccaagcggcaccgcaagaagcgaccacgcacagcgagcgatagacaaacacagggcaccagcacgcaaaccgacgggcgagacaaacagaaggctaggggccaagaggacgaaccaacacacccgcttcgatcgcgccccctcgtgcaccgatggtaccgctaggcacgccacgcgaagtggcactagcagctaaagagaacgtgatatccgaagagcagtagacggcggcacggtcaccacgcacgtgctgctggtagcgcccaggccagtcacgaccgccgtacgcccattgcatgtgcccccccacaaaacagtttaggctagctatagacctcgtatggacgagacagcagagtagcatctgattctctcgctacaactcacttctgcgggtgttatactcgaccgcactatctcgatgttctgctccacgcactcacgggcggagtcatgctaattaagcagaagcaaaacggcgtctgattgctctactagaaccactcgtttgcttgttctaccctgg

SEQ ID NO: 555420 - DNA, 360 bp, Homo sapiens
tccctcagcccaggcagacgggagcaggtttttggccagggtaaacaacaacaaacaacagcagggaagccattttccctgcatcctccctgcagtaaccccggccaggcccttaggaggaacagtggccgggagtgtccaaaaatatcctgtccctggatggaaaataggtctcgtttggatttttttttttttttttttcccggggtagggaaatatttttttatttcacagacaggttttaactcaacccaggtgggaaatggggtccctgtccctccccaagcccaaagcccaaaaatgaggccgtttacatggggagtttccgggctggtgttttagtccttaaaaaaatactca

SEQ ID NO: 555421 - DNA, 257 bp, Homo sapiens
gtccatcaatactatgctcggctatagtacggtcaaccaaggtggcaaagcagacgggtgcgattgcctttggttcccatgatatcttattttggttagatattttcgtgttgcttggcttaatattcgcacggaaaatcaagttcgatccacgaccattaccccgttttcaaccctttaaatcggctaacagttcggtgtttgtactcatcgccaatttgttttaaaccctattatctaccacaactttaaaccac

SEQ ID NO: 555422 - DNA, 138 bp, Homo sapiens
ccggtcatcttctgaatccgtatcttattccatacgaatcccatctctctgcccctatcatcctgatcagtcctagatcggtgtctacctctgtaatctgattgtcgcgtatccctgtccctaatgtctatctcagaa

SEQ ID NO: 555423 - DNA, 384 bp, Homo sapiens
acgcgaggagaataacccgcgtctcgtgtccctcacaggaggcctgaggacgctcccagcttatggatgtcactattcggaggcgagaggctgcaggcggggtcctaggagcccctgcttctccaggcctcttgcctttaagctctttctggaactggattgcctcccactcggactgcgaggagaactaccgcaggtcttgtgtccctcacagtccgcctgaggagtcccagcttatggcatgtcactatcggaggctgagaggcttgccggccgggccctaggagccccttcttctccgcgcctcttggccttttactctttctggactggatgggctcccactccgactgcgaggagcctagcccaggtcttgtgtccctc

SEQ ID NO: 555424 - DNA, 155 bp, Homo sapiens
tcatcagagtgttaacaatccagctcttgtagaagaatattagtatccaagtcctgaattggtacctccctcggagcgagataacttcgtaagaaagaagatcctgccaagcaggaagaattgctgctgaaagcaacatggcaggacttaaagga

SEQ ID NO: 555425 - DNA, 181 bp, Homo sapiens
ccgagatctcatgatcgttcttctctcactagcaaactcaagaatcttttacacccacatagtggtccctgtgtactcctatgatgctgctggtttgtaccaggcagtggttcgaagcagaagaggataatgatactgaaagtggtgctgcataagacggtgaagaattagatacagaaga

SEQ ID NO: 555426 - DNA, 223 bp, Homo sapiens
aatcgagctggtccatcatttacacaatcagaaagttgcttttattgttatgttgttaagaaacaagatcttgctcctgtcacccaggctggagtacagtggcacaatcatagctcactataacctccaactcctggagtcaactcctcctcctcagctccccaagtagctagaactacagacacacactgtccagtctcattgatatttgtgtaaactgatt

SEQ ID NO: 555427 - DNA, 111 bp, Homo sapiens
  misc_feature (51)..(51): n is a, c, g, or t
gcactttaggggcccctacggccggggggatcggcctccctcccccacgantcagcaatacccgcccccccggctgtgatgctccaataaacttttttatgcttttgcgga

SEQ ID NO: 555428 - DNA, 295 bp, Homo sapiens
gagtaggagctagaagatgagatttggatggggacacagagccaaaccatgtcatttcactccagcccctcccaaatctcatatctgcatgtttcaaaaccagtcatgccttcccaacagtcccccaaaatgtcaactctttttagcattaactcaaaagtccacagtccaaagtttcatctgagacaaggcaagtcccttccacctatgaccctgtaaaatcaaaatcaagttagttacttcctagatacaatggggttacaggggtacagggattgggtaaacgcagccattg

SEQ ID NO: 555429 - DNA, 373 bp, Homo sapiens
catacaggccactccctcgcccagggctcccgattccttacagagtgcaagagatcagctcccgagaagtgatcagcctcaagatcaaataacagtggctaccagttcttgctccctgcactcagctacctatttatttatgagcactgggtgaatcacccgaagcatagaacgggttactctagaagctagctcccggcagcatgtcagcaaatgaacaggacagcgagctggcctctggagccttggaagattctcacctccaagcagctgcagtatttgactcgaccttggaacactggccctgagactcaggggtttaacatttcacctccctgaattcccatccagaaatctcaggcgagcagatata

SEQ ID NO: 555430 - DNA, 1209 bp, Homo sapiens
tcgtctctttttttaatgctgctatttgcccttgtggcgcaggcgttgtttgtctatgttttctctgttttttctctcgtgtgctcttttttttgtggttccttgttttttctttacttcgtcgtttcttttttgtgtttatcggttttatgttaatcttcctcgtgttctacttgtctgactgcttcgggtttcttaggttacaattgcgtgccttctttggcctttgctgcttttctccgtttgtctttgtgaatttccggctttaggtccctttggctttctagatctctggtgttttatatgtcccatttttgagctggttcctgtttttttacccctgtttgttctgttggcaatgtcgttcttgaatattgatctttaaagaattccaatattctcgtggtactacttgtgttactaccctgttggtgtgtcccccgcttagctattgattcgctgtttacggcctgtatgcctagttcgtcctgcctctgcttgttccccttcgggtatcttgtagctggttgttcgcgctattcttgtcttgcgatcatttctgcatggtcacactagatgatgacccgcaactcgcttgtccctgggtcaccctgcattccatagccatgtgcttgtccctgtgctccctacggtttcccaggggccaggctgggagcccacagccaccccactatgccgcaggccgccctaccctaccttcagtcagcctatgggactcagggcccctatctgtccatcggtcgccgtgtggccagagtgggtccgtcgtccccaacactcgtgctcgctcagacactttgtcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcttatataaagactaacctctacttttttctttatgatattttgagtaaacaactgaagactggagactgattaaactgtatcttggggtaacctctagaactggtctatcttggtgtcgtggaacctcttacagcaattcaatacacgaattacgtaatcaactgtctcttgatacttaggaatatttcacgcttttatttcgaccaccagcataaatcataggctactagactattcaacctt

SEQ ID NO: 555431 - DNA, 364 bp, Homo sapiens
  misc_feature (5)..(5): n is a, c, g, or t
tcatntaaaaggcccctagagagggatatgggctgtcctacaaggcccaagggagagaggcctcagaagaaacaacccagcagatacccttgatgttgcacttcttgcctcccagaactgtgaggaaataaatctctgttgtttaagccaacccagtctgtgatactttgttacagcagccctagcaaaccaagagtgagccaccttggaagtagatcctgcagtcccagtcaaagcttcggatgactgaaactttggccaattatctgactgccatcagagaacccaagccagaactacccagctaagctacttctaaattcctgacccacagaaactatgtgaattaataaatgtttcttct

SEQ ID NO: 555432 - DNA, 362 bp, Homo sapiens
  misc_feature (112)..(112): n is a, c, g, or t
  misc_feature (120)..(120): n is a, c, g, or t
  misc_feature (123)..(123): n is a, c, g, or t
  misc_feature (139)..(139): n is a, c, g, or t
  misc_feature (144)..(144): n is a, c, g, or t
  misc_feature (150)..(150): n is a, c, g, or t
  misc_feature (152)..(152): n is a, c, g, or t
  misc_feature (156)..(156): n is a, c, g, or t
  misc_feature (161)..(161): n is a, c, g, or t
  misc_feature (184)..(185): n is a, c, g, or t
  misc_feature (195)..(195): n is a, c, g, or t
  misc_feature (208)..(208): n is a, c, g, or t
  misc_feature (214)..(214): n is a, c, g, or t
  misc_feature (218)..(218): n is a, c, g, or t
  misc_feature (259)..(259): n is a, c, g, or t
  misc_feature (301)..(301): n is a, c, g, or t
  misc_feature (305)..(305): n is a, c, g, or t
  misc_feature (320)..(320): n is a, c, g, or t
  misc_feature (332)..(332): n is a, c, g, or t
tgagccctacccagcacctcagtgaagggggcctgcttgctttttattttggtcccggatcctggggtggggcaaaaatattttttgggctggggtaggaggaaggttgttncagccatntcngctgctgtaccctagnaatangggganangganatggngtcccatgcccaaatgataaacnntgagctgccnaaacatttttttnaatacncccnaggagcccaagggggaagggcaatgcctacccccagggttntttttggggagggagggctgggcatagggacatattttttanaatntattttattaactgncctgttttgggncctgttacccaaaaaaaaaatgtttttaga

SEQ ID NO: 555433 - DNA, 763 bp, Homo sapiens
gctcaggcttcagacagatggggcccaccctggcggctgctgcccgacgtgccctccctgatggagacactcagctacagctaatgctacgatggagaatcatgacaggcccgtacttccgctaccgcacctacctggtcctggctggagcgagcccttcccgcggggtcgagttgcccaggccgtgcggctccctgtctgcgcctgcgtccgtggccggtccctcgcttcttcggcctgcatgttcctgactctccgtctcaccttcttcccgctggaggccgtgcgcgaggacgccttctaacgtcccggccgttggccggcccgacctcttctacatgagtccccgtcattcttcggacttccgtgatgacgtcattctacgctggcctggattgccggcgagttgctggattgcagttgtgcagccggacttttggcgtgccttacctcgcagtggtccgtcccaatagaccacgtgcgcccggaaggtcggggccgcggaccctgtcctagatggccgaactccgcctcaaggcaggattccctcgcataacacggactgagacgttcccattgggtaggatattgaacctaattgcaagatcccgatactcgatatacaactacggactggcgaagcgaggacaacaggaatttcctgccgatgccgggatgcgcagaatggcaattgcgagtaactgggaaacattgaccggtgccaagtggatgagctgggccgcaagaactatactacaaagga

SEQ ID NO: 555434 - DNA, 908 bp, Homo sapiens
cggggacacctcccatttcagttacctttgtgaatagtgcccgaaatatttatcttccctgagttggagccatagacgccatttaacatttacacggtctgttgctcttattgtttcatgtttgcctttgtaagcaacctagtcgacgatatggccggtatttctttgtggcataggatacactagatgtgataagcttgtggagaaattcctgctactgaacaaatggttttccacaaactttagcaacctcgtcttatcttccgtagagccttaatccacaccattaggttaggcaacatttatttgatagcactacggatgtacacgatgcgtttcgctctaaagacagatgcacctacattagagacttaccagggtgtctggagcgcaattcaacgtagtcgcatttctacagcaatttgacgatatggaagccgtatactatgctgacagataacatttgttactggagattttactactctagctgatcccaaattgaaacgacgctactgagagattttaaaagcaaacttgaagtatccgtaatctacttcagagtatgtgggtgagacgcagccaatcaggacaaataaagattaaaagggaggactatgaatctgcttccaataagaggttgccatgtgctagaactccaaagtattgctagatcgtgaaactgaaggcgtgaagatttatatatgtggatgtaagttattagtcccagtagatatcactgagtagaatacgtgtataaagatataagcacccaccattataaaagtagtacatgttcattttagcttaattagaaaaataccagaaagatgtaagaagtcatctgtgccctcacaaagagaaccaatatatgtaaccacataaacattttgttcatgatgtgcata

SEQ ID NO: 555435 - DNA, 432 bp, Homo sapiens
ttacagaggtgtatatatatggggtacatgaaatatttgatacaggcatgcaatgcataataatcacatcatggaaaacggggtatccatcctctcaagcatttatcctttatgttgaaaacaatcctattgtattcttttaattatttttaaatgtacaattaaattattttgactgtagtcaccctgttgtgctatcaaatactaggtctcattcattctgttttttttttgtatccattaaccatccccactcgctgacacccccagttcccaccaccattcccagcctctgttaaccatccttctactctccagctccctgagtccagttgtttaatttttaaaatcccacaaataattgagaacatgaatgtttgtcattctgtccctggccggcaaattcttgatatctaatagcaaagcttccca

SEQ ID NO: 555436 - DNA, 84 bp, Homo sapiens
tccgacataccgaggaccaactggtctacatggatgccctgaaacatgcaattctttcttccaaaataaaacattaaatagaaa

SEQ ID NO: 555437 - DNA, 786 bp, Homo sapiens
cgggggcaattttttccccccctgtatttaggggaaaatgttgtcccgagatcaagactatgcgcgcgttgccttcgtaaaagtcttcaccctttggagggaatcaaataatgcttcgcgccacgtatgaccagcgaggtgaaggacccctctccaacaagtccctacatggcatcactaggtgatggtgtcttctttaccatcgcgaccccacaactggatgtaaactctccgtaattaatgagggacaaccactcccgttaacatggaaaaattgtgaattatcctgttcgtgacatactcaaacctcgttgttcttccccagcaggtttcccactcctctatgaactcctcgggtgtccacacgttataacacgcgggagatcacattctttccccaccgcgtctttatcaaagagaggaggagcagaaaaagcacttctctggtggttgcttgggcgcgagcgtacaatatacgctctctgtcggctatccttaaatatatccggaaagtatcataaagcttggctcacccccctgccggaaaatgacttcacggccccacattcactcaacgcatcgcctggtaattacaggtcgattgtaccggggtattcagctaggtgtagagtgaaaacaatccgggctaggaagaaatctggtgtctattttggaagtaactcgccaccacatctacttcgccctactctctaggaaggtttatgaccccctttgttccagactcacttttaaagattggaggagataaaaacccccaacaaaaca

SEQ ID NO: 555438 - DNA, 214 bp, Homo sapiens
ctcccgtgatagtgtcgagtaacgtcgggcattctggataggccgagcaagtgtcgtgggaagaaaattagattatacgccgataaatatgatagtgcaatggatttaggagtaagtaagatctagaggtgtagcctgacaaataagggaaatcagtgcatgaagcctcctatgctggcaacaacagctcctcttgataggacactcatggaag

SEQ ID NO: 555439 - DNA, 404 bp, Homo sapiens
catgtgtggttggaggggaagagataccatgtatatacctttttcttttcactcttcgaaaatgtggaaagtgggccgggcatgttggctcacacctgtaatgccagcactatgagaggctgaagtcaggaattcgagaccagcctgaccaacacggcaaaacccaatctctactaaaaatatttaaaaatcagctgggcatggtggcatgcgcctgtagtcccagctactcaggaggctgaggcaggagaatcactgtcccagctactcgggaggctgaggcaggagaatcactggaacccgtgaggcagagcatgcagtgagccaagatcacgccactgcactccagcctgggcgactccatctcacacacacccacaaaaaacctacgttaacccgagcgc

SEQ ID NO: 555440 - DNA, 666 bp, Homo sapiens
  misc_feature (413)..(413): n is a, c, g, or t
ttccggggggagaaaaaaaaaaaaaaaaaaaaaaaaacaaaaacatgggtgcggcgcgcgcgccggggcccgcggaaaaacgcttcgctagaaacacacacatcgcggtgggcgcgcgcggcgggcgcccagagagagggataaggagaaccacacgtggggccatatagcgcgggtgtccctatagagagagagatctcgctggggccagagagacaataggggcgcggggagattctcctcaccacatatatagaaacaaagcgcgcccgcggggggggaaaccgcgagagagcggctctcggagagacagaaaacctctcagagagatgggagagtctccgtgagaggagagctctaaatatcagaggggcgcgactcttatatctaacacagagagagagagctctcanagagagcgagcaggcgcgtcgcgagaatttattctcacaaaatattatatacgcgcgcccgccgggcagcggggggggggaggagacacagagcgaggagcgagacacagagacgcaggcacggagacgacccaacaaacacaaagaaaacaaaggaggcaccgacgcaccaagagcaagaagaacaaaagaagaagacaagccgacagcacaaaccaacacacgcaaagcaccaccaagaagaggaggcggt

SEQ ID NO: 555441 - DNA, 525 bp, Homo sapiens
  misc_feature (89)..(89): n is a, c, g, or t
  misc_feature (221)..(221): n is a, c, g, or t
  misc_feature (446)..(446): n is a, c, g, or t
ccagccaagtgagacacatggcacagtcaagtggaggagtgagttgatttggaagcttgtttaactgaacccttgagagacttctcagncatgagctaaatgtcccctgtgcgggcaagaaagagaacacagctcctcccccgactaaggtggaaggctgggccaggcacccaagcatgttgtgtgcacgttggtacctaggtaggtattctactaggttnagcaagtaccagtttttttttctttccacacacacacaccgaggtggtggcacccccgcccgcgattttattttctcgcccccgaaacaacacgcgtcttcttctcggggggggggggccccccccacacgcactttctttgtgtggggggggcaaaaacaccgagcaacaccgggtttttttcttaatttctattggcgcgtttaacgtatgtcgtattaaggnaccagttttagacttctctaattggttattaaggtagcaaggtttcactctttagtaggggcgcccccattgggggctt

SEQ ID NO: 555442 - DNA, 1452 bp, Homo sapiens
gcaagaacaccaatgatgccaacatcctgccagatcattattccacagaaacaagtcaatcgaaagtcagatatctacgtctgcatgcatctccttatgcgccaccaaggtagcagccacaagggcaagtcacatcgctcatagttcagtcacacactgtggcaaacccaaggagcctgagcacaggcaacatccagaccgagctctgtgagctctaggaaccaattggaacagcaacattatgttcagcatccagtgacctccgtggtaccaaaaagactatgggaacagcaaagccagcatctttatttacccgcgacgatatgatgccaccacatcatttagcagcaaacacgtagtgcatgcaccatctaagaaaccatctcatcacagcaggcatgcaccaggcatccagcagatccgcacttaggcaggcaacatgcacagccgccaagcaagcaatgcacatactatggagagaacgactcacaccagccaggagcactggccgatacactggtaactaacaggcaccagcatcagcacaaacaaagcaggcgacaacctacgtgcccataatcaccggacaactaccaaccacactagggcacagggcacgatggcacacgaaggagtacaaaataggaacaacaacaggggaacgaaagacagaatagaaaacagaagcccgacacgcaggcagcaaggatagacacactgacagacgcccacatagaccacacccgagagacgcaacaaagacatacacacaacaagcctacaacaacagctggggcaagctgggacaataataccccgcaaacatctgggagcacaggaacgacccagagaattgagacaggacgacgcaagagagacaaaagacacacaaacgtggagccaagacacacaagagagtgagagcaacacagcggggtagcaaggatctcaacgaccaaaagaagataaggggcaaaagaaaccgaggaaacaaaagaccaacacagtatcgcgcaagacacagcgacgaagagacgcacgcaaggcacataccgcacaagcacagagagtgacgagcgacaacaaaacgcccaagggcgacacgcagatgatgaacagacaaagaacaaccgcatggcgaccagcccaaaagaaagccaggcagaagtgcaagagatgccaacaaaaagagacccacaagcaaggcagaagcggagcaagagggaaaagaagtttcacaaacacagtggaacacaaccaaccaagacacgcagaaacagggaagcaaagacagagccacaagacagcatctcgcaagcagtcaacagaaagcaacggaagcgaaccacaaagcaaaaacaaaagaacatcgacaggacgcccacacactgagataagaacagaaaagctacagcagaaagtcgcacgacaaacaaagaagaaaagagaacc

SEQ ID NO: 555443 - DNA, 287 bp, Homo sapiens
  misc_feature (4)..(4): n is a, c, g, or t
  misc_feature (18)..(18): n is a, c, g, or t
  misc_feature (25)..(25): n is a, c, g, or t
  misc_feature (44)..(44): n is a, c, g, or t
  misc_feature (75)..(75): n is a, c, g, or t
  misc_feature (90)..(90): n is a, c, g, or t
  misc_feature (117)..(117): n is a, c, g, or t
  misc_feature (120)..(122): n is a, c, g, or t
  misc_feature (148)..(148): n is a, c, g, or t
  misc_feature (176)..(176): n is a, c, g, or t
  misc_feature (200)..(200): n is a, c, g, or t
  misc_feature (269)..(270): n is a, c, g, or t
aaanatggttcaaaatanaaaaatnaataaatgtgataaccccncattaacagaatgatgggcaaaaaccatatnccaaaccaaaaaaanaaaaggcacccatatcagataacaagnagnnnaattaactatttgcagaggacatggncttatacatacaaaaccctgaaaactgnacacacacacacaaaaactggagntctaataaacaaattcagtaaagttgcaggattcaaatcaacatacaaaaagcagttgtgtttctgtannccaacaataaactatcc

SEQ ID NO: 555444 - DNA, 125 bp, Homo sapiens
ctccttttatccaagcagtcgcatctcatagacacgttctctggtcgtgaacctcaatctaccacaagaaaagtgtccagtgaccagttatttctacgtggcgggagaagtagtagaagctgagc

SEQ ID NO: 555445 - DNA, 171 bp, Homo sapiens
accacacctagtagaaatgtgtgtgagaacagaaggtgttccaccgagattcacatccagattggacaggttgtgttgattgaaggagatgatgtataacacccgtatgttgctgaattgcttgtagttgttcgaagatgactctgatcctcctccttagaaacgtgctct

SEQ ID NO: 555446 - DNA, 416 bp, Homo sapiens
  misc_feature (23)..(23): n is a, c, g, or t
  misc_feature (65)..(65): n is a, c, g, or t
  misc_feature (95)..(95): n is a, c, g, or t
  misc_feature (145)..(145): n is a, c, g, or t
  misc_feature (175)..(175): n is a, c, g, or t
  misc_feature (187)..(187): n is a, c, g, or t
  misc_feature (192)..(192): n is a, c, g, or t
  misc_feature (194)..(194): n is a, c, g, or t
  misc_feature (264)..(264): n is a, c, g, or t
  misc_feature (324)..(324): n is a, c, g, or t
  misc_feature (338)..(338): n is a, c, g, or t
  misc_feature (341)..(342): n is a, c, g, or t
  misc_feature (370)..(370): n is a, c, g, or t
cggccagtgtgtggaggtgagcnccgggattgccggcattcccgcttctgctggttgcttcatgntgcaggctgcggccgtaagccctcgctcgnattggtggcgctgaggtgccggggcagcaagtaaaatgtcgtcgggcctncgcgccgctgacttcccccgctggaaggcnaaatctcggagnaactnangcgccgggaacggctgcagaaaaaggcgttcgaggagataatcctgaagtataaaaaattgctggaaaantaagatcttcattcagtgttggcccagaaactaaaggctgaaaagcatgaagtaacaaanaggaaagaaataantannggaaatgatggcacatggaatgaaaatnagctaaaagaaatggcccaactgaggattaagcaccaagaggaact

SEQ ID NO: 555447 - DNA, 566 bp, Homo sapiens
  misc_feature (479)..(479): n is a, c, g, or t
  misc_feature (488)..(488): n is a, c, g, or t
  misc_feature (505)..(505): n is a, c, g, or t
  misc_feature (531)..(531): n is a, c, g, or t
aatgctctctttctccgaagatttgccatgacctctgccttgggaaaaaatatttgagattttaaaatttttattctgtagtacaaaaattatgtttttcgttaattggtcctgtggaattggaaggaaatttaatatttattgactctactttggtattattttcagagtgagaagtaactttaagtgtattaaaatttcattcatttttgcatgaaccaaactttccctacacatcgctgtccttgactgtccagagtaaacatgtctaactctggaatgtttcatttccaataaaagtattcagcctgtcattttgggcctaagtaaaatgggataaattagcaatctgaagttaggatcctagccacagagggccatgtctcatttctggtttaagtgcacccctcatccccagcccttaccttcttctttctcttaaggattgagacaatcctcttggtgctcttggtgcaggntgcatcttnggtcacctctttacatngaaggggccacaaacttgggtaaatngggtgggcctggagatggggttggtactaggtaat

SEQ ID NO: 555448 - DNA, 299 bp, Homo sapiens
gaaatccccccttttgaagggcccctttttatgagcccaaagtttgtcctttaaaagttcattttgagggaaaaacctgtaaaataatttgaaaaaaagggataggacccttaaaaaaacccttaaaactgattgttgggaaaggggggaatttgttaaaaagaggaactttgaaaaagtttttcatgccccggccaaaggtattccctagatttttacggagggatcggcttttcctttggaatttggagttcccaaaaaacttttttttaaaaaaaaaaagcccccccttcccctta

SEQ ID NO: 555449 - DNA, 312 bp, Homo sapiens
gaaggatccccctaaaagctacgatcccctcctccaagcctcagaattttcacgaagcaccattcacaatctccgacggagtgtattgatccactttactttgtggctacaggatttcacgggttgcacgtaatcatcgtgatctactattacctagcagtgtgcttactacgacaactaaaattccacttacacatccaaccaccacttcggctttgaagccgcagcctgatactgacacttcgtagatctagtttgactattcctttacgtatcaatctattgatgaggatcctactcttttagtattaa

SEQ ID NO: 555450 - DNA, 280 bp, Homo sapiens
  misc_feature (40)..(40): n is a, c, g, or t
  misc_feature (64)..(64): n is a, c, g, or t
  misc_feature (90)..(90): n is a, c, g, or t
  misc_feature (98)..(98): n is a, c, g, or t
  misc_feature (107)..(107): n is a, c, g, or t
  misc_feature (110)..(110): n is a, c, g, or t
  misc_feature (118)..(118): n is a, c, g, or t
  misc_feature (128)..(128): n is a, c, g, or t
  misc_feature (133)..(133): n is a, c, g, or t
  misc_feature (150)..(150): n is a, c, g, or t
  misc_feature (167)..(167): n is a, c, g, or t
  misc_feature (172)..(172): n is a, c, g, or t
  misc_feature (175)..(175): n is a, c, g, or t
  misc_feature (184)..(184): n is a, c, g, or t
  misc_feature (202)..(202): n is a, c, g, or t
  misc_feature (220)..(220): n is a, c, g, or t
  misc_feature (228)..(228): n is a, c, g, or t
  misc_feature (230)..(230): n is a, c, g, or t
  misc_feature (257)..(257): n is a, c, g, or t
aaaaaaatatatatttccttatgcatgctcgatgcatttncgtccggaaaaaaatgttctctanagaaactacccgtgtgtaaaaaaaanattggcgnaaaatggcnacngtgatggnaacagtgtcntaggnagatgcagcttggacgngaggtaaattgaatacnttacnacngtggtttanagtttgcgttaatgacgntgtatgtaaaaggtcacntgattgcngnaattttgtattcattatggtttccggnataaatgtacgttgatgacgatt

SEQ ID NO: 555451 - DNA, 863 bp, Homo sapiens
gtgagctagtgctgccatcggtgccggtgcagatacggggttgctcttgtgctcataagaggggcttcgctggcagtctgaacggtcaacgcttgaacaatcgcggtaaaagatattgcttcgcgtgggtgacgcggtatcagctgcccaaggggcgttcgtaacgggaatgccgaagcagtgggaaaaagggagcggtggcggaagacggggatgagctcaggacagagccagaggccaagaagagtaagacggcgcaagagaaaaatgacaaagacggcagcaggagagggccctagctccttgtatgaggaccccccatgatcagaaaaccctcacccagtggcaaacctgccacactcaagatctgctcttgggaatgtggactgggcttcgacgccctggtattagcgaatgaacacggattaatgattgtgcgtaagagggacagaagccccagcatagtactgtgccttcaagagaacaaaatgttcagagaacaaaagtaccatgctgaacttcagtgagctggctggactctctcatcacttactggtcatgctccttcggacaaggagagggtacagtggcgtgggcctgctttccccgctcaggtgcccatctcacaagttttcttaccggtcaataggctgatgaggagacatgactcaggaatgtccggggtgatgtgtggctgaattttgactcctttgtgctgggtaaacagggaatattgtaccttagtgcagggcgaggtttggtacgactggagtacggcaagggcgggatgcaggcttggcgcagttcctgaagggctggttccgaaagccctgggtgtgaggaaactcgagtggcatggagac

SEQ ID NO: 555452 - DNA, 489 bp, Homo sapiens
taattacccggctaattctaatttctgtattttttgtagatatggggttttgtcatgttacccaggctggtcttgaactcctgagcttaggtgacccacctgagttggcctgtcaaagtgctgggattacaggtgtgagccaccacacctggcccttttcttttcttttcttttcttttcttttcttttcttttctcttttcttttcttttctttctttcgttcagggtctcactctgttgcccaggctggagtgcagtggtcttatcatgactaatttcaacctggaactcttgagctcaagcgttcctcctgctacagcctcccaaatagctgagaccgcaggtgtgtgccaccatgcccagcttttaaaaaaaaaaaaaactttggtaaagactggattttgccatgttgcccaggttggtcttgaactcctggcctcaagcaattcttcctcatcagcctccctaagtgctgagattacaggcag

SEQ ID NO: 555453 - DNA, 109 bp, Homo sapiens
attactgacagaaggggtagggggtgggcgctactttgtgcccgtgatagcttctctgctaaataggagtccccccccagcaggactttgaagccccattaatgggatt

SEQ ID NO: 555454 - DNA, 450 bp, Homo sapiens
aaaggacatacatataatctactcacattccactcatctccctaagtcatgtaacactgcaaaagcaatgtgtaaccctggctgggtcgccatttcccagcaaaacttataaactatacaaagaggcatgaaactatggttatcagctggccatatctgtcacagatgacaataagtaccaaagacaaaacagaaaaaaagggacagaaaatacaagggagggcattacataatggtaaagagttcaattcaacaagaagacttaactatcctaaatatatatgcacctaacacaagagcgcacagattcataaagtaagttcttagagacttacaaagagacttagatagccacataataatagtaggagacttcaacattttgctgacagtattacatgaattatcagggcagaaaactaacaaagatagtaaggacctcaacttgac

SEQ ID NO: 555455 - DNA, 214 bp, Homo sapiens
acggggtttcagcatgttggctaggccggtctctcctgacctcagggtgatcagcccccctcggcctcacaaagtgctgggattacaggcgtgagcccccttgcccagcccccatcatacagtttgaaatgaaactttgccccaaccagcctttgctgtagcacacacatatatccctgaacctgtttgaaataaagttttttttctttttcca

SEQ ID NO: 555456 - DNA, 197 bp, Homo sapiens
gtgcctactactgggaatcccgatagctgtaagtcttttggttttcctttcttattgaccagcatccttggagctctagatctaggattcgggggatattctaagcgcggagcttgagagatctttatggttgggtatgtatgtgtatgggcgtgttggccccacacacctgcagcaaagacttattgtgatttggt

SEQ ID NO: 555457 - DNA, 1226 bp, Homo sapiens
ggggacagatgccctgtgatggccgcggcctgggctcggcgggccaccccgtgtggtgccctggtgccatggcatgtgctgcctgtctgaaggtgaactgaacttctgctgatggagctgcatgcgcctgctggcctgtgacactcgcatggccgtcaatggcctgagcttgctgagcggctgcagtgcggcgttggatggcctgaggagcctgacgacgtagcgcggagctcgacgccgacgacgaaccgtgggctgacccgggcacatcacagcgacggagatgccatggacaatattaccaggcagaaccaattctacgatacccaagtcactcaacacaacgaaacacgagtcaggctacgagacggagaccactggcacacatggcagcagcagcaggcctatcgtccagaaatgaccgacagcagactgaacgcaccggagcacccaccagcattcctcccgcctgacagcttctcaactcaagccagacaggcagcaattccagagtcgcaaagaggccttatgacgcaaaaccggggcacgggggtactttgagcacccgcgaggatacgcgaggggccgctcctcctcagcctcctgctgacgacggcactcacgactgactttgatgagtaccctcgcttgctatcgaccacctataacctggcacctccacttcaaggtgggcccgagaatcggcagtaggtggctactccgcgtcaccatttgagcgtgcttagcataacctgttggtccacgggagccctgtgcgccagcgtactcgggttcccgcaatgtgggccgcgtgaatgcctcgaggatgacaactccactgtacggacacatcttcggcgacatcgcgatcgcttccagccttactggagcccctgcaccgccccacggctggaccgcaattcgcgttcgtccccttgcacatctggagggaccgcagctaaggaaaagaagacttctacaacactgtgcctattgggaggcgccgctgtacaagcgtcgtccgcaagtcgtcagggtcgaccccgcaccgcgaacagagcctggcgacaacagctgcgaccagccatcgtgagcgcatacaactatcgagtcagtcagactcgcaactcccagcacgcgcggagggcattgagtgagcagcgggacgtgaggagggggcgctctcggcgacaccgcctgcaccgccaccgccaccaacaggagaa

SEQ ID NO: 555458 - DNA, 207 bp, Homo sapiens
acacatctgtattactctgcattcatgtgagttactcaccctgacgctcaccatatgtctaatagaaaacaacctgaaaccaaataattcaatgcactgcttattacaattttacttggtgtctctattattacccctacctacaatgcgctcagatgtaccttctggggtacctgatgctctgacattctgtaactcattgtgtct

SEQ ID NO: 555459 - DNA, 661 bp, Homo sapiens
tatgtgttgtcgtgcagggtcctacccccacggaaatctcgctgattgctagcacagcagtctgaaatcaaactgcaaggcggcagcaaggtctgggggaggggcgcccgccattgcccaggcttgcttaggtaaacaaagcagccgggaagctcgaactggggtggagcccaccacagctcaaggaggcctgcctgcctctgtaggctccacctctgggggcagggcacagacaaacaaaaagacagcagtaacctctgcagacttaagtgctccctgtctgacagctttgaaaagagcaggggttcctcccagcacgcagctggagactctgaaaacgggcaaacgtgccttccctcaaggtgggctcccgtgaccccgtgacccccgagcagcctaacggggaggcacccgccagcaggggcacacgtgacaccttcacagcggcagggtatcccaacagaacctgcagctgagggtcctgtcatgtatagaaaggaaaactaaacaaacagaagggacatccacaccgaaaacccatcgtgtacatcaccatcatcaaagaaccaaaggcagataaaaccccaacgatggggaaacaacggaacagaaaacctgcaacccttaaacgcagagcgcctctcatccccaaaggaacgca

SEQ ID NO: 555460 - DNA, 257 bp, Homo sapiens
acgcgtcaagttacccacaaggtggaagcagcccatggatggatgaatggaataacagaacaaacaaatacgtggtatatccatacgatgcaaatattactcagcctcttataaggaagaaaattctgatgcatgctacatagataaactttgaggacattatactaagtgaaataagccagtcacagaaggacaaatattggatgattccacttacattagcagtctaacccacggagacagatggcgaatgagga

SEQ ID NO: 555461 - DNA, 169 bp, Homo sapiens
ttatcattgcccttatggggtcttgtatcaggtctataatatatagctaccacataaaaggacatgtactgtacttgggtgtagcactgaaaaatgacgatgcttaatgctttttgaaacttatttcctatacattaaatctaacctgatttgtgaaatttatacaatc

SEQ ID NO: 555462 - DNA, 794 bp, Homo sapiens
gccagatcacctggtgagaatgagcaagtggttgtcaatatagctggtcacttctatgctatgcgaggtgcccagagaaaaatgcaggaagattctgagctcaggtaaagcagagaccaacaacagaaggctctgctagggtggaccacctcagtcaagacggaagtcagaggctcaggagaacagcctcaccacagaggcagatggcaagaccaaagacagattgcttaaccaacagatgggcgctgaccccctatccagaatcacatgcacgagtttttacctagccagtctgtttctgaggaccaggcaacttttgaactcctgtctcgtgtgagaatgtatactttatgctctcctgaaagtgtatgacacccagctttaagaacaacacaaagcaaacaaaacaaaacacagggtgggggacgggagggcagagagaagagctctgcacttcccgtttgtggtagctctcacagtataaccagatattctaattcttcttaatattcccccataatgccagaaatgggcttaactgatgcttttcactaaattcatcaaactagattgctgcctaaatccacattgtggcaacttggactcagaaactcacttactcacaaggtaacttaaatggttaagccattagcatagtaaacaactggtgcctcaggcataattctttacctatgcactaacatgagtaaccctaagggaagtgctgaaatgggtggtgggcagggggctctaaaacgctcatttgtaatctaacatacctcaggtattccggc

SEQ ID NO: 555463 - DNA, 436 bp, Homo sapiens
cagctgaaaaagcctaggacagcggtcttgtgagggaccgggatgcaggatttcttcacgcctcccctttgtgacttcaagagcctctgggatctctttttgcaaaggcacctgaatgtgtttgggtccctgttagcataatgtgagggggtggagagacagcccccccccgtgtcccccgtgacccctgtttccatggtgacctgtgtttcctcccccgtcatctttcttgttccagagaggggggggtggatgtctccatctctgtttcaactttatgggccctgggctgcaactttttacttccctactgaaaataaggatttgaatataaatttgttttttcaaatatttggtatgggggggtgatgggttaattaaataagtccattcctgggatttgagggggccaataaaggcctgggaaccttcccga

SEQ ID NO: 555464 - DNA, 492 bp, Homo sapiens
  misc_feature (226)..(226): n is a, c, g, or t
  misc_feature (306)..(306): n is a, c, g, or t
tacttttcacagggcatgtttgctcagatctttgtaattattattgatagtcttccctccacccgtgactaggctgctatcttcttttcagccctggatggtgccttaagcccagtttgcctggcactaataaataaccagagtgccacctgtcccaaatgagggaggtcccaaagtgggtagcctgctactgtgaaaaggctggctaggagtttgtgcccagggnacctgtggaacaaacctccgacagcacagtgctgatgaacagtcactctcatttgatatctcttttggccaagtcactgngcagagtttttaggtgggatggttgtcctctctttttgcccctgtctctggctgttctcaaggatatttctccctggctcacagtttttacactggaaaagtgagattgaggtggacaatcagctttctcaccatcttgggttcctggcgagtcctgttcctgcctcaacccctgtgaaaagctcg

SEQ ID NO: 555465 - DNA, 360 bp, Homo sapiens
  misc_feature (5)..(5): n is a, c, g, or t
agganccccactatcgctaagaaaccctcatatactgctggtggaaatgtaagatcatttagctgatggaaaacagtctggcagttcttcagatggttaaaaatagaattatcatatgacccaacaattctactgctagggtatatacccaagagaattgaaaacatatgtctacacagaatacttgtacctgaatattgatagcagcattattcacaatagcccaaaagtataaacaacccaaatgtccatcaactcatagataaacaaatgtaatacatccatacaatggaatattatttagccgataaaggaatgaaactctgatacatgcctggtgacagagtgagactccatctc

SEQ ID NO: 555466 - DNA, 470 bp, Homo sapiens
tagaggatcgcgtgcgacattttacattgatcaggaaatgaaggaggtattccaatagaaacagatgtcaactaacgaaggaattgtgacccttattaaggaagtagattatgaagaaatgacgaatcttgacttcagtgttattgtcgctaataaagcagcttttcacaagtcgtttaggagtaaatacaagcctacacccattcccatcaaggtccaagtgcaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtccaattagaagatcagagataattggatctctgtggattctgtcacatctgcaattaaacttgcaaaacttcctgcatccgactctagatatgttcaa

SEQ ID NO: 555467 - DNA, 248 bp, Homo sapiens
actcctaggcacacgcgtatccgcctgcctcagcttcccacagtcctgcgattactagcttgagccactgtagccgccagatttaggatttctagatgagaattcgtgtttaccagaagtggcgctgttgaccacacacctttgagaatgggttctatacgaattatatgcttcaaaatgtatacactatgaactgagctcagatgaacctataaggggagtgtttattgaatgtattagtttatcca

SEQ ID NO: 555468 - DNA, 101 bp, Homo sapiens
gacggttcaacggaacttagaaggctgagttttataggttaccataggtatacgtgcagtgaacataggacagacgtcctgataccctgttgagacacgtt

SEQ ID NO: 555469 - DNA, 171 bp, Homo sapiens
tgaccccatcagaacacattacctcataaagagttgcctctatttaggaataagacttcctctaactaatttcatacaaactagtgtatgtccttcagttgttttatctaggcttctctgcaagcttggagacagctgcttaacacactattgtcgggtaccgaggctcga

SEQ ID NO: 555470 - DNA, 154 bp, Homo sapiens
tctgatgaccggatgttgctggtaggagaagggtctcagagaaagggggagaggggaaggtcttacaaaggttcctcgagctcatgccatctcctactttcacttgagaccacaaagtctttggtccccaagtcttgatttggtcaaagcgccg

SEQ ID NO: 555471 - DNA, 208 bp, Homo sapiens
  misc_feature (55)..(55): n is a, c, g, or t
  misc_feature (113)..(113): n is a, c, g, or t
  misc_feature (126)..(126): n is a, c, g, or t
atggtggccaccctggggacagtgacaaaggacgggaagacagatgccccgccanaaggagctgccttaaatggcccagtgtgatgctctgccgcccggccacggcccacccnggtcaggctgccnccttaatcgagaaaactacctggtgatgcaatctttttttttttttaatttaatttaattttaaaataaatgctgcattggt

SEQ ID NO: 555472 - DNA, 150 bp, Homo sapiens
tcgatcgctaagcataggacaaatccgatgtctacgatgcggttgtataggattagctatgtagtgcagctagtgtaagagcgtctgtaacgtccgtgtcatcataccaattgagacaggaatagataatgattccgtacgaccttctac

SEQ ID NO: 555473 - DNA, 162 bp, Homo sapiens
tgggtgtgttacattgcgtatttcgggggaggttatatgggttaatagtttttttaacttatttagggggaatgatggttgtctttggttatactacagcgatggctatcgaggagtatcctgaggcatgggtaggtcagaggtttcgtgtcctccggacta

SEQ ID NO: 555474 - DNA, 818 bp, Homo sapiens
cgccgacagcaccagaagcgggccggatcacgaccgcgcccccccttgacgacctaggtagaaccccgtggaaagagccagaggcccccagagggaccacaagaggcagggggaccaacggcaaaacgggtggcccgaagggaaaccaaggggacaaagagggcgaaaaaaggggacaacgggggggacaaagaggaagcagggaagagcacagagacacgagaaacgaaagggaccgcaaacggagggggaaggaaacaaagaagaagagagaacaagggcaccaggggggaacgaccgaaagcgcacaaaggccgaaaggagagcaggaagcggaaaccccgagcagaggacgaaacagaggcgaacggggaaaggacggagagccgggagggggacaacacccgagacggggcaggagcgcgggcccaacaggacgcagagcccgaaaagccgacaggcaccaaagggagcaacagagggggacaagggagcgaggcgcaggggcaaaaaaagcgcagagcggggcagagagcccgggaacccaacagggggcacagcgaacccaaaagaaggggagagcaacgaagagaaacgacgacggacaggaggccgaagagcggagaacaacggacaaagaggacacaacaccgcacgcggggaagagacacaccgacgcgaagccgaggccagaagaaggagcaaagggcgccggagccacaccaggagcgggaaaaaagagaaggagcccgaagcaaaccgacgggcgcagccgaaaggggcaacaaaccacgaccggccaccgggggaacccagcc

SEQ ID NO: 555475 - DNA, 943 bp, Homo sapiens
  misc_feature (426)..(426): n is a, c, g, or t
agcgggtcgtataccttcagcaggagaccgggttaccctgtgatgtgtgtccgtgtcggccctcgtgctgccggtccgtgcggtggtgcccactgtcctcactactggtcctactcactggacctggcgtgcactccctggacggcctttcactctctccttgggattccgactagcctgtcgttctcacgccgggcgtcatctgcgctcggcgcggtgacttcatgcctaggatttcttcaggctcgctgtcgtgcgagctcacaatggtaggaaaagatggggtatcatccgaagattccgcaatatctgagaggacgatcgaacagttgaaacgctctcttagacagaagtgtgatccgatccaaatacgcatagatagacgagttgaagctccttggggagctctagagttgccctagcgcngggaatggagttagccggaagatgcgctttagctgctcgcattgctcctaagccgattcgcgcatagggctaacgaagggccccattgattttagcgctcgctccaaagctactttgggacgagaaggagactacgcttgtgcgaccctttgcgggggacttgaggcgtgaatgtggttgcgacagttgcattcctgccctgaacttaggtcccattggggatgaagaacccagttgacaacctcttatgaagccgtacgtgtgcacggtttacgtcaccttgttgcagggacctattgtgtctcgtgaacctctggaaggccgttagaaggagttcggggaagcgcgatgttttcttcttgacacccacggagttttttgtgaggggttacacgtctcgacggactgattctttatactggccccaaaacgccaaacgcttggggggaataggccaggaacaagcgcagtccttgcaggggaattggcctgtggaattgctagttttacctagtgg

SEQ ID NO: 555476 - DNA, 617 bp, Homo sapiens
  misc_feature (421)..(421): n is a, c, g, or t
  misc_feature (469)..(469): n is a, c, g, or t
gcggtgtcacgttgtaatcccagctctcagggaggctaagaggcgggaggatagctggagccaggagttcgaagaccggctgggcaatatagcgagaccccgttctccaagaaaaaaacaacaaaacccagcaaaaaaaactttttgggcgcccctggcctaggaagaggtttaaaaaccacatttgggtggggccggaggccccaagaggtacggtggaacctggggcacaaggtgtgccaaaagacacactgggggccaagacaacgggggctgggtttcccaccaaagaaaaaaacggccgcgggggaaaaccaacacagcgtcgtgtggagacacacaacaccaagaggtgagagattcacggacgagcacaaacggcggacccataaaacaccagcggggcgaccaaagggagagntgcggaattaaacaaaaatgtagccacgccgcggcgggtggaggaganaaagcaatgcctaggcaactacaagacaagacagcaagacgaagagagcaaggctacgcacaggcaggcaaccaacggcactacacgaagcacaataccaagaaacaagagcaagcagatgaaagaccaagctgagaagcagacaagt

SEQ ID NO: 555477 - DNA, 144 bp, Homo sapiens
cagctttttttattgtaaaaagaaaaatcaactcactgttcagtgctgagaggggatggaggccaggtgcgtaggggcctagatgcacgtttgaaccaggaacgaggttgtaaccggacgggcagtgcctagcttatgttgcga

SEQ ID NO: 555478 - DNA, 1005 bp, Homo sapiens
tttgcaaatagtaacgacaaagatgatcaagttttaaattgccatttggcagtgaaggtgctatccccggaagatggaaaagcagatattgtgagagccgctcaggacttttgccagttagtagcccagaagcaaaggagacccaaagatttggatgtagatatgttagtttactcagttcaaatggttgtcctgatcctgatttagtactgaagttcggtcctgtggacagcacacgaggctttcttacctggcacatcagattgactgagactgtctctttgccttcccatctaaacatcagttatgaggactttttctctgcccttcgtcattatgcagcctgtgaacagcgtctgggaaagtcgtggtcattggttgcataattccatttgagcttatggaggaaaggaccaagtgactctgattttagaaagcacctatgaaaccctgtacacacctatgaaaccctgtacacacctagttcataatcttcataatttatcaacaaacacaaaaaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctgttttcgtggggagaagagggcctgattagaactgttctggttgtgtttggcgggaggggaataaattttgttcagtccttcttagtgaccaaactttaatttttaagaataatatattgacttactgaactgaagcattctgagttgaaaggagctccagaggaaaggagttctgtgttgctcacatgttaaagcttgctcaccttcagagcagaggaatacctatctacagatatccgcccattttcatctctcttcattatagtcaaacagtgtgacttgagagtgttg

SEQ ID NO: 555479 - DNA, 124 bp, Homo sapiens
gttgcccttgggccccagaattcggcccggggttgcggggttccccaaggagctcacctcccattgggggcccccccccccccccccttaccggtgttccgtgttaacgttccccccgtgggga

SEQ ID NO: 555480 - DNA, 898 bp, Homo sapiens
tgagcggtgtgggctggactgcggcggacgtgggtgaggtgcgcggctgtaagagagcgggacgcggggtgccctggcgcgtggtgggggtccccggcgcctgtccccacggcacccaagaatgggcctggccagcggtacccctcctgcggatgccctgcggtggttggggggggcgctggtgtctcctggcgcctgctgactgggccctgtggactccccatgcggcctgcgatgctggctgcccagtcgccctgcaggcctgcttgtcacctgtgttggctgctgtgctgaggctaccgcctgtggcgcccacgttcgctcaagtgagcctgtgccgcgtcccatgtgtgttcaccctaccttgctgctctagcctgcagctctggtgcctgcgccttacagttccctgcggcgcgtggggcttgctgcgtgctgctgggccagcgtggccgacgggctcgtgcaacagcctgctcgtaggagcttacgcgagaggccagacacatggcagccccggaccagacttgcttgcggcaccaggataacaggacccaggcaggcacacgggctctaggcaaccctaggtcaggggacaccggtccttgccggtaacattgatgtcaccatttcccacgttcaatcatttctaaggaaccgcgttgcgcacgtggggggctaaggtgtcagtgcagggccacaaaccggcccccagaagtttggatgcatggcacccattacattcttaacgtaaatagaggaccccgtaaccattccgagtgaatcttattcccaaggattcagcgcaatggagcccatcaaacaacaaagaaattctcgccagacgtcaagcccaatacttccccggggaagactccaatcacccacacggacacct

SEQ ID NO: 555481 - DNA, 340 bp, Homo sapiens
attttgatttgggccccacccctccttccttttcccttgggctcttaggccggaaactctcccaaacaaattttctagaaaatataccccccccttcccgtcaaggggtaggggggggggcaacagggagaaggttggtcccgctgagtcctaagcccatgggacctgtgaccaaccggtcctcatttcgttctcagagcccccccttctaggacaccaaggagctcccattcctgagtcgcattatcactatccttggagccgggtagggagaggcagaggagaagccggagagggcccagaccacataacaccgcgatcatacataaggcacaggagt

SEQ ID NO: 555482 - DNA, 83 bp, Homo sapiens
tgggccccgtggagcctcagtgcccgtttggcctgctctctcgctgacaataaagagcccttgcgttgcactgaaaaaaaaaa

SEQ ID NO: 555483 - DNA, 394 bp, Homo sapiens
tggtatttttagtagagatggggtttcacctggttgggccaggagggtctcgatctctggacctcatgatccgcccgcctgggcctcccaaagggctaggattacaggcgtgagccaccgggcccggcccaaagatccctttttaaacagtgcatttgggagtcggtagtggtgaccttttatttttccctaggcacggaaaatgaagatgcgggaagtgactatcaaagtgataatcaagcaagtgggattcatcgtatgataagggcctgggtgagtgattcagctttattcaataccagagaaggacgtgcggggaaggtacacaacttcaggcggggctggaatctcaatacatcttatccacggtctccttggagtgacttggccacac

SEQ ID NO: 555484 - DNA, 246 bp, Homo sapiens
tgtcacccaggctggagtgcagtggcatgatcttggcctacttcaacctgggtgacagagcaagactcagtcgagaaaaaagcagtgtaacaattcctcacaggactacagaactaaatagcagagcttaccattatgacccagtcaacctctagttacttgtgttatattaccctatagtaaatatagagttagttcgtcttaaataaggacacacacggtgctacatgcattattatattgcag

SEQ ID NO: 555485 - DNA, 490 bp, Homo sapiens
ggatctggcagacgacctatatgatgttggttccggacaagaaccaagatattcttcgagaaaaggtcaatgaggaaatgtatatagaaaagttattggatacaatggtgacagcagttccatgaaagtcatttgcgtgtggttagagctgattagatttgagacctctcaagctccattatttaccagctgaagacgctcatcaagattgtgaagaaaacgctacagggacttatcgattgcagggtgtgtaggaaggaagcactgaactagtaagactgtatgatactgtagcacagtacgctttacaccaagatagcagggagggcccacagcactactgtttcagaaggaggaggacttcagggtcattactatgacaagacagtgactgaagaagaacgaaggctgattatcatcacaggctatagcgcgaatggaagcgaacgaccgttggattcgagcactaggtcggatacttatcttttaa

SEQ ID NO: 555486 - DNA, 106 bp, Homo sapiens
ctgaactgggggacatgggtcgttggtcagctccagtaagcccaggctgtcatagcggtcaggtggtgtgattgtgatggactgggcggtaaattcatcatcgaag

SEQ ID NO: 555487 - DNA, 911 bp, Homo sapiens
  misc_feature (911)..(911): n is a, c, g, or t
ggagggtgtgtggttgtctttctaattaggtgtatagcctattcactttcctagaataaatctcttaacctaaattggagtagtctgcatttggcaactcctctagcagcttggtagcctagtacaggtgttgtttaaaagaaaggaaaagcaggaaggaggagtgaattttattaacgatgttgccaaagtgtatggagattgggcctcgtgaagaacgagctttttcagtgttaagttgtctttaccttaagattcagagaatactgttagaagtatgattaattttaagtccgtgtctgttacatcctgttggaaaactggtattagcatgagttggaaaaaggacaacgaaaggcttttcatgtaaagataagatctttagctatctctaagccgtgtccttttttcactgcattttttctagttttgtgtcattgttatcattaggatagggtaagtgaagtttgctatgctgctagcatcctaagatgatacctttgttgaaagaattgtgaatagcatgattccatttctagcagaggctgagttaggacaggagtgtcatgtggagaagtcttctgtgtcggaatagcatttaatgactctggtcacataagcaaacacatagggacgtatctggtatgaaaattcacagaattttagataggctaaagcaattgatatgctcactgctgtttcttagggttcccccatgcttttcatggtcttccagagagaggttgcagattctattccctacattaatgatggatgggtttgagggaggtacacagcggggaggaggtggggccactgagggggggtagttaacatataatcaggggggagagaagagggacgaagagcattatatgggacaggaacacatgtggggtaggtcgctatan

SEQ ID NO: 555488 - DNA, 472 bp, Homo sapiens
  misc_feature (301)..(302): n is a, c, g, or t
  misc_feature (356)..(356): n is a, c, g, or t
ataatttagaccccatacaagtttataaagagtcattgttattttctggttggtgtattattttttctgtggtcttactgatctttgtatattacatacatgctttgaagtttctggaaagtagatcttttcttgacctagcatatcaatgacaggtgcagccctttgtgatgtgattaggggtctaatgtgaaccaatggattggtattggatgagttcttaaaccttttcccgtaacatttggtttcttccaaccaggcatttggtttaggaaacccttggttaaggacggactcactnntctttttagttgaggccttctagttaccacattactctgcctctgtatataggnggttttctttaagtggggtgggaaggggagccaatttcccttcatcactccttataagcgagtagagtatatggggggtctctatagagaaagagcccttttgcgcccaactctct

SEQ ID NO: 555489 - DNA, 131 bp, Homo sapiens
ggctaggattataagcatgagccactgcacccagctgaagcccaagtttttttgctttttgcattttggggtttttttcttttttctgttgcccaggctggagtgcaatggcgtgatctcggctcactgca

SEQ ID NO: 555490 - DNA, 607 bp, Homo sapiens
  misc_feature (33)..(33): n is a, c, g, or t
  misc_feature (49)..(49): n is a, c, g, or t
  misc_feature (52)..(52): n is a, c, g, or t
  misc_feature (55)..(55): n is a, c, g, or t
  misc_feature (83)..(83): n is a, c, g, or t
  misc_feature (94)..(94): n is a, c, g, or t
  misc_feature (101)..(101): n is a, c, g, or t
  misc_feature (123)..(123): n is a, c, g, or t
  misc_feature (126)..(126): n is a, c, g, or t
  misc_feature (235)..(235): n is a, c, g, or t
  misc_feature (309)..(309): n is a, c, g, or t
  misc_feature (432)..(433): n is a, c, g, or t
  misc_feature (444)..(445): n is a, c, g, or t
  misc_feature (464)..(464): n is a, c, g, or t
  misc_feature (468)..(468): n is a, c, g, or t
  misc_feature (581)..(581): n is a, c, g, or t
gcacccggcgccaggcagcgggggcgggagggngccgcccggggcaggnggnganagaagagggccaggcaccacgggcggcncccgcccgggnggcgggnggcggctccgccgtgggcaggnggngaaggaagagaacggggggccgccggccggcaccctctccggaggcgggaggcgggaggcagtgaggcagcaacagcgcgagggcgaggcgactggggagcggccccangcagcgacctcgccttccgctgcgcctcctcccagaacccaagaagcctggaaccgggggcggccagcccgganaggaggagacggcaacccagccgcgctttggccggcacccccccgggaggcgggaggcgggaggcagggacgcagcaacagcgcgaggcgactttggagcggccgcagagagcgaccgcgccnnccgcggcggtnntcccagagcccaagaagcncggnacctgtggcatccatctctgaaaggagaagacggcaacccagccgaggcactactgggttggggtctccacgaccgagctggtctcatcaagtggcgtccaacaaggggctcncacccgggttgaggggttgctggagc

SEQ ID NO: 555491 - DNA, 525 bp, Homo sapiens
  misc_feature (318)..(318): n is a, c, g, or t
  misc_feature (386)..(386): n is a, c, g, or t
  misc_feature (427)..(427): n is a, c, g, or t
ggcgcacgctaccgattcggcgcggctcatggtccggttcgggctcgcgagtctccgtctggggtagggcaggttcttagactctgtgagtaaagacagcttcatcttcccagttcatcatggcttcaacatccagataacaacgaacttgatgcaagtgataggtttgccaaggtcagacctctcatcatccggatgaactagcaatttccagaagcatgcacccttggaagagttctacagctttggcgagtctatgtgtgagtactttgggcaccgggggtccaagcagctgcacagggggaagcctgtgcgacnttggctacaagatttcggtgtgggacaaccagcagaggctacttggtgtggtttgagccctcacaggntacactgtttaccaagccagacaggagcttggatctaggangcagtatggtaataaaatttgtggatgcgcttcaggagcgtggttttctgccatatcacatattttttgacaaggttttcacaagtgttaaactgatg

SEQ ID NO: 555492 - DNA, 242 bp, Homo sapiens
gacgattacagaccgagaatcagatataccgggagtagagcaacacaagcgtgtccacatctccactgaatccgtgattcgcagagtaaatcttgttatgtagaacattatgagctaactctaaaggttcaaccaacaaaacttacatattctcgagtatttctttaaagtctaaatagtttatctctgatcaaggatggagaaaggacaaaaaaaatactgtcctgaattgattctcacag

SEQ ID NO: 555493 - DNA, 105 bp, Homo sapiens
ttggagctagagcagtcgtacacacacgtacagtgttgcaggtgggtgatgttgcgatcgatagtcatggtggacgtctcgcagtactctgagatgtacttgtaa

SEQ ID NO: 555494 - DNA, 271 bp, Homo sapiens
tcgctgtgtatcctcgcgagcgtgtatctctcgcgaacgtgttatcctcgcgaacgtgttatctctcgtcgatcgtgttatccttcgcggacgtgtttccctcgcgaacatgttatccctcgcgaacgtgtgatccctcgggaacgtgttattcctctggaacgtgtagtcgctcgcggacgtgttgtctctcgctgaacgtgttatccctcgcgtccgtgttagtctcgtctggatcatgttatccctcgtgcccgtgttgtccctcgga

SEQ ID NO: 555495 - DNA, 374 bp, Homo sapiens
atcacactgaacatgaatataagtaaatcatttatttgggccaagcttggggattataacctgggagcaatgattcaagttgtctggaatgtaaactttagcagcagttacaagtagatttgtaaaggcaaaaaagaggggcagagagtggactggtacaaagttgtttgtcagccacttaggctgggcacggtggctcatgcctgtaatcctagaactctgggaggccaaggcagctggatcacctgaggacaggagtttgagaccagcctggccaacacagtaaaaccctgtttctactaatacaaaaacatattggacgtgttcaggcagatttcccgtttaacatctgcatgtttctcagggacctgaaa

SEQ ID NO: 555496 - DNA, 1036 bp, Homo sapiens
agcggaattcgggagttagcgggaagcactctgatcgaactacagagggtcaaggtcagtcaacatggtctcgagtgcgctgtgaccaggtccggtttccggtagccaggaccttcttcgaaacgtcggagatggcctaaactggctcacaggtgtttgcaccatcgagatgaaggcatggacctactgtcgacgcaagttattacccggggatgcctccgggatgtggcctgagtcggtgatcagggcttcgtgatcaactaaaatactacgggatgtttgatggattggtagacagtctttacggtgaactagaaggcatgtactcgagcgaaaattgatgacgcactgcgcagccagagattgtaagagatgacattacggtaccagacgtcaagtaagtgaacagtcggcaggttctctccctggtttgacacaatagacattgactgtacataacaggcattccgagttgaaaaatcgtatgttgcattgacccaagaccaaaggacatacctgaactgtacagatgtaaagatgactaacatctaatgtactttttataggcagtcattgaaatagtaaagacgcttgtaacttggggtcaaattgataaactagggaaacccgaaatatttggttagtctggatcgcaatgccttggtataatcatgtcgaaatgatggcgagactaggagagatcgagtgtgactgaattgttgcctgtattgctagtttggggcgacgtggtttacttatagtggagtgtctacctcgacttaaataccgcggggtagttagtggaaccgactctgactcgtttgtatttacagatacggaaaaacgtgtctggccgagaacattgccatgcccgctactttgcatttgcctgcaagaaatcctcttggtcgtggaccaaagtttattaaatgcccgagtattagggacttttaaaacgtaggccctttctttcaccggggctttgggtgaaagagcatgcattaatagggttcccagacaagttgactgcaccaga

SEQ ID NO: 555497 - DNA, 1019 bp, Homo sapiens
  misc_feature (296)..(296): n is a, c, g, or t
  misc_feature (649)..(649): n is a, c, g, or t
gactggagggtgatcttcgcctgggacgcgtttgctgggccttgagtctgcccaagtctctatcttcccacggggccccggtcgatgtcgggatcgatgttgcggacggaggctggcggcctgtctcctcacctgctctgctgcaggggacatcagacggaagatctatagtgtgaccgtgatcatcgtgttctttagtactcacttgataactcctctgtctcacggagtagcaggcttgaagggtccccgagggtggaccgtggaagcacgtcatcacgtggtcgaaaaccggnagagatagacactagacatgtactatgactttcatacgcagattccacataccgaccgagtctgatcgttcgtccaaagcaggaagctccatatatcctggccgacaggacagccgtgcattcctggcaagcagtcggaggagcctctaaaggcccgttctacatcttctgccttagtctcagttatgtgttgtcttacttagtcatttgtgttcttaattctaacactagccttgctcaatgctacgataaacctgtgaacgaaccacgctgtacccaccactagatctctggacagttcacacattaattctaacacaatgaacttaggcggtctgaactgagaggttccntatggaggtgcttggggacaatcgtcgacacatggattgcacaattacctacttgtaaacagctcctcactcaattgccgatgcttactcacgtacttgcgtcattgttccccggaaacggttgaacgatgtggtccgggcttaccagtggcccgcggcgtagcttcctctaccgatcaccagagctttgctcgcgccttcgtgctttgtacgcccctcctaataagcgtggttgcttgcgaatcccttacacccgacctggcgtcgttcaccggggcagagctcacttgcatcggtctatagaccccccttcccatcgttggcaccaccttgacaaccctgtaatttcgcttgttcaatcttgagccat

SEQ ID NO: 555498 - DNA, 1105 bp, Homo sapiens
cggacgcgtgggtttccggtccatgaagcagcagtatgagcagaagatcacagagcttcgccagaagctggtggacctgcagaaacaggtaactgagctggaggccgaacgggagcagaagcagcgtgactttgaccggaaactcctcctggccaaatcgaagatagagatggaagagaccgacaaggagcagctgacagcagaggccaaggaactgcgccagaaggtcaggtacctacaggatcagctgagcccgctcacaaggcaacgagaataccaggagaaggagatccagcggctcaataaggccctggaggaggccctcagcatccaggcctctccatcatctccgcctgcagcttttgggagtccagaaggcgttgggggccatctgaggaagcaggaactagtgacacagaatgagttgctgaaacagcaggtaaagatctttgaagaggacttccagagggaacggagtgaccgtgaacgcatgaatgaagagaaggaggagctgaagaagcaagtagagaagctgcaggcccaggtcaccctgactaatgcccagctcaaaactctcaaagaggaggagaaggccaaggaagccctcaaacagcagaagaggaaagcaaaggcttcgggagagcgctaccacatggaaccccaccctgagcacgtctgcggcgctattcctattgctaccaaccatggcagccatggtactcaccatgcttacaggactggtccaaccgtaaacctaacccttgcctgggaacacacgcaccacagcgacgaaaacccggagatgtcactggcggaaacacgaggggcccggggaggaatagaaaaagatcacagtgggagcgcgcaccacaaggaggcaagacaccagcacaggtcaacacagcgcaaaaggaaaagaacagaacggaggggggcaacaggagaaagacgagccaggagaagagaacaacacggacaacgaggagagacacaggagagcaagcgcgaagcgacagatggagcaacaagcacagcaacagagaagaagatgagagctcagaacacaacacaaggcaagaaatagaagaaggacgatgaaaacaaa

SEQ ID NO: 555499 - DNA, 459 bp, Homo sapiens
  misc_feature (135)..(135): n is a, c, g, or t
aaactttctaaaattaacctgcattacttttataatggattaaattaaaccacacaaaaaattagaattgattctactgactatttttaggatcatgggctggtacatatgacaaggaacaggcatggattaggntaagggttttttgggttgggggcagtgatggagaaaatcctccagctttttggtatctttaagggtgtggaccctttaatccaatactttctacagaacaattagcacacaatgaaaacttaataacatcaaatagatgacattgccaattcactcgacatttagtatgcacatactatgtgccaggcactaggaggaaataaccaactttgtattctagatcatttaaaaaaaaaatcaaaactacactttgtccctatcatcatatatgaaatgtagcacattgattccctcaattttccttccattgttttcagaaaggca

SEQ ID NO: 555500 - DNA, 210 bp, Homo sapiens
tattataggtctggcccctttttgtgaaaatatgcccagcggcaaggccaacaagcccagggaggattgttcgggtcatacaccaaaagcttctggccattaggatgacagcctacccatatgtcccccgaggaagggtcaatagataaattatccaccagcgtatccggctcaagttccttcaactgagttaaattcatattaatgtgt

SEQ ID NO: 555501 - DNA, 252 bp, Homo sapiens
taaaagctatggtgaggggggcaacaaaagagcagttctgagttcactcttgattgcccacctgtagagattgatcatggtgctgcgatttgagcagtttttcagaaaggtcaagtgaacggaaagctgggaaccttggtggaggggtggtgacatcgaaaggagcagagcagatcaccgtgacatccgaggtgctttctccaaaggtattgaaatatctcaccaaaaatatttgaagacggcagcgggggt

SEQ ID NO: 555502 - DNA, 259 bp, Homo sapiens
actggacattcccttctacatagtctatccctgtttctatgtctcattcttttaaaatcttaaatatggagcgcttttctatgatttaaatatgctttaaaataagtcactgttgacacggtcatgagtttccgagtatagtattctttttatcttatatttactcgtccgtggaaaagataatcaagggctacattttagctgaggatactgaactctttttcctcattcgggtgtgataatacataacccacaggca

SEQ ID NO: 555503 - DNA, 895 bp, Homo sapiens
caattgtttacttaaaggtataagtggtgttcttggaacctcttaattcgggatatcagagggctccccccattaaaacggggctgtgtcctttgcccctggtgtaccggttgtgaaaccccatttgtttggggggcaaagttccgccgcctactattgggggtaaaaccatttcatgacccccccccggtctcccgtgacagtcctgcctttcaggtaccgcaaacactgggtgccaccggcgtgttcgcactgaaatataattcccactgcgttaacgggattacagggtataacctttgatcgactagcgcacgagatatctatggaaaaaggctagtatggtacacacaggtttagctacctgtttgtaagaaaatctaagtgaagatacaactgggggccctctccttatgcgtaatcctcaaagaagtatttgggggccaacatacctcgctcactgctttagtaaaatagggttagtgacaaccaagtgtagcaccactggcggccccacgcacaaggagtccacattgtgagtaaaatggggggccacacatccctcctgggatttgggagctaaacaccagtcaaagacaacaaagggggcgtaactttctaaacaacgccctttttaattggtgcgggtattctgatatacacatggtatcagcatctgtttggactccctagagggtatttcatgtttctgtgataacaacgtaagtccgacaacgacacacacacaagggtataacatgctttttcgcacgcacgcaccgctccttcatcgcgttgtcgccttgattaggcctctcctacgccccttctggaaaaaccgcagcgtttgctgaggaccccctcaacccggtaaaaaaaatgcccccaacccaca

SEQ ID NO: 555504 - DNA, 365 bp, Homo sapiens
ttcccccttatgctaatattcagctcatcatagagggtctggtgaatcccgtgtactctctggggcttccataaatgattcaggtaacaaggtaccaaacgttggaacatagcctacctctgtttctcctgtgtttactgtatattatgcagtcgcagtacccgaagatgagaaatcttccacttccccaccagagagtctgctaattataggagaggtgtggatctgtttgttccctctacctcattttgagtgagacggtcccagtcatctattgtcagtcttatttcctcacacagtgacgggaccttgatgctgaggattgacgagctgcttccactctgggttcgcatttgtctcagtta

SEQ ID NO: 555505 - DNA, 137 bp, Homo sapiens
ggtttgggtaatctgaatcaagtgaacatgggacatcaacacatgtccttaattatacatctaatatcgatgtagactgtataccaaggccggggattcttaatttcagaaatgagctttgattctgcacatacaaa

SEQ ID NO: 555506 - DNA, 124 bp, Homo sapiens
taaggatccccgcgctgcggcttagtgaacgcatgcacatgacccccacggctagtgttgggagagaagaaacaggatctctttgatgttagctgtggatccgttcacttaatgccgctagcgc

SEQ ID NO: 555507 - DNA, 129 bp, Homo sapiens
ttcctggtcgggtcacagtgggcccacactatatctagtccttagggaggcaacggcaggtggatcacaaggtcagcagttcaagaccaccatggccaagatggtgaaaagccatctctactcaaaata

SEQ ID NO: 555508 - DNA, 316 bp, Homo sapiens
gttgaagaattctactttgtgggtatgagtgtcattctgtgctctaggcctttactgttcaggaggaaaacactgtataatttctgtgttctaatctgggagttggtgagaggaatgtcgtagggagtgagtgtggtggtcattaccaggaccaaaggcaaagcatgagtctggagctcttggagtttgaagccaggaatgaaagtccgagcatgatctttgatcaagtgagttgggcaagttaagataaaaagctaaaatgaaggagccaaaacaaacaaacaaataaacaaaagaaacaaaatcacagagcaag

SEQ ID NO: 555509 - DNA, 485 bp, Homo sapiens
taaactataaaattttaatttgacccataacataaagcaatacatcttccaaatgccttttataacctttattaaggagttggttaatgcttcaagaaaaccctgttaatctgacacaggggcccatatactggtcttgcatcagtgtgcctttgacagtaatgattatagagaaactgaacttattttatctcttaaaagcagcccttaaaatcccacattccaacctctttcacaacagtcacgggaccttgaagagttgaatggctttaattattggccctgtgtctcagggatgccgtttattttgattagcatcttctatggggcctggagataaggctttaattgctgtcagtgttaagatttagcaggacttgtccttttagacccaggagtcaaaaccctgtaacttaatgtcacaagtacattaggagtagatacagaaagatacatggaagtaataacataaaattaaaaaaaaa

SEQ ID NO: 555510 - DNA, 313 bp, Homo sapiens
  misc_feature (38)..(38): n is a, c, g, or t
tgtgctgaggagatctagaggatcccggtgggttcttncagagcgtggtcttgcagaggtccttcacgtcccttgtaagttggattcctaggtatttgattctctttgaagcaatgtgaatgggagttcactcatgatttggctctctgtttgtctgttattgatgtatatgaatgcttgtgatttttgcacattgattttgtatcctgagactttgctgaagttgcttattggcccaaggagattttgggctgagacaacggggttttctagatatacaatcatgtcatctgcaaggaacccacggggtacc

SEQ ID NO: 555511 - DNA, 308 bp, Homo sapiens
atctagaggatctccagtgtactccacaaacagagtctgtttgagtaagttagaagaatgcctctcttccctcaatgagtcacaatacatagcaagcattttaaagtcaggttaatagttgaaagatcttagatgcaaagagttttaaatcattagttcaagaactagtcagtgagtgattgaataaactttattaaaacatgcttagtgaattagtgaatattacaacacaatttttttcctattactttcttggagtttcaagaaagtttctagctgggcacggtggctcatgcctgtaatcccag

SEQ ID NO: 555512 - DNA, 286 bp, Homo sapiens
tcgtgtggtgagttaccagttcccactgacttccctgctctatcttggcccgattcatcacggagatacctcgctcgccgacgtgctcgtgttgcactggttaacgcggtcggctgcactcaagccactggtctggaagttgcccttaaccccgcacaggtaggccgtggctgtggctccactgtctgccacatgtttgtctacattgtactgtcttgtacagagccacactatgtgaatgcggtccatgagccaggggatatctcaatggctgcgttggcccaaa

SEQ ID NO: 555513 - DNA, 156 bp, Homo sapiens
agctaaatactttcagacatctttgtctttggctccatgttacaggatgcgtgtagacatcgatgtaattgaaattcccctttttgtcaataggtgcttctctgtacagtctcatcccacttcctctatcttgtaaacctgatccccgaaccaaat

SEQ ID NO: 555514 - DNA, 140 bp, Homo sapiens
cggcgagcgcccaagtgctcggattacatgcatagccactttgaccggctaatctcctctttatttcatcagtatgttttttacctccagacattgtaatttttgtttaggctagttttatattttccctgatctttaac

SEQ ID NO: 555515 - DNA, 500 bp, Homo sapiens
catgtgacccttgatatgtgcaaggaattgcgagattgtttctgtccagatattatgtacccagcacagtgagacactgagcaggtggtccttctgccataggcagcccagctgctggtccagaaccgtggagcccatggtgacctgtgctgagcacgtagttcatgctgacgtcccaaatcttggaagtttcgtccccataatcagagatcaaattggtgctgtcgggactccaactaattgtgtaaatcccagcgtcgtgggccttgcttccgaccagcgcgcacaccttctccccagtcttcccgtcatagatgtatctgtggccgtcagcactggctgtggcaaatctgttcccatcaggagagaatcgcacacagttgacaaagcggctgtggtcgccaactgtgaacttgaacttgaatgggggtccctcaaagaatgccgcgcagttatcaatcgcttcccgtggccagccggtatggccggctctgcttgat

SEQ ID NO: 555516 - DNA, 436 bp, Homo sapiens
ggggcgtgctgcgtcgggctgcacggacgacagactggcggtctccacacggacgttacacgttcctcgtaacttttccgcttgtcggacacgaacttgaacgaccggaccaaaacacggacgctagcgcgaccgggctacaggtctacgctggtggccttgaaccgctgactgacacgactactgaccacttaccaacggtcggaccacggccactgactcactgcggcgccagccaacgggcagccaagcttactgacaacaccacggacactacttcgtaggcgcttgaaacaggtacgacactcgctggacccttagaagtacccgcagacaacgcctccttcgcgctcaggctctacgctttgtggtaaaccacacacaattttcacttaattgcacacgggcacataaactttaaattcccaagtgggcg

SEQ ID NO: 555517 - DNA, 516 bp, Homo sapiens
  misc_feature (9)..(9): n is a, c, g, or t
  misc_feature (26)..(26): n is a, c, g, or t
  misc_feature (53)..(53): n is a, c, g, or t
  misc_feature (67)..(67): n is a, c, g, or t
  misc_feature (126)..(126): n is a, c, g, or t
  misc_feature (236)..(236): n is a, c, g, or t
  misc_feature (307)..(307): n is a, c, g, or t
  misc_feature (319)..(319): n is a, c, g, or t
  misc_feature (348)..(348): n is a, c, g, or t
  misc_feature (484)..(484): n is a, c, g, or t
tcttgtggnaattgggcttcttgggncaacggccgtttttaacagcccatganctatcgaaatgggncagggcgaacttggggaattggcaagccggccgaattttccgcgggaagttatgttgcncagttgccgcaatccgtttcaggacggtgcaattgaagcaaggagccgccgtttccagtccgttctattcgaaggattcgtacgttgcaggttgcgcaacgacgccccgncgtgacgccgaatagttgtttcatggtccgggaaaaattgccgaatcggcgaacccggcccatgggcagcntcggtcagggtntgccccgagcgccagtcccagcgccactncaagcgccgccacaacaccaggcgacgtaccggcaaacccagttggttggcgaacaaacgttccagctggcttaacgaaacgtgcgccgcctgtgccagggcttgggccgagaccttgccactcagttgctgatcncagccgacagcgcgcgctccaccctggcatct

SEQ ID NO: 555518 - DNA, 424 bp, Homo sapiens
  misc_feature (43)..(43): n is a, c, g, or t
  misc_feature (85)..(85): n is a, c, g, or t
  misc_feature (302)..(302): n is a, c, g, or t
  misc_feature (320)..(320): n is a, c, g, or t
  misc_feature (344)..(344): n is a, c, g, or t
  misc_feature (411)..(411): n is a, c, g, or t
  misc_feature (422)..(422): n is a, c, g, or t
accagtatgtaagtaccaaggaatcgtggatggcagattactntaaagatgacaaggacatagagtcagctaaatcagaagactngatgggctcttcggtggatcctccatgttttggacaaacagaggtgaaaacccccaagcgccggcagccctttgtcccctttgctctgaggaaccacacggggtgcactttgtggtttgccaccctgaccaccacacccaccagagctgcactctctcacagtgggagtccagggggtagttccagaagggaacgggaacattttcttcgatgatantcacaatgttagtgaatnggcgaggaagtcctttacaggtgnaaggagatttcccttttgattttgaagcaagagggaaagtttaagacacaggacacacccttggacntccgggtttcntc

SEQ ID NO: 555519 - DNA, 464 bp, Homo sapiens
ttttgtttttgagaaggagtctcactgtagttgccccgtggtggaatgcagcggtgcaatcctggcccactgcaacctctgcctcctgggttcaagtgattctcaggcctcagcctcctgggtagctgggactacacgtgagcaccaacacgcccagctaattttatatttttagtagagatgaggtttcagcatgttggccaggctggtcttgaactcctgaccttagatgattcgctcgcctcagcctcccagagtactgggattacaggcatgagccaccacacctagcctacatgtattttctcatcctcttattttttaccccgttctctagtcatatatatttcctatataatacattatggtaataatactgctggattggggagttagacgttgtgctatgcttacagaggtaatcattgaactgtaataaaataaaggcagtattggagaaaaat

SEQ ID NO: 555520 - DNA, 1360 bp, Homo sapiens
gttctagatcgcgagcggccgtcctttattttttatatttattttttttaaagcccccaataatacctttaattatcatgtccggctcaaaggcaggaaggagtgtggaacggaagtggaagggctagcgggaggcacggaaggggggccaggggcaaggtggcaggagggcgaagtggggggcacgcggggggccaccggggcagggcgccgcagaccgtgtctccgtgggcgcccggagttgtgggggcacaaaatgtagaccctgtgcccaccctgtgtctcccgcccacgggacaggccgccccgacatctcctctcaacaaacagcgcgcacatgtggacaggccttatcgggcctccgatctctcgcgtggaacgagtggcggtgtgcacaggggccacaagtgtggttattgacaggcgtctcgcgcccgcgtgtggggcccccgggaagaactcctgtgtcccccgaaagggacccccaaagccccaaagggaagcgggccctcaaccactctcacctcacagtgtgtgggtgttttcaacaaccgtgccccaaacccaaccagggggagaggcgcagggcgagggtaccaagggggggctccccacaattccccaggggaacggcaacaatataggcaaagccccctttaaccaccccctagtggaacaggaggcgacgagaaagacggggggagatccctaccctcccgcccgcgggaatcccaaacgcatccagaaggagatgggcggcacaaccacgggagcgcggtatgaaaatcggcgcaaaaacagggaaggggaccaggggccgagaaaagcgagcacaacggtgcggcggcctcccggaccaaagcgccaggaccgcagccataggggcacgggcgcccccaaggagacgcaacgcgggcacgcgcttcccccaaaacactcccacagccaccaccatcacccccccagacgaatagcgaggccacctcacgagagacagaaccactaagcgcagaaccacatggcccacgaggtgcgcccaccacaacggccgcgacccctaaaaacacccggagagaaaagagcaacgaaaaagggggcagtaccccacacaacaacagaagtctagaacgtcccgtaatcacaaccccacacttgatacaacagataaagggcaaagtaaattaagctagaaacatacaaaagcaccaaacaagactaccacaaagaaaacaaacaaacaggcccacacaacgccacccataccatagagacaccgaacacatcacactacactcccctaacagaaacactgaacaacaccacacccatcaaaataccaacaacattagtcacaacatat

SEQ ID NO: 555521 - DNA, 237 bp, Homo sapiens
agaccggggtctgcagaggctcacatgctgtagtcgatctaggtattatctcttgaagcaatgtgaatggagtcactcatgatggtctctgttgtccgttatgggtataagaatgctgtgattttgcacatgatttgtatcctgagatttgctgaagttgttatcagttaaggagattttggtagcgacgatggggttttctagatttacaatcatgtcatctgcaaggaacccacg

SEQ ID NO: 555522 - DNA, 309 bp, Homo sapiens
tccccgattttccccagtctcttaaacagaaaaatgactgatataattatctttgggaaactgacccttaatttttttaaaaagggggaatattaatgtttcccccaaactcaccacagctataacgcaatgtgtttggacacgcaattatacatgcgccgtttgtaacacttttttttgagagttattggtcatctggtcctgggtaccctatgtcccacgatagtgtgaaacacctgctcttatacgaatattatcaatataatatctcttattattctcttaacacaaaacaaaaaaaagaggcgc

SEQ ID NO: 555523 - DNA, 89 bp, Homo sapiens
accgtatacattatttaaatgtatttaactgttaaatgcgcgtacccaccaaataagtgacaactaggacctttagtgaaacactgtga

SEQ ID NO: 555524 - DNA, 107 bp, Homo sapiens
atcgtagtagtcccattattctcatgtctcggactaccaccaggcactccttcattcaggatctcacatccttcttagggctcccactcctttatagcctgcttcta

SEQ ID NO: 555525 - DNA, 878 bp, Homo sapiens
cggaagtgtcgtatgtcggtgcctcgagggttctctttctcccctggctggtccggctctcgagtggtggcgtgacgaggggcgagtggtgtggcggcgcttgtgctcctcggttgggagggaaccaggccgcgaacccaggccgggaggggggttcggcctgggggggaaagggactgtacatgatcatctcgtaagagcccttttatgtatctaccgagggtgatgtgacaacgacgggagagggcgaagggtgctctgtacccaagccaggcagttgcccgtgcgttgtccaggtccgctagacgtgcccggtgggtctgggcaaggccgtcggggtgcagaagtgggaggcgcacgcaaggggtaatataggggtaactccggtggagatacccacattgcagttgtggagtttagcaagtcagggaggggcagaagtgcaaggcagtgagatgtgacctgtctggcccatattgcgatgctcaggcgtgtccttggcccgcagtggaggttgcagaaatggcgggtggaaaccatctgcgatcgcagaagagtggttggttacactagccgcttgggttgcaaagctccttgcaaggaacattgctgcgggatggtgcgggacggcggaggagtctaggaactaggagctaaccaattagagctgtggatatggcctgaagatgctatcaaggtggggatcgtccgcggtaccgtgtgaaagagaactcagtcggtaatagggggaacgccaaatcctaggctatgttcaaaagacttccaagcgggggcacctgcgaggataagaaacggtgtccgaggagcggattggaaagggcgtccaggaaatgaaagggaccgatatggtcagacca

SEQ ID NO: 555526 - DNA, 776 bp, Homo sapiens
gctgagtcgttggggcgcagctcgctcagcgccaggatgacgtcggtgaagcgacgctgggtacgcaggcagtgccacgcggaaccggtacggcctcgttcaccttgacgctgcactccccgcgcctagccagcacctctgcctcccggcccctgggacaggaaagtcctacttgacccgcggagagccctagctacagccctggcggctcgtgcggtgtgccgcaggtagtggacgtggcaagggatggtgagggcgcctgacgagcacgccctgcagttggcgctgtccgccctgctgatgccgcactgctgataatatgctgcggtcctctgtcgaacgggttggagccggctggtaacttgaacggctgtcgaccctcagagtcccacccaggtggctctccgaagccgcccgctccagcgatccctccattccctgtgccccagggagttccccggtgccgccccgcgtaggacgcagcggagccacggcgcccagcggggcccagcggtgtccgtggccgtgccgtacctatctctcgttcccactcccactgcggaaccataagacacaccacacaccagcgagaaatcagaacacactctctacaatactccacaatatccccactaaaaagatgttcctacccacagtgacagaaactctcaaggaacaaccacaagcgggacctcctcatatagtacctgtggctatccctcgaacaatggttcatatccaacgtatccattcttccaaacaacatttcccctatg

SEQ ID NO: 555527 - DNA, 402 bp, Homo sapiens
  misc_feature (41)..(41): n is a, c, g, or t
  misc_feature (48)..(48): n is a, c, g, or t
  misc_feature (61)..(61): n is a, c, g, or t
  misc_feature (74)..(74): n is a, c, g, or t
  misc_feature (86)..(86): n is a, c, g, or t
  misc_feature (115)..(115): n is a, c, g, or t
  misc_feature (133)..(133): n is a, c, g, or t
  misc_feature (140)..(140): n is a, c, g, or t
  misc_feature (142)..(144): n is a, c, g, or t
  misc_feature (148)..(149): n is a, c, g, or t
  misc_feature (151)..(151): n is a, c, g, or t
  misc_feature (153)..(153): n is a, c, g, or t
  misc_feature (157)..(157): n is a, c, g, or t
  misc_feature (166)..(166): n is a, c, g, or t
  misc_feature (169)..(169): n is a, c, g, or t
  misc_feature (174)..(174): n is a, c, g, or t
  misc_feature (183)..(183): n is a, c, g, or t
  misc_feature (192)..(193): n is a, c, g, or t
  misc_feature (197)..(197): n is a, c, g, or t
  misc_feature (199)..(199): n is a, c, g, or t
  misc_feature (206)..(206): n is a, c, g, or t
  misc_feature (229)..(229): n is a, c, g, or t
  misc_feature (237)..(238): n is a, c, g, or t
  misc_feature (241)..(241): n is a, c, g, or t
  misc_feature (243)..(243): n is a, c, g, or t
  misc_feature (252)..(252): n is a, c, g, or t
  misc_feature (254)..(254): n is a, c, g, or t
  misc_feature (270)..(270): n is a, c, g, or t
  misc_feature (276)..(276): n is a, c, g, or t
  misc_feature (279)..(279): n is a, c, g, or t
  misc_feature (299)..(299): n is a, c, g, or t
  misc_feature (312)..(312): n is a, c, g, or t
  misc_feature (335)..(335): n is a, c, g, or t
  misc_feature (337)..(337): n is a, c, g, or t
  misc_feature (362)..(362): n is a, c, g, or t
  misc_feature (381)..(381): n is a, c, g, or t
  misc_feature (386)..(386): n is a, c, g, or t
  misc_feature (389)..(389): n is a, c, g, or t
tgcactgatggtgccaaagggccctgagtcaaaaggaaagncaagggnggagtggaaaaanaaatggtgaaggnagaactgctcanaccagacaccaaaagcacgtcctcaaganttcactagcacgcagctnattccanannnggcnntnanagancctaaaaanagnagacnagcacaaanactggaaanngcangnaaagtgnaggaaactgccagcacaaggaanaaaagaanngtnanagacacccnanagagggtaagtttcanaattgnaanttgagagctccttcaattanattgactttcttnggttttccttgtgcattaggtananattttttgaagtatttttgccaacnaaaatgaagtctgtaaatnctgtnaanaaacaaggagttc

SEQ ID NO: 555528 - DNA, 115 bp, Homo sapiens
taatatataacagtaagtatagtccactgatgctttaaatacagaatggtatttttgagcagagtagagatgaacttctatgacagtggaacttaactcattcacaggagaaatg

SEQ ID NO: 555529 - DNA, 636 bp, Homo sapiens
  misc_feature (497)..(497): n is a, c, g, or t
  misc_feature (549)..(550): n is a, c, g, or t
  misc_feature (555)..(557): n is a, c, g, or t
  misc_feature (582)..(582): n is a, c, g, or t
  misc_feature (588)..(588): n is a, c, g, or t
  misc_feature (595)..(595): n is a, c, g, or t
ggatctaatggttttaatttctaaaagttatttcttatgcttaagataatcccatttcatgaaaatttgatcttatttcataaatgtcatgtctattctcaactctacagaggttcttataggctttattgacatcatctgttgttacctacattttcataatttcctctaagttcatggttttgtttgtataggactctgtttatgataaggtactactcaaactaaatttgagttttggatataaatttatatgtatacacagggctttacaaagtatgataagctctatggataaagaagacagagcctatataatacaacaggcatgtttctgataaagaggcaggtattaggagtatgcctaataccagtgtgatagatgcttttctggtaatatcttagagctattgacattgttcactgaagatatgtgggggttagtggtacaatggcttcttctgttgactttcctctctatacatctactggtccanacattttcatttcatctacaaatagtgacatctcatctagtgtcagtgctannatgcnnntatgggtacttacaggatagtaaancatgcnatttcancagcatgtaaccagagatccttatatatcttagagaagaaa

SEQ ID NO: 555530 - DNA, 935 bp, Homo sapiens
ggaagccagaaatacgcagatcgacaaacaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggcaatcgcatgcaatcttgcatcaagatggcggcaatcaacatcaagccttgtcggcaagccatggagccagcaacagctattcagtcttgctcacaggctggtgtggtcttgtcagccttcctgcaagcaacttccattcattgcctgctgcacaatcccagttggaggcacattcacaatacaagccaacaaccagtttctcgagcaatttaacaaatggggagtgcactactatccagatttgattaggtcttcatcctgttagatactccaaatgagcatcatgatcacttactctctgaacatgtgattgcacataagagctggcaccgcagagaaccattagcagtgccacagtagctcgtatgcatagtcaagattcacatacttccgtacttgaagtcgtgtctgcgaagccatcatccgaaagactacaggtggttcctgggagaaaccataagatcgcattcccaacaaactatggccaacgtacatggctatggtacggcacctgtgtaccccaaggtctcccaagaacaggagaagtcatgcacgacgaacccctgagtcccggaaccagagcacgaggcaacaacatcacacaccatacaggagaggacccggaagcgtgagaacaccagcaagcggaatccaagcaacccaaaacggggaaca

SEQ ID NO: 555531 - DNA, 921 bp, Homo sapiens
  misc_feature (8)..(8): n is a, c, g, or t
agcctgcncgaagcgctgttagtaagactgtaaggagaaaccctggagcacctcggtggacagtggggtaaaaaaggcgtgccaaacgggggtgggagagcgcgccacggggataaaaaaggtgggggaaaaaaaggcgacccgcggggttgccaaaacccgctgggggaaaaaaaaaggccgggcaagagcaaccccccacaagggccccggggttcggggaacagagggtagaacggttcggatcacagagccctctatacttgggccacccaccagggggcacagaagggggccccctcaaaccgggattgcctcaaaggagggtgtttgcccccccgccaaggtggtcagaaaagataacgtgtttggccccacgcccccggtcgttgtctttggggacccctcagggacgattaaggtgcctatgcgtatatagaagatgctcggtgttactttttttagaaggcacatactcgtgcagcaactcaccccgcgggcctgttttcatgggaaagcggcctccacccctgcaccgcggatccattagacccgccttatgttctaaaagctcgaaaatagctatttatgttcacaagaaatatgtgccactgtttttatattcagaccacaataacgctgcctctaatcaataccgcacgtaacaacaccacgcaggctgtgttaattcagcaatctctttgctgaaaacgctgccccccttatgtgcgactatgtgaatttttcacaaatcaccacaatcccccctcaacactggatacgccgatattgaattctttctaacaactcgttcttttctacaaaaccccagaaatattatctctttaaacattctgtcaaacgagtttggaccaccaagcaccaattcaagattttgaaacctcctgtcccaacaaaaca

SEQ ID NO: 555532 - DNA, 474 bp, Homo sapiens
  misc_feature (36)..(36): n is a, c, g, or t
  misc_feature (66)..(66): n is a, c, g, or t
  misc_feature (76)..(77): n is a, c, g, or t
  misc_feature (80)..(81): n is a, c, g, or t
  misc_feature (84)..(85): n is a, c, g, or t
  misc_feature (89)..(89): n is a, c, g, or t
  misc_feature (101)..(101): n is a, c, g, or t
  misc_feature (131)..(132): n is a, c, g, or t
  misc_feature (172)..(172): n is a, c, g, or t
  misc_feature (183)..(183): n is a, c, g, or t
  misc_feature (189)..(189): n is a, c, g, or t
  misc_feature (194)..(194): n is a, c, g, or t
  misc_feature (198)..(198): n is a, c, g, or t
  misc_feature (211)..(212): n is a, c, g, or t
  misc_feature (226)..(226): n is a, c, g, or t
  misc_feature (231)..(231): n is a, c, g, or t
  misc_feature (234)..(234): n is a, c, g, or t
  misc_feature (257)..(257): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (289)..(289): n is a, c, g, or t
  misc_feature (292)..(292): n is a, c, g, or t
  misc_feature (295)..(295): n is a, c, g, or t
  misc_feature (303)..(304): n is a, c, g, or t
  misc_feature (309)..(309): n is a, c, g, or t
  misc_feature (337)..(337): n is a, c, g, or t
  misc_feature (342)..(342): n is a, c, g, or t
  misc_feature (386)..(386): n is a, c, g, or t
  misc_feature (400)..(400): n is a, c, g, or t
  misc_feature (474)..(474): n is a, c, g, or t
aaaacaacacatatttcatgttagttttaataaganattccctatcctctgccccagtaaaacctnaaccgaagcnnagnntgnncggnttatatcaatanaagtgtgtagtggtgtagttgtgtgtagtnnaagtgtgttggttgtttagactagggggtggggttacagngtcgggggggncgtggntgggngtcnggtgtacttggtnngttctcttgccccntcacntcnttggtgagtagctaatttcagcngctggcttcatanggnggngtcaggggngggnggnggntcctcccnnttccngttccacttcctcttctccttctgtctnctggncacttaggtcttactgagatggttttcccacagtaaaggggggngggggcagagtacnaagggtcaggggtgtgactccttcccatgactcaggcctctgtgctagtggtgacccttatagggagggggggn

SEQ ID NO: 555533 - DNA, 488 bp, Homo sapiens
  misc_feature (38)..(38): n is a, c, g, or t
  misc_feature (377)..(377): n is a, c, g, or t
gtgatctgaggtcccctcacgcttatacttctttcctnttttaggttcctgaaagtggtttcagacaccccaccacagatccaggaagttaagagaacaccaagcaggataaatccccaaaaaaagaaagaagaaaaagagaagaaatgaagagaagaaaaaaaaaaaaagaatgaaggaaaatgaagagaatctgagggacttcggggatagcatcaaatagaagaaaacatgctttatgggaacctcagagggagaagaaagaagggggtagaggacctatgtgaagaaataagggtgggaaacttcccaaatctgagagaatgggctatacaaattcaagattctcagataattccaaccagaataaatctaangggatctaggggatctacactgagacatataatcatattataatgaaacggtctagtgacagagatctggaaagcagcaaaaaaaaaaaaggcaccccggtatttacaagg

SEQ ID NO: 555534 - DNA, 377 bp, Homo sapiens
ttgagcgtacaacgtcggcctgtgtagcgctattcgttttctaagctatcccatgggaataagcctgcgacgatccagacacggatacagggaatatttaatattttgggatagagcgcctattggagaatgttgtgtgttgcaagtcagcagtgctttttctgatacttaaccccagaatgatataggtctatgcccatctggtctctagcagtgctggaccagtgcagctttcctgatgtgggggcctgcctctttaaaacttgagtatgaaagagcagctcagaaatgtgtgtgctttcatagagtgaatttgttcccaaagagccacagttttttatttagtcattttttcgtcaaatgttcatcaacaacaa

SEQ ID NO: 555535 - DNA, 382 bp, Homo sapiens
ccgcatcgtcctggactcgcatttcacagttgactcatggaactgtttattgcatggagttacaacaggattctgaccagtaagttctccttttagtgtacagatcctttaacgttaattgaagatgcttcagattcgacaccaacaaggtgctaacccctttgatctggccatttgctcgattttcacaatacattttatctcccaaatatcatttactcccaaagaatgaactgcttcagttaagtcttcatctgtggtccacgcatgttagatttccaatatataatgcaattctctttccattatatgtctagacaacatttggtgctgctcctttacccattttatcaccaacagttggtgggagagtatccatatt

SEQ ID NO: 555536 - DNA, 159 bp, Homo sapiens
aagcgcgacttctgagtctgttcacagcgaggatttggagtctccaggtctcatcagggagtgattgtcagcggacgctctgccctgtctggcttcaggtccaggaaagctttgaagcagtcaagccttgtactatgtaccccaatgtgtccatgtctt

SEQ ID NO: 555537 - DNA, 119 bp, Homo sapiens
gtacctgacgacgaggagtgaagaacctttacgcctcggcagccctaccggcagtggatcgagaacgtgcgcatcaagctcgactcgattcccgcgcaggcccaaggccccggccagtt

SEQ ID NO: 555538 - DNA, 511 bp, Homo sapiens
  misc_feature (449)..(449): n is a, c, g, or t
tggcgtggttaggataccaggagctgatgaatgtcaagtggccctggaggtggagatcgccacttaccgcaagctgctggagggctgaggaatgcagattcagtggagaaggagttggaccatgtcaactatctctgtgtgtcacaatgcagtgtttcctcgtggatatggcaggtggcatgtggctaatggcgtgtggcctcggttggaggtcttggccggcggcctcgggtggaggtcttgccgggagttagccagtggaagctactactccagcagcagtgggggtgtcggcctaggtggtgggctcagggtggggggctctggcttcagtgcaagcagtgtccgagggctgggggtgggctttggcagtggcgggggtagcagctccagcgtcaaatttgtctccaccatctcctcctcccggaagagcttcaagagctaagaanctgctgcaagtcactgccttccaagtgcagcaacccaggccatggagatggctcttctaggg

SEQ ID NO: 555539 - DNA, 240 bp, Homo sapiens
  misc_feature (79)..(79): n is a, c, g, or t
  misc_feature (124)..(124): n is a, c, g, or t
gggctggtaattttgtatttcagtagagacaggtttcacaatggtctcgatctcctgacttcgtgatccacctgctcgngctcccaaagtgctgggattacaggcatgagccactgtgccgtgncaagaattagttatttttgtattgatccatcatggtcactgaagagcatcatctcacatagcaggtgtatgacatgtgcctgttcaggggcacaagactcgggcttctggcgaggg

SEQ ID NO: 555540 - DNA, 1434 bp, Homo sapiens
  misc_feature (116)..(116): n is a, c, g, or t
  misc_feature (129)..(129): n is a, c, g, or t
  misc_feature (132)..(132): n is a, c, g, or t
  misc_feature (281)..(281): n is a, c, g, or t
  misc_feature (284)..(284): n is a, c, g, or t
  misc_feature (298)..(298): n is a, c, g, or t
  misc_feature (300)..(300): n is a, c, g, or t
  misc_feature (312)..(312): n is a, c, g, or t
  misc_feature (318)..(318): n is a, c, g, or t
  misc_feature (320)..(320): n is a, c, g, or t
  misc_feature (331)..(331): n is a, c, g, or t
  misc_feature (334)..(334): n is a, c, g, or t
  misc_feature (339)..(339): n is a, c, g, or t
  misc_feature (360)..(360): n is a, c, g, or t
  misc_feature (579)..(579): n is a, c, g, or t
  misc_feature (697)..(697): n is a, c, g, or t
  misc_feature (867)..(867): n is a, c, g, or t
  misc_feature (919)..(919): n is a, c, g, or t
  misc_feature (942)..(942): n is a, c, g, or t
  misc_feature (1039)..(1039): n is a, c, g, or t
caagatatggccccagcctactttatcctgggaggcaaccagtctggggaaggtgtgtgattacacgagacagaaaggaatcatggatgtatatgaactcgatgctaagcagggtngatggtatgtggnacnaacaaattatgaccgttggaaacatcccttcttccttgatgatcgcagaacgcctgcaaagatgtgtctgaaccgaccagccaagagaatatctcatttgaaaccatgtatgatgtcctgtcaacaaaacctgtcctcaacaagctgancgnatacacaaccttgntngatgttaccaanggtcantncgaaacttacntgngggantgccctgacccttgtataggntggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatctttttttttttccccctatcagtggattttcttatttacagataacttcttnaggggaagtaaaacagtcatctagaattcactgagtttggtttcacttggacattgggggatctgggtgggcagtcgaaccatggtgaactccacctccggtgaataaatgggagatncagcgtgggtgtggaatccagcacgtctgtgtgagtaacgggacagtaaacactccacattcttcagtttttcacttctacctacatattggtatgtttcctggtataacagccttttccttcgggttctaactggcggttaaaattaatatatcattatcttggcggtnattggacagcgatataattttattacatatgattagagggatgagacagacnttcacctgtatatttcttttaangggcacaaaatggggccctgtgcctctaaatagcactttgggggttcaagaagtaatcagtatgcaaagcaatcttttatacaataatggaagtgtnccctttttcataattactctacttcccagtaaccctaaggaagttgctaccttaaaaaatgcttcccacgttctgttaatttagtaaataaacaagtcaaagacttgtggaaaataggaagtgaacccatattttaaattctcataagtgcttctgtataacaggtttagttgtctcaacgatagggtttaagcattcgggttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaagagaa

SEQ ID NO: 555541 - DNA, 187 bp, Homo sapiens
ggggggggcccccccgggggggggggggggcccccccccccccccccccccccccctttttgtggggggggggggggggggggggggcttttttttccccccccccctccttgggggggggggtttccggggggttttttttcccccgggggggcttttttttttttggggggttttttttttttta

SEQ ID NO: 555542 - DNA, 752 bp, Homo sapiens
  misc_feature (116)..(116): n is a, c, g, or t
  misc_feature (129)..(129): n is a, c, g, or t
  misc_feature (132)..(132): n is a, c, g, or t
  misc_feature (281)..(281): n is a, c, g, or t
  misc_feature (284)..(284): n is a, c, g, or t
  misc_feature (298)..(298): n is a, c, g, or t
  misc_feature (300)..(300): n is a, c, g, or t
  misc_feature (312)..(312): n is a, c, g, or t
  misc_feature (318)..(318): n is a, c, g, or t
  misc_feature (320)..(320): n is a, c, g, or t
  misc_feature (331)..(331): n is a, c, g, or t
  misc_feature (334)..(334): n is a, c, g, or t
  misc_feature (339)..(339): n is a, c, g, or t
  misc_feature (360)..(360): n is a, c, g, or t
  misc_feature (579)..(579): n is a, c, g, or t
caagatatggccccagcctactttatcctgggaggcaaccagtctggggaaggtgtgtgattacacgagacagaaaggaatcatggatgtatatgaactcgatgctaagcagggtngatggtatgtggnacnaacaaattatgaccgttggaaacatcccttcttccttgatgatcgcagaacgcctgcaaagatgtgtctgaaccgaccagccaagagaatatctcatttgaaaccatgtatgatgtcctgtcaacaaaacctgtcctcaacaagctgancgnatacacaaccttgntngatgttaccaanggtcantncgaaacttacntgngggantgccctgacccttgtataggntggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatctttttttttttccccctatcagtggattttcttatttacagataacttcttnaggggaagtaaaacagtcatctagaattcactgagtttggtttcacttggacattgggggatctgggtgggcagtcgaaccatggtgaactccacccttctggggaaataatggagttttaacccgtggtgttaaatccttccagtttggttaaagatacggggcaaagaaaa

SEQ ID NO: 555543 - DNA, 368 bp, Homo sapiens
tagatcctacgcccataatccagtttcactactcattattcatcgcgcgttaatctaactttcttcccacaacactttctcggcctattccggaatgccccgatgttactcgtactacctcaatacatacaccacatgaaacatcctatcatctgtaggctcattcatttctcttacagcagtaatattaataattttcacttatttgagaagccttcgcttctatacgataagctccttaatattatattggtaggatgaggtcatgcatgatctgtttcatgttttttttgattgcccgcccctccttcaaggcatccatattgttgtagaatttgtcttccgcctagaccatctcagaggctgtt

SEQ ID NO: 555544 - DNA, 324 bp, Homo sapiens
cctcgctggaaaaaagagtagcgtgtgaccttaggaatcaatggggctggactgaatccccgagaattagtacctacagacccagttcctgatgaattcccgtgaaaagcatagctataagaaattgaaacaatgataaatggccccttgagagaatcatacagtattatgggcctgctacttaggcacaagatggctcgtggggataccggatccccattatatgatcaaccgatcatacggtacaagctgtcttaaaaataatcactgcaccgcaggccttgactatctggccgcagaactcagtggaatgctatcttcaaa

SEQ ID NO: 555545 - DNA, 925 bp, Homo sapiens
gaatactgctgtaggaaaaaaaaaaaaaaaaaaaaaaaaaaaaaaaaaaacctaaatttaaatttttttccccccccaaaatttttttttgggccttttttgggcctttttaaaaggttggggttaaagaatcttcttaaagggtttaaatctaaggagactggtatccatctatatgatgggggaaatattctgttggagaagaaatatccttcttcaaacgggcctatgggggtaatgttttcttctctctggtgaagaagaatcgatccttgatgaatacaattccgggtccacaatggtgggttttatttgtcacccattgttggtctgcaaagaataggggcagaacgcgggttttgaaaatctccttggaaatagtaacgtgctcctcaaaacctattgcggtggtgtgtatggacgcactccttttttctcttaaccatatgggggtgtgcgtccacacactctgtggtggggagcgggggtggaaaaatctctctcgaaaaatgggtgtggggaggaagtgcgtccctccttttactacccacagagggctatatcccagaaaattgttaaaaccagctatttttcgcctctattccaagaaaagttgggcattcccccctcttttagatgtcgtttgaaaattttttttaccccgctttgtgggggagaattattctagatatacagtgtgatacagtaagctgggagaaaaatatttttccacccattctttttaaaaggaattatcttcacaacatatttactaccgcggggcaattttcttataggttcaggacaagctgtttttactccacaacttgtttttgggggctgttataaattgttatatataaataggcggggcttataaaacaacgagttgttattagaatcgctgctttttagaagaatttgg

SEQ ID NO: 555546 - DNA, 395 bp, Homo sapiens
gacgacggttatagataagcttgattccctataccccacagtgagaagcggtaagctaaaggagacagacggcgtagcctttaaaaacaattcaactatcattttaattgttgctatagtaaagttcacaattaaaataccctggaagttcaaatatggaaatgagcagttatggggtcatagggctacaacaatataaatggcagatatcagtgcaggggtaaagggtagtaggctactaggcgggcatgactagacctaagattttgaatagccagtatgtaccaagactacaatgacacctatgggtaacgtaggtttcatagacagtacctacagcttctatcatacatgtatgaaatgagtagctaaacacctaccaatagagactatta

SEQ ID NO: 555547 - DNA, 235 bp, Homo sapiens
ctgtaaaagtgggagctggatggaatgtgtctgtagaggagtgagcttgggtggaatgtgtctgtagaggaggagctggatggaatgtgtctagcagaggaggcgctggatggaatgtgtttgtaaaggatgagactggatggaaaactgtctgtagaggaggagctggatgaagtgtgtctgtagagaaggagctggataaaatctgtctgtagaggaggagctggatggaatg

SEQ ID NO: 555548 - DNA, 272 bp, Homo sapiens
aaagacaaataatgcgtagaggcagcaaagcagatctggtgagtgacataggagatactgtagaggacccctacacatcattagtgaagttgctacctctgaatgatcgccgatatgcttcgtacgatgccacatacgaaacaaaagagtctaagcaacagcaagacctcagtatttcatattctgggctcctgcaaagtgcaccctttacacaaagcaagcatgcatttatcgctcagcgtctcaaagcatgcccaattaaacaagcacaa

SEQ ID NO: 555549 - DNA, 358 bp, Homo sapiens
ataaaattttggtctccccaacctcttacttcaacccagatatttcctttttattgatcccaggtctttagataaacttaaccaattgtcaaccaaaaaatttttaaatctgcctataaactggaagctccgcactccgctcccctcccctccccgcccttcgaggttgtcctgcctttttggacaaaaccaatgtattttttaaatggacttgaagtttcatgtctccctaaaatgtataaaacccagctgctccctgacccccttgggtacatgttttcagggtctcctgagggctgtgtcatgggttatagtccctcaaatttggcttaaaataaatctctccaaatattttcca

SEQ ID NO: 555550 - DNA, 542 bp, Homo sapiens
ggtctagaggactccccagcgacatttgctgtgggtgcagcaagtctatagaaggtgtatatcagtacaaggagaagcaatatactggtctcctcgagctccacaacagacattaaattatatgatcaaggcgtgctcatgctctcacctggaagaatctgaagccccatatacaaggcattatccaagatgttatttttccattgatgtgctatacagatgctgatgaggaactttggcaagaagacccttacgaatatttacgcatgaagttagatgtgtttgaagatttcatttctcctaccactgctgcccagacactttagtttacagcctgtactatgaggaaagaggtactgcaaaagactatgggatccggttaccagattcttacagaaccaaatgctgaccctcgaaaaaaaagatggagccctgcatatgattggctctttagcctgaaatacttctgaagaacaaagatctatacagatcagatggaatacatgttgcggaatcatgtattccctctcttcagcagtgaa

SEQ ID NO: 555551 - DNA, 386 bp, Homo sapiens
atcaccatgtatggcagacactacttcatgtatacgtaaacaaacttaacataagaaataacttcatagtatacatgtaacagaaaaatatcattcacttatacttccacttccctttaaagtatatctcaaattatatttcctgacactccaatcgaaagcatacactcttaatcatggcaccgggtcgggtacacattggagaccaaaatctggtgacaccatctatatatgtacttagccatattcttaaatgcctggcaacacagtcgatatttcccagctgaatatgacattaaaaaactaaattacaaagcgatagagatactaaagcccaagtagagggactacatcattttgaagcactctagaagggggatgtgcaa

SEQ ID NO: 555552 - DNA, 117 bp, Homo sapiens
  misc_feature (39)..(39): n is a, c, g, or t
gttgggtcttgacaagcctgatcacttcatgatcccgtnacctggcacaggaggtgcagccaatctctatttgatttttggcaaccttttcttgatgtataatttacctattagaaa

SEQ ID NO: 555553 - DNA, 347 bp, Homo sapiens
cactggttggcagaagaacagaattggagacaggacacgtcttactgggatgtaagtcctgatgttccccattaagaaaaaaggccaggcataccaacactttggaaggctgaggcggacggatcatggggtcgggatattgagaccatcctggctaacaggtgaaacccggtctctactaaaaatacgaaaaattagctgggcatggtggccggcacctgtagtcccagctactcaggaggctgaagctggagaatcgcttgaacttgggaggcagaggctgcagtgagccgagttcgcgccactgcactgcagcctgggcaacagagtgagactctgtctcaaaa

SEQ ID NO: 555554 - DNA, 175 bp, Homo sapiens
tgggttccttgcagaagtttcgaacatgagtttcagtttcagttttgaagatgaaaaagttctagagatctgtggtacaacaatgtcaatatagtttgactactaaaatggacacttaaaaattgttgccctctcctctggctcgcattttcactctgccatgccctgctctgca

SEQ ID NO: 555555 - DNA, 101 bp, Homo sapiens
tcgcgataagggtgatgtgggcacaccggtactggtgtggcactcagtcattcccattctgatctcagaggctggagaggcagcagagggtccagtggtag

SEQ ID NO: 555556 - DNA, 424 bp, Homo sapiens
aaggagggtacttactccagcaaggaggacatgattagtgttccagcatgaaacctttgaagtgggtcagcaggaaaggaagaaaaagcaaaagcagccagacatgggagaatcagaacatttcttgttgcctaggttattctggtagactttgaaatgccagtccctattagtttggtgggtaaacattctcattattttctgtaattggcattattattggaaggtaattaacgacagtaacattttcgtataacactcagacctggatgggtcttaatgacttcccttcagtcttgcgtgaagttgttttctgtttgatttttgagtgcctgaaactacttagggttctggctgtgagtggactctgctggccctgctatgttttataatataattgcattgaccatgcctgtcaaattgt

SEQ ID NO: 555557 - DNA, 1885 bp, Homo sapiens
gagagggccatggtcatccctgatcggatgtttcgggctccatctgccacaggactgtgatgctagtcgctcatgttccatctccccagacacgtgcaccggtctggggtctcctgcacgctgcagactccattctattcgggcccgagagatccaaggcgcatggggtgcacacgttggttccgccacatgtagccgtcgccgggtcaccgctgcccaggcattctagcatgtgcataagttgcattggcattgaatggctcgttggtgctgcatcatgacgagacggcactgtgcgatatctaccctggtttgactggccaccttgagtggcgagccgtgcgcgcgtggagagattgttagctgccggagaccgtgggttcgtacgaccccagagtgtcagtgtcgcatgggatgctgtccgacgctgctcttggattgctctccagactagctaccgtgagctcggccccatctttggcgatagcggttgggcgcgttgtccgcgccgcaactgcttttgggcgccatgtgcacaagccatctccatccatatttacagatcccagtgcgcaaacaatggcatgggagacgtgacgccaaggggaggatggacaccgagatgtgaacgccgacgaatatgtgggccatgggcggggcactggtcgttggtacattggcgttaccttgtgtgggaccgacagcggcaccgcggtgccgtttttgcctggggattgggcgcagggaaacccggaaggttgtaccacttgggggttcttcggaccgacttcgacgaaagtttcatgtgcatcgcttaggcccccttgcactggtcgggccgtgcgtactgacagggcccatgggtgtcctaaagcaaggccggggcccatttggctgctggtcgaagagggcgctgtggcccggaaagttaggccaaaccgcggtcgtagtggcctttcgcttgccagccatggggacttttaacagcaaggcccccgcaaggaactcccatcggggcgtaggaccgtaaggcaggagacagccacacgttgacaagccttgggtcgctgcaccccaacatgaaattgcggacccacacggcatcgtggggacttggctagacaataacacgtgctcactggcgtatgtaaatccaccgcgacacacaccgtacaatgtagaggcccaagtgacacagcccctacccgggagcaactaaccaacaatgggtcgaggaccagcagggggtaatagaaagagaaaacaccaagaaagaggcaccccaccaggacaggggtgatcgtaaaacggtgtactctagtaacccacacatggatgccctgtaaccagtggtgtcacaaattgatcacatgagatgcataaaacgcaattataaacagctttaacatataatggtgatgctccaggatgtatctattgtgagtacatagttgacttccaactgcgtaccaaccgggtgtgtgatcacactagtgcgcacgagcaacacacaattagctgtgtgcaccagtgcataataagactaaagcgagtgacacacactcaacacgatgcaagatcgagtgacacactagagagcgcacgcggaacaccaaagaagatcagagccgaaaaaagaaacctatgacagacatcgacacaccataccagagcagaccgacagagactaaactacaccactcaccagccagcactcagcccaacacacaaacaaccgaaggtctcatctcaatcacacatacggagaatcaaccacagtcgaaggcagagaatagatcatgcgaggcacacacgagctcacccatgtcaggcgacgaggagacgacacgtactcctcagaccaacatgcacatatatcttcaag

SEQ ID NO: 555558 - DNA, 336 bp, Homo sapiens
  misc_feature (8)..(8): n is a, c, g, or t
aggatccnccgggttgttgtgtgggtagaagtcgagacgctgcgcggcacggccgtagaggaaagctggaaagcaccatgctgcgcactgggagggtgtcagtgcttgctagatggcgatgaggaggaggattgtgagatcacgcacacaggtaccgcagtcaccgccgcagacattgctgcaaagaccgttttcccatcttccaggcacggtcagtgcggacacaaccggtgcagatacgattggtgcagatatgattggtgcagacgcggttggcgcagacggtgtcggtgcagccacgattggtgcagccacaactggcgaagccacgcttgg

SEQ ID NO: 555559 - DNA, 800 bp, Homo sapiens
tgaagcctcactacaggcaccgtaagcttaaagtaggacaaccatggagcctttctgtggcaggagagacaacaaagcgctataatacctaaaggtcaagagaagtgtaagcctaacctgatttaaatatagtaatagaggactatagcctaccaactcacctctttctaggagatagaagcataccgaatggaatagctatgaagtaacccctagggctatctactataacatattaagacaatgctgtatatttaataaagcatgctctataaataataaaaggcccaaaatctacaagacggtagctatgaagagggaagggaaaaagtggaggaaatgctgggacaaccaactatttccctaagacttatatccagacagcactgtataaaaggcaatggtacctacccacacaaagacaactatctcttgaccacatacgccaaccaccgtaacctaattagatactagcaacaagacccttgcaacccctacacctccgattgcaaggccaagtaaagcattgggatacctatgtagggacatagaataccataaatacggataatcaaagggtcaaacgaataggatgtcgaaggatctataggaagggatggaaactattgtaaagaaacaggccaattaaatttgccctgcaaaaaggtcaaacagaaaggagaatcacaaaccaacagctaaattagctctataataattacttatccagtgaactaaaaacaaactaaaaccagtaagtggagaaatacatgtccagaaactgactgctgaataggact

SEQ ID NO: 555560 - DNA, 154 bp, Homo sapiens
acctgtgccgggcctaaacggaactgatggacctggcccggacatggtggaatcagttcagcgtgacagctctgcagctgatgcagagccaaccgggactgtgtgtggcttccacctgggactacctaggataggtgacggtggaacgctggtc

SEQ ID NO: 555561 - DNA, 499 bp, Homo sapiens
  misc_feature (377)..(377): n is a, c, g, or t
  misc_feature (401)..(401): n is a, c, g, or t
  misc_feature (435)..(435): n is a, c, g, or t
gacgaggaactcagcgacgtgctggaacgattctcgccaaggttccacggtgtggtagaggttgcgccccggcagctcaacgtatttcgcgcccgggatgtgatcggcgacgtacttgccatcagcgggtgggacaaatgagtcgttcctatgctggacgataagcgttggcacgcgcacggtcggaagcagcgcccgtatctccaattcggacaccaccggcatcatgacagcaacggtccgcgggctcgctgccagccgttcgaatcgcgcccacgtcgcccggatctcctcattccacggcatatcgggattgagcgctcgttcgaactcgcccgttccccacacggccaccatcgcatcgaagaacgtctcangagtaaccccgttgtcgcgctcanccgccggatccgcgtagacctggagtccgaccanagccgtggtgcgcgacggataagtggccgcgaacagcgccgcgggcgcgaaagcggcattcggg

SEQ ID NO: 555562 - DNA, 505 bp, Homo sapiens
gcacgagacaactactttgaaaacctttattataggtgaatgcaaaagtaattgcggtttttgcactgttggaatttgccatttgatattggtatacattcttaaataaatgtggttatgttatatatcattttaatgcgcatttctcgctttatgcgtttttgctaatgacttattacttgctgtttatgtttattttagactatggaaatgatgtcagacaaaaagcgaatttgagtgactttcttattcgagttcaaaatgggtcgtaaagcagtggagacaacttgcaatatcaacaatgcatttggcccaggaactgctaatgaacgtacagtgcggtggtggttcacgaagctttgcaaaggagacgagggacttgaagatgaggagcatagtggctgaccattggaagttgacagcgactactcaagaacaataatcaaagctgattctcttacaactacacgagaagttgctgaacaattcaacattgaccattcta

SEQ ID NO: 555563 - DNA, 283 bp, Homo sapiens
gcatgtcactttgaaaaaaaaaaaagtacctgtacctgtaatataatatagactccaatgtgtttgttgaatggataaatgaagtgatttcataaaatttattcgatttaataaaatctacccccaactacagccttgtgaagtatgaattgttgtgcccattttaaagatgagaaaactaagactataagggttaagtgacttgtccagataacaaaacatgtaagagtaggaattgagagtaaaatccaaatgtggctgggtctaaattcaaggatcttaa

SEQ ID NO: 555564 - DNA, 203 bp, Homo sapiens
catgttcaagtggcgaagggggcgagacatccaaatcgctatgagcattttgtggggcgactgccgttatcgaacgaggtctggggtgtgctgcaagacgtgagaacgaacatgctatgccccggtcccctccttgcattaaaaaatcctgctgccccagaacgtaggtcttggaataaaatgaataattctccttgtttcca

SEQ ID NO: 555565 - DNA, 704 bp, Homo sapiens
ggtagtccctggagtgcgttcttgatgccgcactgctacgatgaggtctgcgacggaaaacttcaagtaaatggatgggtgcacactcttcaaatggtctccagcctgcagctgtgaccctggagcctagaggtggcctccatcctgcaggtgtactcgtgccgcccaccatggaactcggacacgaggctgcagcttccatcggccatctacgaggattgcatccagagttgagtgtgaagtctggacgtggtgcccaagtccaggctcttctggtacgcacagtgccaggatatcgtctgtggaggtctcatcgatacagtgagagagaggtgatcggtcgatagggtctggtgtccatggacatagtgactgtgctatatgcggaggggcgcttgcaccgtgtgtcctgcgatgcgtgtgaggatgatcggttagcgccacgtactctggaccttggatgctgggccgtgcgagccctacgtccaggtctatgggacccactcttgggatgctgggaccacagttctgtcctgtggctgtgtctcaagctggcagccctgtggctaggagggcccctgggaagcctcctggacagactaaagcaccccttgcagatggggaggactgggctggggggactgcctggggtggccggtcactggaggggtctcagagagtgaggcgggtcacccctggcggcg

SEQ ID NO: 555566 - DNA, 1592 bp, Homo sapiens
ttcgctcagccggcggggggtgacttttgtttttcttgtgtgggggaccgagtttgtccctcatcatgatggcgtgtgggttggctcccccccttgggtgggtggaacacatactcttggctgggttgggttagtgttgtctctcgcctgttgctcgtgctcgtcgtgtttgctcccgtcggccctaggggactgtttctctgtttgttggtgggaggaggcgggggtctctctgctctacggtgggatgtctgctgtaatgggtaagggtctgttgttgaatatcccaggtccgcccttgtgtgtgtgtcgctgcccccttcctgctggggcaccgtcgtgatgacacggtgttgtgggcctctggggtcgggccatcggactcctccgctttggtggggtcccctccgtgtgggtgtgtgttgccccttcgttgttggtctccgaactgtgcgatagatgttccgccctggggcctccccccatggggcgtttgttgggggcgccttaatacgcgtgtctctctccccccctcttgtttatggcttcgcgccttactctctttggtgtgagggtttcctccacccgtttgtgtagtaggcctctgcgctgcatgacagcaagacggtgttttgtgctcctcacagggcggcactgcgcgcttgtcgcgtccctttttttcctcggggggcgcgccctcgtgtggcggccacccctgttgggagaggagagagtgttgtgccgattgcttgctgagagttgtgcgcggcgccacactggtggttttgtgtcgcccgctgttttttgtcgcgcgaccactccacaacttgtgtccccccgacatgtgagggcgagcccctccacgtctcccactgtgggggcgcgactattgtgtggcgccccccgggtttctctttagcggtcgtcgcctcgcgcgtattttgggagaagatttagtagtatccgccctctggtgcgttgtgagacgtgtggtgcccctcgggtgtttctctcccgccgcgcccgagggtgtgtgtgacaccccccttctgatgaagcgctctgtgcgacacacgagtgtgtgtgtgattccgagtttctctggagcgtctccacacgagagactctctggtgcgccacacctccgcactcaggcgcctccctctcttccccggcgacccttctgtgtgtgtgtgtgagaaagcggcacacacgcagacacaccactcgcgagagtgctctcgcgcgcgagacacacacgcctcggcgctatccgcgcgctctcttcttttcacacactctccacctcggggagaaaaactgggcccacatggcgcccaacgctgcgtggccgctccacctggaactcttgtggtgttgaaggaccatcgcacaggattgagacgagttgagagattgatcctcgcgttcccttcaccccaccaccctggagagtggggtatacccgccccttgaaggccgaagcctcgccctcggggccaccccacaccccggcctggggcccaccctttccccagacctccccctgccccaaaatctttttccatttaaaaattttttggaacctttta

SEQ ID NO: 555567 - DNA, 1149 bp, Homo sapiens
ctgagattgaagaccctctttcatttaaattgaaatttgtggaaagtatagtgtcaaagtgctaaacatatacatggggaacattacgtttagatgagaaaatattttattaataagttcagacagagtgtgatatggtctaggctgggtccccaccaaatctcatcttgaattgtagttcccataatccccacatgttacccagtggggggtaattgaatcatgggggcggttagcccatgctgctattctcatgatagtgagtgagttctcatgagatctgatggtttgatccaggacttatcccccttttgctcagcacctctccttgctgctgccatgtgaagaacggatgtgtacgcttcccgttccgccatgattgtaagtttcctgacggcctccccgaactatgagtcaattaaatctcttatcgtttatgaatagccaagcactgtgagaactggactactcaaatacgagtgtcttactccatttagcatcgttcataaaggaatatctgaggctgggtactccaataacactacgaccacttcatccggactcacggatacttcaggctctgcaacgaagccatggcaccagccatctgcctcctggctgagcgacctcattgaagtttcctaaccatgggagggaggccaacagagcagaagcccaagcaatcggcaccatcgcgcacacgacacggcgcaccaagacgcagagcggcaggagtgccacaggcccaatagcgcgcccagacatccacaggacctaacaaagaaaatcccctcactcgcaacacaatgacaccaagaactactgacggatcggcccccagcacaaaccgcctccaccagcccaactgacaaaacagtagcaataaaccacgacaattgaaaaacacatctcaacagggcagcacggagatgaaaacaccagcgaagacacgacgcaacgccaacagatcgacacccgcacgtccgaccccgacaccagacaacgaacgaaaaaaagaaagcgaagccaagcagacatacgagggaacacaacgcagacaagcgagcaaacaaaagacaagcagtgagcatcacaaacatgaacgcggcaccacagcaagaccgagagaaagagtcgaccgcaccacgc

SEQ ID NO: 555568 - DNA, 370 bp, Homo sapiens
  misc_feature (60)..(60): n is a, c, g, or t
  misc_feature (214)..(214): n is a, c, g, or t
gggagaaggggtggcgaggttaatggataattaagaagtttagtgagcctgtggtgtttnggatataaactagtgctactagcagtggtagggatcctgctagggtgtagaataggaaataaagtcctgcattgagtcgttctgtttggtttcctcagcgtgtgatgataattagtgtgggtactagtgttgcttcgaataggatatagaatangattagttcggtggcggtgaaggttataattaggaatagttgtagtaggattagtatggtaatatatagtttttttcgggttgtggtttcttttgataggtgagattggctagctattagtataagggggaggagtcatgtgcctagaactgtacg

SEQ ID NO: 555569 - DNA, 1243 bp, Homo sapiens
tagtccccatagttagacgtagtatacttatgaagtggtatattaaagtgaacacagcacatatacattatctatactgcttttatgtcatgactctaatactagggtatgttctggtaaactccataccttataggtctagaagacaacaaattacctctaacaccaggcttatccacacgacagaactagatcacaacagctcacggacctctcactaattccttgctacagtgggacctagatacatgcagaacctgcaattcaccccacttccaagaatgacccaccacagccagaggaactcagcgctaaagaccaacttgaacaacttgcccctacgagctgacatcagactgcataccagttgcggagtgacacctcaaagggacatatcaaggattgcccattagcgagtcaacggagtcccctgagccgtactctaggaatacctactttagcgtagaacgctccatagggagcagaccttcgaaaggctcaggtatgagctgctgggtgcagccgcgctttagggccctatacgccaaatagacgcgctacacaaagttaagaagtacctactgaaccgatgaacccaacagtcgggcacataattcatagcatgagacaaataccaggatagtgcttccagagacgggtccgcgacgatcgctaagacataatgcgcaacacagagactaaagaaagacgacagaccaaagccccagtacactaaacatccaatcaacacaccctctataaaaaaatatcattaaacataaaaacataaaaccaaaaaaaaaactaaataataacacataataaacattattattacctatcgccctactcccaagctcactcaccattactgaacacaacaccatgtctaatatcaaaatacactattaagaagaataactccaaaatctaagcagacgctagagcatcaccaaaacagaactcgcctgcagatactcacccagaggaggagccacaagcagatacgacgaggcacgaacaaaacgaggctcataacagggaacgcacgatcacagaacagcgcgcaagcgaggtgacagcgggggcgaagcgagagacgccaatggagaccgcaggagcagacgagacgaggaaagtgcatgagaagaagaaaatgagccgcgggcgagggcggctgaactggaggaggagaggggacagaaccagcgagagcagcggaggcggagcagcgagtacccag

SEQ ID NO: 555570 - DNA, 490 bp, Homo sapiens
ctcggtaccggatattcctttgtcttcattatgaaataatttcaactttttctcaaagaaatcataaaactatccacaatttggaaaatgaatggaaattacttaagctaaggagcaggaaaaaaaaacgaacaaagaaaaaggaacagaggcggggcacagtggctcacacccgtaatcccagcactttgggaggccaaggtgggaggactgcttgagctcaagagttttcatcagcctgggcaacatagggagaccctctctctgctaaaaatagagaaattagctgagtatggtggtgcctgcccctagtcccagctactccagaggctgagatgggaggatcgtttgagcccggggggtcggggctgcagtgagctgtggttgtgcctctgcactccagcttgggtgacagggtgagaccctgtctcaaaaaaacaaaaaccaagacaaagggaaacaccgtggtgctgactgtgtaataaccact

SEQ ID NO: 555571 - DNA, 150 bp, Homo sapiens
ggtcggtgaaggatcccaagatggctgggcgaaaacttgctctaataaccattgactgggtagcttttgcagagatcatacccccgaaccaaaaggccattgctagttccctgaaatcctaggaaagagaccctcacctccaggttggtt

SEQ ID NO: 555572 - DNA, 229 bp, Homo sapiens
agcagacagtggtcagtcctttcttggctctgctgacactcgagcccacattcccgtcaacctgctcaaggatcaattgcaggtcttccacttcttgcctttcttttcctcctttcaaccatggttttttgcacccggtctctctcaatacacttctctctctagacacgccgcccgcctctctctcttcatgtcacaccttccgggcagattccacaggatttacata

SEQ ID NO: 555573 - DNA, 119 bp, Homo sapiens
agcctgcccaacttatatagcggagagatatagtcagattctggcgtatgttccttctagagcagggtcctcgctgttgtgcccaaggtagtggtcaatcaacttctctcgagaggcag

SEQ ID NO: 555574 - DNA, 273 bp, Homo sapiens
  misc_feature (144)..(145): n is a, c, g, or t
  misc_feature (151)..(153): n is a, c, g, or t
  misc_feature (220)..(220): n is a, c, g, or t
  misc_feature (246)..(247): n is a, c, g, or t
gaaaaactggcgcctggcacaatcaacgtgctcagtttcctcttcactcagcagcatgttggggatcccgcggctgatggggaacatacgtcagattccgggcactgcagggtgctctatcacttcacctcagcagcaggtggnntgtctnnnactcctattctcctcatatcctcaaccggccctttcggcaccgtggatcagacgcaagttatcggcngctccaggaacgccgaccactccacnnaggtatcatacggcacgagtggggtt

SEQ ID NO: 555575 - DNA, 578 bp, Homo sapiens
  misc_feature (125)..(125): n is a, c, g, or t
  misc_feature (510)..(510): n is a, c, g, or t
  misc_feature (513)..(513): n is a, c, g, or t
ctgacttgaaactgggaagagtccgccaccacgcccagcttattttttgtatttagtagagatggggtttcaccgtgttcgtcagggctggtctcgatctcctgacctcaggtgatccacccgcntcggcctcccaaagtgctgggtcaactatgttcttgagtaagaactcctgatgcctgattgttatgtttatgaacaaacaaggtgaagggttcagtataagttggaaatcctagagcaaccatatctgttactttccatcctggttatatttcttaattagactgcgaagttctgaatgaagtcctttttaaatagagcagttaatgccatttctgtctctgcaggtttcacaagtagtgtttctaaatgagctctataatctgaaaccggttcatctttcttttgcccacaagattatgtgattgaccaatcaattttttgtggaaaagccctagggattgaatttaaaagatcttcagcaattcttccagttcctttttgccnccncttggggttttggagtggtctttagtatcctcaggctgtttccattctgatgttggagcggccgc

SEQ ID NO: 555576 - DNA, 401 bp, Homo sapiens
gcggacgcctactactactaaattcgcggccggtcgacgataaaaagtaattgaattatattgtcttcctttctaaatgaagaaattgctattcctttttctataaaaaaattctatccattttactcagtcttgaagggaaaaagaaaagtggcattgtcataacagtaatactttatgtcagaagagagctttatcttgtttgatttattttaatttttgaagggtatgtgcatttatgtgagaaataaaggggtaaaacataaaaatcatagttcccttttagtgctttgttaaacacttttcatgtactttttcactgaatcctagaagttaaagaacgtgttaacttgttttctagataagaacatagaaacttaaaggggcccaaggtcacatag

SEQ ID NO: 555577 - DNA, 238 bp, Homo sapiens
taccccataacatcccatagggaatggaggttatgggggacactttctcttcagagacgtgtagggaccaaaggggaatcttcgagcctgccactgactataccaccactaacatctaggatacagcgagtagaactctggacttggaaaaggtgctctctcggacccatttctagatttgccatcaatctttcacacatttggtcaaaatgggacacaaacgtggaagcatattgga

SEQ ID NO: 555578 - DNA, 1162 bp, Homo sapiens
cggacctgaaggtctcaaatatgttgagaacgaaagtatgaactataaggaacctcgagatgtagatttattttgcaggaaatacgaggaacactaggaacacgaacgtgtttgcacgcatcacacgtgtaaacgacaatgactactgacggactttttaccagttttactgacacactgacacatacactggcactttacaacacactgacacacacactcgtaccgtttcacaactaagttttgttaacacgggacctgcacatgctcttgcttcatcagcttccttgagatctttgggtatttgcaccatctccatttcccaatctctcttttcgccatagtacgacacatcatgctcagtctcctcacacttgatatataacgtcgaaaaacatccaacaccattgatttccattgctcctttcagagccctctatgggcgggaaccttgactatctctcgtaataccacaagagtaagaaacacactcggctcttacttggcaaccacaacgtaaccaactgtaactattccaaacaattattaagcacaatggttgcctacccggacacttatataccggcaatttaacgttccttctacacgagcagctccaaaagccgtcccgttccaacaacaacaagagcggggttacgtttaacacccaaggaccacacggcgcgcacgccgacgacaagacaggaggcgcaacgcgccactctgcccctcccggcgtcacactcatgccccacgttgtataggtgggggcgacatatactactctcgcctttcacacagacacaactgacacgcccctcttcatgttggtgccccccccacacgcattctcaatgctcacccaccgcaaggcatgctccgcaaccgactatagatggtcttactacgggggagtaatgtacagcccgaataacaacccactatagaactaccgatagtaccaaagcgaccgccagatctagcacctccacattggggcgcgacaaacatcgccgccaaaactctatctacagcgccttagtacaaagcgccacactagggacgtactatacccagaggggggacccttccgctggacgaccgcagggtccctatctgacggtgccaattaagacgatctaacagtcataggcccaggcat

SEQ ID NO: 555579 - DNA, 190 bp, Homo sapiens
aatgtgcgtcacgagacctggagaagcacatccaaggcggtgggctcctccatggtacagctgctgacctgtgctgctcaaggcgacgaacactacacaggtgttgctgctagagagatgggccaagctctgaaaacactgtcccaggccgtccgtggagtggatgcattgacaaccgatcccgcagtgg

SEQ ID NO: 555580 - DNA, 266 bp, Homo sapiens
ctaagggtcctaggatatagaagtggtaatgagcacgtggcttcaacttgaagccaccagcgcattaacccaaagcaagagtcaacctgtcctttgaagctctgaagccaggcactgtgtttctcctactctagtttatcaagagtcatagaatggcatcttcttccaagtagaaggctgtttcatcgtgcactgacaaatctatgtgtgtagttcagcccaccttcatcactggatctcatgccagaatattctatgatcatttg

SEQ ID NO: 555581 - DNA, 332 bp, Homo sapiens
gcttatgtaaaatgagggcatgcctgtaataacttatcctcgataggcgatgtacaaggacggggtatgctttttcttttgtcagggggtacagaaagagtgtgagcgttgtattataccatagccggctaataaaagagtactgcggcaagtactattgacccagcaatggggcttcgacatgggctttagggagtcctaagtggagtccgataaagaggtatctttactataacaagctattgtgtcagctagtcatattcagtagttggccccagagtttgatagttcttgggcagtgatactacctcccaagggacaaggactgtgta

SEQ ID NO: 555582 - DNA, 687 bp, Homo sapiens
ggtgagactgaaacttggcagaagacagagcaaagctaaaagagctggagaaacacaaaatccagctggatgcaggtgcagtgaatggaagagcaaaatgcaggagcatgcagtgccgacctgcagctgtgcgcctcaaggaggcgagaaagtgaatgccaaggaggcgctggaggcaaacggaacgctatatgcgaggagatggctgatactgctgatgccattgagatggccactttgggacaaggagatggctgaacgagcgggctgagtccctgcagcaggaggtggaggcacttgacacgtgagcggtgtgtgactgagctcactacttgacttagagatcctcaaggcttgcgcattgacagacgaagtggctcagattggcgctgcattccatgtaatcagctcaagcaggcttgaggagcatgaattgcccgcctgacagggatgcccatggtgaggatgcgggatctttcttccttcagagcaagccaggagcatgtgaagctccagaagctcaatggaaaagaagaaccaagaagctgaaagcttgacgagggcaacaggcgcggagcgctcttcgagtaggatgcttaagccatggcacgacagcacccattgacttgagctcaaggagccagctggcatgctgctcttgggttcttacgcgagatggtggcagca

SEQ ID NO: 555583 - DNA, 523 bp, Homo sapiens
  misc_feature (25)..(25): n is a, c, g, or t
  misc_feature (73)..(73): n is a, c, g, or t
  misc_feature (137)..(137): n is a, c, g, or t
  misc_feature (158)..(158): n is a, c, g, or t
  misc_feature (166)..(166): n is a, c, g, or t
  misc_feature (184)..(184): n is a, c, g, or t
  misc_feature (186)..(186): n is a, c, g, or t
  misc_feature (196)..(196): n is a, c, g, or t
  misc_feature (200)..(200): n is a, c, g, or t
  misc_feature (272)..(272): n is a, c, g, or t
  misc_feature (282)..(282): n is a, c, g, or t
  misc_feature (305)..(305): n is a, c, g, or t
  misc_feature (330)..(330): n is a, c, g, or t
  misc_feature (448)..(448): n is a, c, g, or t
  misc_feature (508)..(508): n is a, c, g, or t
aaaattaaaaagattttttgtgaangaataaagggatataaaaatgaaaaaataataaaaaagataatatatnaattaattatatataagaaaaattatagaaggaatataaatggggaaattttaaaaaaaaaggnaaaatataaaatataaatgantataaggnaaataaaagaaatgagtntnagattaaggnagtnaatttattttgaaaaaggaagtggaataagaaaataagtgtgtgaaaattagggtgggagatattaaaaatnaaaatgaaanaaaaaaggaataattttggaganaaaagtgtattatatatggatagangtgttatataggattgaaaattattaaaaggaaggggaggaataaagtaaagatgggaatataaggtaatgaatttagggagatgaaaatttaatttgggaataaaatgaatgaatgnaataaaaaagggaaatggaaaaaaaagttttgattgagttaaagaaaatgaaggtgaatntttaaaattaaaagt

SEQ ID NO: 555584 - DNA, 260 bp, Homo sapiens
ggtagatattgatgccttcacctagatcaatgctaatatgatgagtcttcagtgacatgaaacattgacaaacaacttcgcatctgggtcacttacaacaacgccatctatccaggcattaattcatggcctaaacagacattattactccataactataaactatcggaaaaatgaactggaacagaagatgtagctaaaatatgcatacgaagagtaggatgagaaggtatgacacttcaggactacagtgaacattg

SEQ ID NO: 555585 - DNA, 298 bp, Homo sapiens
  misc_feature (212)..(212): n is a, c, g, or t
  misc_feature (241)..(241): n is a, c, g, or t
  misc_feature (268)..(268): n is a, c, g, or t
aaataagtcctcacatttagggtcaattgattttcaacaagtgtgctaagataattcaacgagaaaaaaatagtcttttcaagaaatggtgctgagacaactggagatccacatgcagaagaatgaagttggactcgtacctaacactatatacaaaatttaagtcaaaataaatctaacctgagagctgaaattataaaattctagaaagnaaacataagcaaaaatcttcatgactttnaacgtggcaatgatttcttagatatgncacccaaaaaggcaagcaccagaagagaag

SEQ ID NO: 555586 - DNA, 534 bp, Homo sapiens
  misc_feature (472)..(472): n is a, c, g, or t
cattatgcaatcttggagtggggctgaactagctacttttctcagagagcaccatttttattggcaagaacggatagataaccacggatctacagatgtgggtatgtggcagacatttcctcaaaaatgaagtaaccctgtcgcttcaagaaaaacaactcagtattggtggtaccagaaaacatttacgctttcaagtgaaaaagcgattaaaatattccctttcccaactactggtcggtgtgaggtgggatttgcttcgggtacttcaacccagaaaacacggcaacatacggaacacaggagcatatatgagaatctagctgacttctattaagacaaacattaaagagatcggcaaaaatgtacaaataaggccactcgtaacattttggtctggattaacatttttatgtggggaaaaacaaaaacaaaaataaataaatttttattggggggccaggcatagtgnttcacacctgtaatcccagcactttagaagggcaggtcagatggatcatctgaggtcaggag

SEQ ID NO: 555587 - DNA, 213 bp, Homo sapiens
caggcggatcacaaggtcaggagatcaaaaccatcctggctaacacggtgaaaccccgtctctactaaaaatacaaaaaattagttgggtatggtggcatgcacctgtagtcccagctactcaggaggaaactccagaagcagacagggccctagatataacggcatctaagtcctgtataagagtctgcacctagattgtgagcagcgttgg

SEQ ID NO: 555588 - DNA, 729 bp, Homo sapiens
  misc_feature (535)..(535): n is a, c, g, or t
ctgtggaggctgcgcggctgcgaaggaggcggcggcggtggcggaggaagaggagtggcggcagcggcggcggggacccgtgcggggatggctggaggtaccgctgggcctagcagactcctcccaccaccagcacctccggccccggcggcggtcgagccccgctgtcccttcccggcgggggccgccctcgcctgctgcagcagaggacagaggagggacagacgaagagcacgaaggcgggcgggcatgcagagagccctgagctgggctgtgagagtcgagagacgtgtggtgctggacaagtgggcatccggtgcctcctgctgccctcagcctgccgagtgagcagcagcagctcaacggatttgattagccccgaactgcggcacctccgggacggacgactcccatcaagagcaaggtcctgagcgtagcagaggtggcgagaccacagacaaccctgaaggaggcacccaagaagagagtgacgaacaaaaaaggatgccggggtacacatcgacgggcgaaaagnggacccctacacatcaccctctcgtagtaaatgcaaaggaaaagtgcgaagacacacaagagacagcagggaaggcaagacgtgaagacaaagcagaatccaagaagagagccgaaaaatgaacatggcaagaggagacagagcaagaagcgaaagaagacaaaaaaatagagaagtgaagatgaaaaaagaaa

SEQ ID NO: 555589 - DNA, 333 bp, Homo sapiens
cagcaatacatacgccatgcctctgtgaaccctgtattcgcttggagtgctcggaaggagaccccctgtagcctatcgccccttcccgctctgtccctggtgtactcactgcgtatgggtataacctctgactggtggctaggatgttatcccaaatgggcaacacatggcaaagggtccccattgtgggtgcgcttgtgatgtgcaggagccttcgtccactggtatttcttccctgtaattgccgggcccctcaccccagtctgacaggctgttgctgtgcctgctcacacctgctcctgcaggcacactgggctacggacgaggaaggag

SEQ ID NO: 555590 - DNA, 202 bp, Homo sapiens
ataggaggtgtatgagtaggtcgtagcggaatcgggggtatgctgttcgagttcataagaacagggaggttagaagtagggtctggtgacaaaatatgtgtgtagagttcaggggagagtgcgccatatgttgttcctaggaagattgtagtggtgagggtgtttattataataatgttagtgtattcgccattcagcctcg

SEQ ID NO: 555591 - DNA, 200 bp, Homo sapiens
cggagcaacgggagcgcacacccggctagttttggaatttggagtagagatggggttcaccatgtggccaggcgggtcttgaactccgtgacctcaatggatccacccacctcgggcctcccaaagtgctgggattaaaggtgtgagccactgcacccagccttctctcttggctttgattttttttcgtggatacgtct

SEQ ID NO: 555592 - DNA, 86 bp, Homo sapiens
acctcgcttagtgctccttggtgtgattccgtcctgcgcggttgttctctggagcagcgggtatccctacccgatccgaggtcaac

SEQ ID NO: 555593 - DNA, 121 bp, Homo sapiens
gtaccggactatttgtggttctggcctatcgattacgcagtgcaaacttttactttacagatgaggtgggaagaacagccatgatctagtaaaaagagacctgccagaaccacaaatatcg

SEQ ID NO: 555594 - DNA, 200 bp, Homo sapiens
gcatccaatgcatctttgtccccaagtgcttacccagggtgggtgcagggaagctccatgaatgtccaaaaattagacatgaatcttgagtccttggaaggaaaacatggtttcttcccttcatatcttggctttagttagcctgggttttctgtcctcccagccctagttccctgtctcagcttgctatgggacaggac

SEQ ID NO: 555595 - DNA, 450 bp, Homo sapiens
  misc_feature (8)..(8): n is a, c, g, or t
  misc_feature (124)..(124): n is a, c, g, or t
  misc_feature (141)..(141): n is a, c, g, or t
  misc_feature (165)..(165): n is a, c, g, or t
  misc_feature (195)..(196): n is a, c, g, or t
  misc_feature (447)..(447): n is a, c, g, or t
gacatatnttaggtggtaaatccctccattttacaggtctttgggaagttctggtggccaggaaatccaaatttgataataggattttctcaactgaactcagggcagagcacagttggtctgngtgggcgccctgtgtgncaggtgccttcctgcaggtgggancacttcctctgcagtcagtgggggaagtgnncatcaggggctgggtgtgatttcagatctgcaccgggagacatgctgttttcactggggttgtggcagtcccgggtgaaggctggtctaggtcataattgttcatctcctccctgtctctgctctcagtcatggagttggttatgctttttgaatactttgtgaattccatccggctctcctcagggtcgtcttccgggtttgggtgcgccagcttcagcttgttcaaggtgtggcgcttgaaaatgaagntaa

SEQ ID NO: 555596 - DNA, 472 bp, Homo sapiens
  misc_feature (3)..(3): n is a, c, g, or t
  misc_feature (21)..(21): n is a, c, g, or t
  misc_feature (143)..(143): n is a, c, g, or t
ttnaatagaggttagacacanggacccctctgccatctccaggttccttccctgtaaaatgaaggagtcaaagtggataattttatggcattgcccagctctattccaaataaaagtgatgattcttacaagccctgtccaanttcctcggcttctgattataccctgatcttagaaaatatgtaactcttggctgggcacagtggctcatgcctgtaatctcagcactttgggaggcggaggcaggcagatcacgaggtcaggagattgagaccatcctgggtaacttggtaaaaccctgtctttacaaaaaatacaaaaattagcctggcatggtagcttgtgcctgtagtcctaactacttgggaggctgaggtgggaagattgactgagccaaggggttaaagttgcagtgagccgagatcatgccactgcactccagcctgggacagagtaagaccctgtcacacac

SEQ ID NO: 555597 - DNA, 653 bp, Homo sapiens
ggcaaattccttaacttcgctgagccttctcttttcctgtgttaactagggaagatgagactagactctccagtgtgtatgcaaagcacccttacgctgcagagatgctgcaaatagggagtgtcttttttttcttcctttttcaattttatcctctgtgcttgccctagagcttgttatcaatttctcttagctttgtcaattgtggtggggtgtgggggattgagatttggctttcctgggaagatgttccaaaactgtctttgaaataatactctcctcctctgcagatcagtggacagggtgttgaagggtcggcataggtggtaagcatgattgatggcccccagagatgtccatgtcctgctccccggaacctgtgggtatgtcatgttacttggtaaagaggaccttgcagatgaaattaagtgaagaaggttgagatgggagagtattctgggttacccaggtggatccagtgtgttcacagggtccttttaagaaaaaggcggggctgggggcagtggctcatgcctgtgatcccagcactttgggaggccgacggcgggtggatcacctgaggtcagcagttcgagaccagcctggccaatatggcgaaaccccgtctccactaaaagtgccaaaattaactg

SEQ ID NO: 555598 - DNA, 592 bp, Homo sapiens
tgtttccctttgtctagcacgccagacaggccagtctctccggctgggggcactgcgtgggcaacagcgaccgcgcctccgagcggcgcaccgtgagggcgcgcgtctgcgctggggcctcgcgcgcgttccacgatgaagactgcgcgtttgagtgtccctggcaacgccacgcttccgccttctggaagcctgcactccagcttcgagtgtgagagacccgtcccggtgggagggacctgggctgtgggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcggtaagagatcgatgaactccccctccttaacctcaagtcggactctaaatagtctcaggtggttttcaacaaccctcccccacatcccccacttaccacaaacacatcattatcttctgggacagatcgcacctttgtctttaagacaaagggaaaca

SEQ ID NO: 555599 - DNA, 288 bp, Homo sapiens
actacatcgttacacttaccgcatggttctgttcgggttgtacggtagcactgctcttcttcatcctctgtgggatattgcggagtctgctccgattttgcgtcgctgggtttggtttaatccacctcacctgcctgctatgatggatcagcttgagcgcgtgaggagacggcttacgtttcgtgagggagagatttggtatctgattgagatgggggctagttttagtcatgtgagaagaagcaggccggattgtcagaggggtgccttgggtaacctctgtgactc

SEQ ID NO: 555600 - DNA, 1794 bp, Homo sapiens
acgaaggccggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagagaggcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgacggaccccggctgcagaagtgctgttggtttggatgctgtgtgcctgtcaagattcctccggttttctggctagaaagctcatcgtttccggtttctaagagtcagttcatgcagagccaccagggaaaagtgaggctcttgggggtggtttgacccctgcttacctgggagcacacttttcccttccccgatgacctgggatggtggccaggccgtgcccttgctgttgctgggcagtgtccttttggaaagggagctgccccaggctttagtgcagctgccaaccctgttaggcctgccgtctcgaggcctcttctgacctcaatggtcacaccccctcaaagaccctctcacccatggtagttgctgctcgtggttctgtctgtccgtgcaccgatgcacacaccgcaccccaccactgtactctgaaattggcgagtgactgtactctgaatggcgagtgagttgtggagagccagctctgcggagtcatcacgcagccatggttgtgcctgccgttcatggtggtctttcaggttatcttggcaacatgtacattgcttttattttttttcttttttgctttcattgtacagtctagtactataaaatttctcttttgagttttatacctttgtagcattttagatgacattgtgtttgtactttgttgtgtagagtggaagaattgtgttgaataaacccaagatcggaatgcca

SEQ ID NO: 555601 - DNA, 1244 bp, Homo sapiens
ggccaagaaaaagcatattatctacataatcacaatcacatttacaaatatgagcccatcactaaccttcctatatttaagctatgtattatttccagcataatttgtgctataattatttagacacaaacatgtgtaggtcacaccatattattacgagatttatactagcattacttaaagcataaaaaacgtatacataacatactgcattgtcgggcactgcattacttcagcattccatccgtgcaggcagatggtgtaaccatagggtattggaaatataaatcccatgggaagtcagctgaagaccactataatgcatcactcaatacctgtataaagccctgtgctgtactgatctctctataaagactggctggaaaacagacaacggaatgatttaccactattactgctcctaacttatggattcaccatagttaactactctaactccggatattaccagagaacaatgttcctatacaacgactattgatctatgagcacaggcatgcattatgggattatttaataaagattcacagggaaaaattgacaaaattatggaatgagtcaaatatgataagggtaagactttaatcaatgataatgaataagaagtgaattacataaagaagttaaaattaatgaaatatacgtaggcacaagggacaacggttatgcattgtatcaccaattgctagtattacacatcgtattactataacagggttacttatacaactacattacacaagtgtacacctaaaagacgagcatttgacaattcatagggaaaagtgtacaccaaccatcataaccgtgcatgccaactattgaagtaagaacaacttaccgagcccctacgcatataaccaacaaacaaaacaggtggcgcgagcacatagagaggagggcacaatgaaaagagagataaatacaacggcacacagtcagtaggagtatttaaggtgcgacaaacaggacatatgtgctagggacaacaaaaagaggggtccgaaaaacaaggggggaacaaatgagagaagtatagcaacggcgttccgcgacagtcagacaagaggatgcaacacagaaatgaggacagaaggaagatgagaaggagcaaagcaaacaagagaatacgtcagtaagagtaaagaaataagaagacaagaaaaggagaggagtaagaagagcgaagaggagaggaagggaaagacgaaggaaaacgagaa

SEQ ID NO: 555602 - DNA, 1769 bp, Homo sapiens
acgaaggccggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagagaggcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgacggaccccggctgcagaagtgctgttggtttggatgctgtgtgcctgtcaagattcctccggttttctggctagaaagctcatcgtttccggtttctaagagtcagttcatgcagagccaccagggaaaagtgaggctcttgggggtggtttgacccctgcttacctgggagcacacttttcccttccccgatgacctgggatggtggccaggccgtgcccttgctgttgctgggcagtgtccttttggaaagggagctgccccaggctttagtgcagctgccaaccctgttaggcctgccgtctcgaggcctcttctgacctcaatggtcacaccccctcaaagaccctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtctagtactataaaatttctcttttgagttttatacctttgtagcattttagatgacattgtgtttgtactttgttgtgtagagtggaagaattgtgttgaataaacccaagatcggaatgcca

SEQ ID NO: 555603 - DNA, 1066 bp, Homo sapiens
  misc_feature (1065)..(1065): n is a, c, g, or t
cagccacgtgctgagttgcatggagaagacagagcagtgtctgctggctctgctgcaaaaacacctccccggccacccctacgtgcgcaggaaacgcaggaagtttcctgataggctcgctgatgatgaaggggacagtgactcagagtctgttggacagtccagggacggagacagaagaagtaaagaggcagggccctagtgagggagctgaggagggggacaggagaagccctcaaggggtgtgggggaggcaggaaagctgggaggatttaaaggagaagtaactggagcatccagaaatgcctgtcatgccaagcttgggcttctcctgcagttccccatggggcctttttccagcaaaggcaagctcttggggagcatcatgctagcctgatgagccctgcccagaaaagctcgcagcagaagtaggtctccccctgagagtgggagaagcctaggcatggattctgtgagctctgcccgtgctctcctcctctccctcctcctcctgcctcattacagcagttgccaagccccctggcctcaaagagggtgctgtacccccacagtaggaaaggagcgtcatctggccacgctgggtgaggtgtggactcttttgaatttatatttatacaccagtcctatttctttacgtccgacttgtctctttcctcttcttcctctcagggtgacagtatcagcgagtgcctacagaattccggttccaccagatctggggacagggggggcccgagtgatcgggcccatacggacacctttcgagaagtccgaagacctcactgtggagcctacggcctacccagtaaggccgtatagacaaacggaaataagcgactccaacaaagggggcgggtacacaagcatgaacgagaaaaggctgcgcaaagagtgttgaacgaccccccacataacaaagctctgtggcaacaaagaagcaacagtgttaaaacgggagtacaagagccgatataacagactagtgagaaagaaataggtacaagaaaagaggatcgccgcgcgggcgacgagtgtcgtcgtcana

SEQ ID NO: 555604 - DNA, 143 bp, Homo sapiens
ccacccgaaggggacggcacccccttaccgaagcaccgacaaagaagcaacgaagcaacgacccgaaccgcacaacacagccctacacgaagaactacgaaggactccgaactacccagcgatgcaacattcccaagggtaaa

SEQ ID NO: 555605 - DNA, 698 bp, Homo sapiens
tgtttctattctgtcttcagtttccgcttcctcgtctcccatatgtctgggattacaggcgtgatccaccaccctggcccttgcaatcttctactttaaggtttgtcagagtatttctctttttatatccacaccgtacatctgcataaatgttatttcaagcaaaggaaatgagtacctgtcaatactgtataatattagtcttcctacattaatatacgtttatttctgatctatacaaattttcagaaggttattttctttatctattgctaaactgatgtacttactatgggatggtggtcctagtcccatgaccttggggtacaattgtaaacctagagttttatctatactttggtgtaactagttttggcataatagtcaatttctacttctggaagtcatctctattccactgttggtattatataattcaaggagaatatgataatacactgccctcttgtggtgcattgaaagaagagatgagaaatgatgaaaaggttgcctgtaaaaatgggagacagcctcttacttgcacaagaaaaatgaagggattggaccgagctggaaacctcctataccagatgctgactggcaacatggtggtttatgcatctcagacagtatccacaatagctgacggatgggtgtttcagtatgaaatattttgttagcttaccatcttgcgctgc

SEQ ID NO: 555606 - DNA, 410 bp, Homo sapiens
aagcaccgaatgtgtcgaatcagtacaaatccgcaaagcatcaccccgacaatcccacccaacgtgttgaatgccaccacggcgccgacatcatggccgacccgctcattgccgacacaaaggcgcaaggccagagggaacgcagctcccaacagcagcgtggggacaaacacgatgctcaacgctgcgaccgcaaaccttgagctcatgcccagcaactcactcgcccccaacgacagcacccaggactccaccagactttgtgccaacaccaaccaccgaccgagcagtgctatctccagcaaagccaccaatccagtcccggcgatcagcaagccaaatactcccctggggtcgcggatacgatcaatccgacgggccagtagcaggctgcccaagaaacagcccgg

SEQ ID NO: 555607 - DNA, 448 bp, Homo sapiens
ttatttttcgcctcctggttttaaaaaaatttttgtaaaaaaaatttggcggggtttttcccatataataaccctacagaaagaagttggcctccaaggttccttttggttgaccagaggttatttttccctccccggttcttacacccacgccggcccaagaaaagtgcccccccaaaatctgtaatattgggagcgccccccccttctttttctgagggggggttataatttgaaaaatgaattgtaaacaaaaagcatttaccttggtttgggttccggccccttttatcttagaaaagatttttgtatagaagtttgggaacccccccccccttttgggccaatatataaaagctgttttttttttccccttaaaaatgttgattaaaaaaaatgggaggtaaaatattcattaatgaaacattcaataaagaaaattctgttt

SEQ ID NO: 555608 - DNA, 199 bp, Homo sapiens
ctggtggtcgatctagaggtcccccacccagctcaatggaaagactcagagaacaaggatttacttcagcggtatcagcagctagatttcagactacacaagggtgagtagcggtgccaaattcttaaaatttcttggggggggggtgtgggtcaggtagcagtttttatgtagatctatatataaaagtccacacctc

SEQ ID NO: 555609 - DNA, 273 bp, Homo sapiens
ggctctaatggaaaaagtgggtgataggcaagaaaacatgggcaatgtaagaggagtgatggacaaaagaacaaaaaggaaattgctgcaaaccaaaaatgctaactgaaatgaagaatctctaagggctcatcaataggatggatatggctgaagaaagaatcactgagttgaagatatgtcaatagaaacttcccaaactgaaatgcaaagagaaaaaaacggaaaaaaaaatcagaatattggagaattgtggggcaaaagtgttacatg

SEQ ID NO: 555610 - DNA, 101 bp, Homo sapiens
agcccagtaaaggcgccattccccattttacagctggggaaactgagttacagagcttgtctgcactgagtcatcaggagcaaatgctggatcagataggg

SEQ ID NO: 555611 - DNA, 306 bp, Homo sapiens
aggcggcgtggatcattgagcatggctaccactctggccatgtatgtctcccacagcagctgactctcgttgactgcttcctgtgccaaagattccactttctcctggaaatgctggataactgccttcttatcagctttaggcaagtactttgacaagaggttcagcctcttcccattctctcatgagctggaacaattctctctcggtgctttggactcaagcctctctttggattactaggaaatgggcatgtccattactcatccccaggtgtctcgagatacttgtcaacggaatcagggg

SEQ ID NO: 555612 - DNA, 1121 bp, Homo sapiens
  misc_feature (736)..(736): n is a, c, g, or t
ctgcttcccaggaaacttcatttcacattggattagactgcccaggagggcaacgctgggctggggcagccgggcaactctgccaggcctcgctgcccactgagctgccttccacagctcgctagacccccatgattgtggctgtgaattgtgccagccaccctgataaacacaccactgcctccaccccatgacacacggaatttggggggagggaaggaagaactcaggtatgctcaaattatcaacaagaaaacccggaaaatttacattgttgatgagcactgtgatggataagtttccaggaagaaaaacttggttttcgcctgtgggccacagccatgcctgagatccgcctaatgggaatggagccggcaatttcctgctgccttgctttctccgccagcccctggcccacagtccagcctcagaaggctgaggggggtgcttcggtttcgtttcttttttctcaacgggtcgacattttaaatttctcagtatccaaggcattatgaggacttaggaaacagatgcatttaatctaattaaagcaaggacggcgagtgagtgaaaaattacattttcacttgggttctgaacattcagttgcacatccaagaataatgatgtttttaaagccagcccaataaacttgagattgcaagttttcagtggctcctggataagatgccacttcgatcatcctagacaatgtgccttttgaggagctgctcancagctttggggactctggataaaggcaaaccaggcttatgatttcttccttttgcctttcgtttcacagtagttcgcaggtttgagagtccatttcataggcctgtttcatgacaacatacgctcctaccgggtgatgggaggatttggcctctggatggtggatactcaagctctgggcgtttgcccgctgtgctagcctctgcggtgatgatgcggctcccgggaacatccagttcaattctcatcatccgtcgggctcccacgctggtctttgttatatcgtccatgcccgcgcgtaaggggcccatctattccttaccatatattcctcttcctctgcagttccgactttcccagcgtcaactgctttagtcatatatact

SEQ ID NO: 555613 - DNA, 621 bp, Homo sapiens
gcatgcagcgctgaggagcggcgaccagcacggcgggccatgaacctcctgccgtgtaaccctcacggataacgggctgctctacgccggcttcaatccaggaccacggatgcttgcgtgtgggatggaaaatggattccggcgccatgaacctccgtgccgtgtaaccctcacggcaaggggctgcatctacgccggcttcaaccaggagcacggatgctttgcgtgtgggatggaaaatggattccgagtctataacactgatccactaaaggaaaaagagaaacaagaatttctagaaggaggagatggcatgttgaaatgttatttcgctgcaactatttagctttagatgggtggtggaaaaaaggcgaaatacctcccaagaaagtaatgatctgggatgacctgaagaagaagacgtgttatggaaatcgaattttctacagaagtcgaaggcagtcacaagtgcgggaggatagaactggtggtggtcgaggactccaggattaacggtgttcacattccacacagcaatccccatcaggtgtgccacgtcttccgagacctgctgttaacccaaaggcctctgtgtcctgtgtccaatagtaacaatccctc

SEQ ID NO: 555614 - DNA, 344 bp, Homo sapiens
gcattccggcagctcacttatcctggcggagcaggtcagtgcatagagttctagtttcctgtggaaaatgtgcaccttgtgaaacctgcatgacagtcccctacggcagggtccccagcggatccgccgcagacgcaggcacagaagacaagtatcctccagcacgaagctggcctgcccgggcccaggtgtgagggactgttctgatcccagaagcgcacgatagacgcttacctctgcggtctcggcgcacgcgtctgtccctggacagacctcggagccgtgcccagactaacatgcatattgcggtggtaacaaggatacagttaaaagggtcaatcacg

SEQ ID NO: 555615 - DNA, 923 bp, Homo sapiens
taatgtcaggctgattaaaaagtgctggcttgtgggcagtcacacagttggtttccaatgaggagtaatttgacttggaacatcctgtccatggcaattaaaatttgtcatggcaaaaaaaacccacagctggcctgccacagccaacacaaaaaccagaaaatggtaatgaaatgaaggaataaaggtggggttaatcccttattataaaaaggaacaaaaaataattcttcagcagtcttacccaaagacttcaagatacaaaattccaatgtgtttggaccccagccctgtccccatctcctccaagagcagaggtaggaaacagttgaccgcaaacaagcaattctgtaaaaattacctaaaaaccctacaattttgattaaaatctaaccttctactaatttccggctctttcaaaaaattttactatcacaaaggcctgctttagatgacatgctattcctaccagaaaatagccccaaataccccctctgtcagataacattgctcaatgttgcccacgcaactcttatctctaaacctattgtggccacgtgtcgtctttctaaaccaaagcccccggagatcaagtgactgctagtaccgtgtcgcttggtaacataaattcccgtgggcgcccccttcctcccgaaggtgttggggccgcggcggaaacccccaaaagggtctttgaagggccttaattccccgaaataaccctcttaagaaaacactttctttggccctctctcatcacaagggaaatggtctattgttcaaaccccactaatttggttcccaatttgtggccccgaccggagaagtttcttccctgtgaaacacctgatttctccaacctcttctgttttggtcgttcctacaaaaaaaacatcgcgtgggtgtcaaacagccgcggcaga

SEQ ID NO: 555616 - DNA, 140 bp, Homo sapiens
tggacagctttataactgtagttacgcatatctgcacgaggcttgtgcccagcatatgcatacgatataagtaggtatcgttcattgcccgactcgatgaactgctggtgaacggtgatcatgatcgcagatcatgggga

SEQ ID NO: 555617 - DNA, 855 bp, Homo sapiens
  misc_feature (242)..(242): n is a, c, g, or t
gcttagacataggaggcgtttcgtggcgcggagcagctgggtatgtgtaattgcattgtatgctgtcatccttaggaacaggccatgttgcatgacatatgcgactgtggaattgcgtcaggccaaatgggaaatgccgcagggtcttgacacacactatgccgtctctggacacgaaaatcttctcgaggaatgaagagttggcatgactaagtcgttgtaaggttggggtagatcatatntgacccatgtgaggtctccaatgacgtaccttggtcgaaggttcacttcgatacgaggataaacgacctttgacaacgggcatagggttagtcataggcaccattagcatgggaattcggggtggaacatagctcgtgggacggtgatccacccctagggactcaataagggggatcagaggttacgcacattacatgggggctaactaggtggagctctggttcaacagcacttgcgactccattgcccttgaaccgcgtttttaccctatttcaagggcgtttcctcgtgcgcgcgaaaatagagtttcagtgcgatacaccacttgtagtcaggccttctcgcaatagtgagtatcgatcccctccccggtattatgggacggcatcccacctccatagggcctaatgtttggtgtcagtagtttcaattttgcggttgcgcctatgtaaggctcgagagttgcctatggggattggcgttaggcgcaatccccatagggattcacacccgttaccagtgtcttctcaccgtttccacaatgctccgacaagtacgctgccattatagcacgcgccaatttttgtggacgcgattgtcatcattacactc

SEQ ID NO: 555618 - DNA, 974 bp, Homo sapiens
  misc_feature (289)..(289): n is a, c, g, or t
  misc_feature (296)..(296): n is a, c, g, or t
  misc_feature (314)..(315): n is a, c, g, or t
  misc_feature (318)..(318): n is a, c, g, or t
  misc_feature (936)..(936): n is a, c, g, or t
tcccgcccggtgtaaaagagaacggcgccgacccgacagggccccgtgagaaggggaacccgccctctcggccaccaatgggcgcccttccaggccacctcatgcgaagtaaccccctgccaaaaatcgcaccggaacagagccaccccagggggaacggaccaagttctgcccccagacccactcctctagcacgtcacatctgtccgggccagccagagtgctatagatctctctaatgagttcccatgttgtaaaggagcgaattaaatccattaaaataggaganactaacntgatgggatgtggtaccnncancagcagctactagacattcttctacaaaaggagtcaagacatgggggcggatggtgaccatgatgtctcggaagtcgatggctgtgactctcccagtcctagcattgtcccgttgcacaaaggcttgctttgcgtgctccagttgtatttccaataaaaactgagtaaattccgcatatgtcaggtgtctttttctttcttttccaaaatgtagttgcacaaattctgaatcccagttaaatggaatatgttgatgaattgtggtctgtccaaaaacttgcttaacatcctcaaaagttacttctcctttgccagctttgtcaaacagctgaaaggctaccataaacaaagcatcaggggcacacaggacagattcaaaggcaacaaattcttgaaaagatattaatccatctttggtctgatccaccactccacttaaaagttccacagtctttggattaggctggctttctccaaaaatgttcaagtatcgagtgacaaagtcattgggggacatgaaaaattcaccgtttttctcaatgcttgcatacttcaaaaatattgttctaagctcagctggatctgctctcttggttaaagccaccttggcggccgccntgattcgccccggttgcggcagctcgtgcgctcgtgcc

SEQ ID NO: 555619 - DNA, 166 bp, Homo sapiens
  misc_feature (55)..(58): n is a, c, g, or t
ttacattgaggatcagtcatgtaaggataaaggataatgggggtataagtaactnnnntctttttctcttatctatgtacctcaattatacataattacgtaaatactaacgttgtatatctgctgtcaactagagtatgctagggttcttggcataacattccct

SEQ ID NO: 555620 - DNA, 338 bp, Homo sapiens
aaaaaacccccctttctttgtttttacttttgggagattccccccccccgggggcctttttggggggggggttttcccccgtgttttcccccctttttgaatttttccggggggcccggttttttttttaaaccccccggggggcctcttttttgggggcccccctttgggaaaatatcggtttttccctttttttttgggggggggggggggggcccccccttttttttggttgggggcgtctcccccggggatttttttaaacgttttttttcccccgtttttttttttttttttttttttttttggccctaaatttttggggggcccccccaata

SEQ ID NO: 555621 - DNA, 174 bp, Homo sapiens
ctagacactcttcccccgtgagtacttatcctctaggtctcaacttagtataacctccttcaagagaccccactccctgggccattttttaaattatggtaaaatggacaaagcataaaatttaccattttaactacttttattttatttatttttttgagacaaagggaaaca

SEQ ID NO: 555622 - DNA, 574 bp, Homo sapiens
  misc_feature (536)..(536): n is a, c, g, or t
tgctaggattataggtgtgagccaccgtgcccggccataccattttaactttttaagagctagacccaccaataaaaactgagtaaattccgcatatgtcaggtgtctttttctttcttttccaaaatgtagttgcacaaattctgaatcccagttaaatggaatatgttgatgaattgtggtctgtccaaaaacttgcttaacatcctcaaaagttacttctcctttgccagctttgtcaaacagctgaaaggctaccataaacaaagcatcaggggcacacaggacagattcaaaggcaacaaattcttgaaaagatattaatccatctttggtctgatccaccactccacttaaaagttccacagtctttggattaggctggctttctccaaaaatgttcaagtatcgagtgacaaagtcattgggggacatgaaaaattcaccgtttttctcaatgcttgcatacttcaaaaatattgttctaagctcagctggatctgctctcttggttaaagccaccttggcggccgccntgattcgccccggttgcggcagctcgtgcgctcgtgcc

SEQ ID NO: 555623 - DNA, 879 bp, Homo sapiens
  misc_feature (841)..(841): n is a, c, g, or t
gtgtgtcatacctggcggagcggggatgtttagaacaaggtccttcatgtaccattctgaaccaccatcttgtgcagcagctctggccgcaaactactccatgggaacaacgtgaagacaagaagtatagggtgcataagtaacttctgtgtgtaggcagattattcgcttcttcgttctatcagtggaaagcactactgatgatgcaggaaagaaacagaagtcctgtctggctctcacatgctatgactctatgaaaacagtcatgccacatctccctcaccttaaaactaaatcagagtatcaaaactactaagccagaaacttgttttttttcgaataggaagatgtttgaactggagctccaaaacattgaagtatctttactaaaagggatatactatcttctataaagaatttccatacactttattttgttcctagaaaaaaaaaaaagaaaatgctcacacaagtccacacttacacagacgtgcacagaagcatgctccttactcaaaagttacttctcctttgccagctttgtcaaacagctgaaaggctaccataaacaaagcatcaggggcacacaggacagattcaaaggcaacaaattcttgaaaagatattaatccatctttggtctgatccaccactccacttaaaagttccacagtctttggattaggctggctttctccaaaaatgttcaagtatcgagtgacaaagtcattgggggacatgaaaaattcaccgtttttctcaatgcttgcatacttcaaaaatattgttctaagctcagctggatctgctctcttggttaaagccaccttggcggccgccntgattcgccccggttgcggcagctcgtgcgctcgtgcc

SEQ ID NO: 555624 - DNA, 370 bp, Homo sapiens
  misc_feature (8)..(8): n is a, c, g, or t
aggtaagnaaattggtaacttgggaaaatggcaaaaaaggtgtaaggggggaaaaataagtgtcagtattcaacactgggtacattaggtactgattatcttttctattctcagttgaaaatacttaagatttgctttataaataccacaattatcttaacactcttcagagcttatgacccatatgacctcatctctaatttcatacaaaatctccataagctgtataccatataatgaaagaatcagacaaatagtgtaaatgtgtattttaagtattctaagcaagaaaaagagagttgaaaaagtgtatgtttctcaaaaggtaaaaatatgtgaatacagagaaaacactctgaagtatttatgt

SEQ ID NO: 555625 - DNA, 990 bp, Homo sapiens
  misc_feature (1)..(1): n is a, c, g, or t
  misc_feature (952)..(952): n is a, c, g, or t
ntgccttagagcatctaagaagattagcaaaaatcagcccttgatatacttcaaaatctaaaacaaaattaacatgagatcacaaatctgtttttccttttatctttaaaaagctaatgtatttctcgaagatattccgtattacccagacaacaaattaacctacccactaaaactagccaaaacacactctttgtttgagtttagtaatgtatgtgatcacattaaaatgttagtgtttgcaacagaaaaaaaacactacataacttataagaattgtttttataattccttatttactgagttaaaccacttcattagggcaagttacaacttacagctactagacattcttctacaaaaggagtcaagacatgggggcggatggtgaccatgatgtctcggaagtcgatggctgtgactctcccagtcctagcattgtcccgttgcacaaaggcttgctttgcgtgctccagttgtatttccaataaaaactgagtaaattccgcatatgtcaggtgtctttttctttcttttccaaaatgtagttgcacaaattctgaatcccagttaaatggaatatgttgatgaattgtggtctgtccaaaaacttgcttaacatcctcaaaagttacttctcctttgccagctttgtcaaacagctgaaaggctaccataaacaaagcatcaggggcacacaggacagattcaaaggcaacaaattcttgaaaagatattaatccatctttggtctgatccaccactccacttaaaagttccacagtctttggattaggctggctttctccaaaaatgttcaagtatcgagtgacaaagtcattgggggacatgaaaaattcaccgtttttctcaatgcttgcatacttcaaaaatattgttctaagctcagctggatctgctctcttggttaaagccaccttggcggccgccntgattcgccccggttgcggcagctcgtgcgctcgtgcc

SEQ ID NO: 555626 - DNA, 332 bp, Homo sapiens
  misc_feature (170)..(170): n is a, c, g, or t
  misc_feature (254)..(254): n is a, c, g, or t
  misc_feature (261)..(261): n is a, c, g, or t
tcccagtccactgcagccagtgctgaatgaaccctgcccagaggtgtctgtagtgagcttctgccctagtgacttttgagccggccaggttgcagcgcggacacactcgcaggtcgctggggccccatcctaagcctaacttacactaaacaacatttaacaacacaaancaccatatcttataaaacacttacttaaatacgtgctacgaaagcaggcacctacccccctagatttttacgccaatctaccanaaataantttaaaattacaacacaataacctcccaaaatataagcacctatttaagtatacggaatgggcccaacatt

SEQ ID NO: 555627 - DNA, 551 bp, Homo sapiens
agaagaagtcaattgacaacagctagaacatctaggtcaggcactccaggccgacacgacaaagcaggtgcaaaggccccagggcgggaaccagcgtggcttgttcacagaacaaggaggtagatcgcttgcccttgggaccaaaggaaggctctggattttattctaggggcagtggaagccgttggagggcctcaggcaggaacacaaggtgtcgtggcagaaaggaagaaggggccgggcacggtggcccacgcccatcatcccggcactttgggagggaggccaaggcaggaggatcgcttcaatccaggagttcaagatcagcctgggcaacacggcaagaccccgtctctactaaaaccctaaaacttagccaggcttggtggcatgtgcctaaggtcccaggtcctcgggagactgaggcgggaggattgcttgagcccaagagtttgaggctgcagtgaactattatcacaccactgcactcagcctgggtgacagagtgactctgtctcaaaactaaataaataaacaataattgtgttaaa

SEQ ID NO: 555628 - DNA, 238 bp, Homo sapiens
  misc_feature (141)..(141): n is a, c, g, or t
ccggaccatatagacatcgttgaggatttgccctatgttcatcaggatatcagtctgtagttttctctttctgttatgtccctccctggtatgggtgttagggtgatactggcttcatacaatggtttaggcaaggatccnctctttttctgtctttcagatatagtgtcaatatggttgggtaccaatttctttttgtgaatgtctgtatagaatttatctggtgagtcgtgtctgg

SEQ ID NO: 555629 - DNA, 874 bp, Homo sapiens
  misc_feature (1)..(1): n is a, c, g, or t
  misc_feature (836)..(836): n is a, c, g, or t
ntgccttagagcatctaagaagattagcaaaaatcagcccttgatatacttcaaaatctaaaacaaaattaacatgagatcacaaatctgtttttccttttatctttaaaaagctaatgtatttctcgaagatattccgtattacccagacaacaaattaacctacccactaaaactagccaaaacacactctttgtttgagtttagtaatgtatgtgatcacattaaaatgttagtgtttgcaacagaaaaaaaacactacataacttataagaattgtttttataattccttatttactgagttaaaccacttcattagggcaagttacaacttacagctactagacattcttctacaaaaggagtcaagacatgggggcggatggtgaccatgatgtctcggaagtcgatggctgtgactctcccagtcctagcattgtcccgttgcacaaaggcttgctttgcgtgctccagttgtatttccaataaaaactgagtaaattccgcatatgtcaggtgtctttttctttcttttccaaaatgtagttgcacaaattctgaatcccagttaaatggaatatgttgatgaattgtggtctgtccaaaaacttgcttaacatcctccatctttggtctgatccaccactccacttaaaagttccacagtctttggattaggctggctttctccaaaaatgttcaagtatcgagtgacaaagtcattgggggacatgaaaaattcaccgtttttctcaatgcttgcatacttcaaaaatattgttctaagctcagctggatctgctctcttggttaaagccaccttggcggccgccntgattcgccccggttgcggcagctcgtgcgctcgtgcc

SEQ ID NO: 555630 - DNA, 349 bp, Homo sapiens
tatcgccctaagtggctcccccattctcggcccacggcttctctgctaagatgctcccattctttggatcggcatctatcataaaatttctcgaatcatgtgcccatcgtacttacgataagagtccttgagggtgtgcactgtgtattatctaacccctgtcattcgctggactgggggcagatgttagcatcaatcaggcttttcataactcacttgccaaaacaaaaaatatcagcctaaaaattatgaactaaaaaataacgactagaaaaaatgcactgtatgtcccattttgctgccgaatgaattcacatgagaacctactaaagatgctagataaactata

SEQ ID NO: 555631 - DNA, 125 bp, Homo sapiens
  misc_feature (107)..(107): n is a, c, g, or t
gaggatcgcatggagaccaggctgaggatcaggtggtgtcgctagattgggaccttcttggctcaggtgatggatcaggtggtctcccgtaggtcaggaccctcttnggccagtgaagaataagt

SEQ ID NO: 555632 - DNA, 98 bp, Homo sapiens
  misc_feature (67)..(67): n is a, c, g, or t
tcgatacgacttttcggtcacctctgcgaaagatcagtcccactccccctcccccttctgtcgtctntagcagccgtatagtagtagtaggcggccgc

SEQ ID NO: 555633 - DNA, 187 bp, Homo sapiens
aatctacacatagccattagttactactaacccttaaaaaaagaaacaggaaaagaaaggcgcaataaactagatcaggtacagaaattatagctactatacttcactacaaaagcagtctatacagtatcatatgaccttagattatgaaaacaatccagaataaaaatctttagatgacataagc

SEQ ID NO: 555634 - DNA, 294 bp, Homo sapiens
aacaggtggaagctgttgagttggaggctaagagtctcaaaattatttcaaggtgtctgtccttctaattgagttatggtgaatggttgcatggatttgaaaaaaggcaaagatgtatggctggacttcagggtcagaggaggttaaggttctagagcacaagttgaaagagctgatgaaatgcacacattgttacagctagagtgtgaaaatacaaatccgtcctcagaacagtaggaatgattttatctacatttgattacttaatcatacctctcctcatggctaatagtt

SEQ ID NO: 555635 - DNA, 988 bp, Homo sapiens
  misc_feature (570)..(570): n is a, c, g, or t
  misc_feature (654)..(654): n is a, c, g, or t
  misc_feature (767)..(767): n is a, c, g, or t
  misc_feature (900)..(900): n is a, c, g, or t
  misc_feature (988)..(988): n is a, c, g, or t
ggaggcaaaagaggcgggccaaaaggaggggaccgggagggaagaagcaaagggaagaggggaggcagcaggcggcggcgccgcgggaggagggggcggcgcggcaggcggcggggcaggggcggggggcgggggagcggcggccggggggcccaccagaggcggcggcggcggcggaacaccaacagcagccggcgggccgggcggaccgaccacaggcgtcgggccggcaaccgccgccggcgcagcggagggggcggggagggccgcggcggcagcagcggccggagccacccggagcgggggaggccgggccgggcgaagaagggggggccggcgcaggggcggggcagagggggggagcggcaacaggaggcgcaaggggggcagggggggcggcgggaggacgcggcgagggagcggcgggcggggggcgcgaagggcgcgggggagcgcggggcggggcaagaggcggcgaagagcgggaggaagcagcgggggcaggggaagaggggagggacgcgggagggaagcggcgggacgccaagggccggacaaggcagcgaacgnccggaaagcacgggcaggccaaaggcagaaacggcccacaggcccaccaggagcaagcggcaaaaggggcagcgggcggacagnaagcagaggaaggccagggagggggcggaaggccgggaggagaccaggagccgcaggagagaggaggcacgggccccggcgcgggagacggcgacgggggcgcagggggccgnggccagcccgcaggcgcggagaggcagagaccggggggagagcaggccaggcgggaaggggcggaagggagcaaaacagcggccgggggcggcggggagccggcaacgggagcggcaacgaccaaaggaaggncaggaacggccgcaagacgaggaccgggagacaggaccagggcggggagggcggaggcagccagggcagaacagagggcggagcgggn

SEQ ID NO: 555636 - DNA, 859 bp, Homo sapiens
agcggaactttgagaccagcctgggtgacataatgagaccccaagtctacagaaaaaaaaaaaaaaagacggaaaataacacagataggtgagcaagtctaaaaaaattttctgtgcctatttcagtctcagtttttttctgatagaaagtcagtactacagtatgtccatacaatatattggtatagattgaaaatgtccttgatgacatttacaggcatacctccctttattgcacttcactttatggtgctttgcaggctgttttttacaaaattgtggcaagcctgcatttgagcgggtctaccggtgccgttttcccaagagcattgtgctcactttgcgtccctctgttacattttggggaattattttacaatatttcaaacgttttcattattattcatatctggtaatgggggatctacgatcagggctctttggacgttactatggtcttggtttgggggtgccacaatccacatccacttaagatggtgaacttaataaatggtcgtgagtcgtgggtcagactggtccacttgaccagtggttcctccatctctctccctctccttgggcctccctaattccttgagacacaacaattttgaaattaataacattaccatgtcctctaagtaacgctgaaccgcgacattgtgtcctatgtctgactcttactttaaactcaaaagcaagaaagtgcttgaaccttaggaagcacttgttgaaagccaagaacggctgaaactgaggttcctgggcaaacagccgctgattgaatgccaagacatttctaacagggaacttcaacaatgctactcccagggccaacgttggtgggtcacacgttata

SEQ ID NO: 555637 - DNA, 418 bp, Homo sapiens
gagaacgcgagcccgtggcaccaagtgggagaagacggatgcagctgtcgaaatgaatcggattaaccgagagcagttctgggagcaggccaagaaggaagaacgagctgcggaaggaggaggagcggaagaaggccctggactagcaggctcaggttcgagcaggagcggatggagcaggagcggcagcgagcaagaggagcgctgagcgtgctgctaccgggagcgggagcagtcagatcgaggatgcacaaggaggaatacagcagactttagaagcggacgcaggccaagtaggcggttgaacggagcagtctatcttctggtgaccatcgggactgacggaggaagagacccaccattgaacgaagtccagagtcggaggtggaggacggcccagtcagctatcattgcccca

SEQ ID NO: 555638 - DNA, 1015 bp, Homo sapiens
tgaatcgcgactgggcatacctattgactcttatggcgagtgcaatgatagtgctaggttatatacatactgtgacactcagacccaaggtggggttagagtgctcacgtatcgagggggaactcaaaagccacatctcgggtagagcagacacgactaaaattagctcattcacgcgaaggatgcccccttaagaagcccgacacacagtctatcagtcatggctctacatctggcgactccgaacttagacatctgcaccaatcgctcgtgtctactatgagacccacccctactccatatgcaagcccctgggatagagtctgccaagcttatgagcccatgctctgaatagtaattcataggtccatccgtctgagacgcataagacacgcccatatcatcacagtaatctggatcgaaggcatgaaaggatcaaaggatcaaatgcataacgacgcctgaaattctgtgagcgatcaatgtgagacgatgatatgccctgatggaattgcttcaatatgaaggtcacgcgctaagcgcgatcagtgtctacgtgatcgaacgagtatacgtaataacgtggctccatttaagctgctccatctcttatcgaaagacaagaaacatctctgattactccgtgtcatcatgacgctgtgggccatagataatgatgtagctccgacagtagcagagacaaactgaagcccccttgacttggcgaaggggagtcggagctagtgctcaagatctcaacatggaagtacgccgaggccccttcgacctaaacttagtagcgaatacaccaagattaatataataaaaccttacgataaaagttgcctaggacaaaatatgaggctttccccggatataaaatatgtgtggcgcacctgagtaacgcgggttagatcagaagaaccgagcgctagaaaaaaacctgaaaaaacaaccactctatataggcgccgatcacgctccaaaaaaagtgggagggcgcgttgctttcttt

SEQ ID NO: 555639 - DNA, 850 bp, Homo sapiens
cccaaaatctggggaaaataaaattggggaaccactctttgtgtttcttttttataaaatagaaggcccaaaatggtgatacactctgaaaataattttgtgggcggtgtatgggttttaaaaattgggaatatgtgttcttcctgggggaccctgttaataactggagttgtgtgtttgccacaaattatgccctctccgggggaaactcgcgaggggttttggtgtgagattttacacacgagacacccactttaagcccccaagaggcccgctggggggaaaaaccctctcttctcacaggctccccacgggggggtttggtcacagggccaccccaccgtataaccacgtggcccttgccttgtttaacacacttcacctttttatcgcacagctttgtggtgttaattttacacactcgggcacctgttgttaatgtggagatttggccacttgagccaccacgggggttttggagagtgttctgctctttttgttgtgtctgtgtctgttctgttgtttcgcggggagactcgggggaacttcctctccccaagagtgtcaccactttgtgagcacttctgtttcttcttcctgagactcgccactttagagaaaacacagtgtaacacggtgaaaatggtggttctcacgtggttaaacgggataatttctgctaaccggcttcctccctgatgagttttgaaaaaacacctactgtaacgaagcttctggctggtcctcttttatcctggaagtggtttttctgtgtagccatatccctgatagtcccctttggaaaaaagtactcttcctcctaaccaggaaaactttaatccctcggccc

SEQ ID NO: 555640 - DNA, 153 bp, Homo sapiens
cgattcactgaagaataaatagaactcagaggcacaagctagttctgagtgtgcagataatggttctgcagctgggggaagcaactcacccgccgtggagtacaagcgtggcggtggagtacaacctgccggtggagtacaacctgccggtgg

SEQ ID NO: 555641 - DNA, 1385 bp, Homo sapiens
aactgggtaaaccgcacaaccttttgtacctttacttacgacgtaacacgtgtacactgacgtacctgtggaaacccaaatttggacatactgcaacacttcgtacggacgttacctacggttacgacaacttacgtccataccattccactacacgcctgactgacgcttcgacaacttgcaggttggacgacacgtggaacttacagccttaccagtcccttttgtctcacgactacccttacaacacgttaccttctactttacaacacggccatttactatacagtctatacgtccttgacacacttcaacacattactacgacttacctcttggcctcacggctctcacactacccttttactaacgcgacgggtggtcaccacactgtacgcgggtacccaacggcgtccggcactcggtcgactcgggcgcctgggcctcgtaccaccttggcttccttggtcgccaccggggtcgctgaactcgtgacacacggcactgggtaactctcctaacggcgtacgggccgtctgtaaggactctcacccctacactcgcacgacaatacttccctacataccgaccttgaacgtgacacacactccgaacgtcaaactcatcatacggggccatttccaccaagacggtccccctggttgcacgtcccttcgggtcccctcgttgacacacacgggcctcggtcccctccaggacacatccccttggcgtcccccttgtgtcacccccaacatcctttccaaggcccacacccctcagggaactctcagtgcccccccacaacaggcctgacccgcctcacctaccccaatcgactcctcaagataaccccgcggggataccgcacaaatcaacctcacgcacgggttccaatcacagcaacccgtggccaccaactcacagcccaggcgagttacgaacggtcgcgaaataccagcggcaaggacgcacgcctgactcgcgctgcgaatcacacgaccacacatggctaggggcccgaccccacgtccagaaccggtacgcgaccgccgtccaaaacctgggcgctgtaaccacaagacctcgctgctcccgcaccggtgaagaaaaccataagacccgtcccggaccgaccgggccccccaacaacgagacgccagagacaccacacggcacaacagcaggccccacacgcaccgaccacccctcaaaagggaaccctgtccaagacaacaacctgcccaaccacgcgcgacaacacactcgacaccgcacaacccgacaactacgacacgagccacaagtccaccgcccaccaagaggacccgcacactgcaactgaccagaacctagaccgtcacacagcagatccgagaaaacgc

SEQ ID NO: 555642 - DNA, 358 bp, Homo sapiens
agaatttagtagaagcaggtatacttctatcattttgatgtttttgttaatgtttccaaacaatgtactttgaaatcagaatcacttcttatcgttttcatatacttctgatgcttttcatcacattagtgatcagaaatgaggtgtaattccccaccccctgcccgcaggagttaagtaggattttactgtaagttgaagggagttttgccctaacttatgggttgtggatgcatgagtgtttgttgggtttgattggctgtcgatggattgtggtttggtgtctttgttggcttttttatgctcctttgtatgattattaagattcttccttgttttagttgtgtgaaccctctaa

SEQ ID NO: 555643 - DNA, 321 bp, Homo sapiens
  misc_feature (1)..(1): n is a, c, g, or t
ntagccgtcctatatatccccaccactagaaaatcattgatgaaatatatcacattatggaagaaaaaacatatatatcatctcaagctgatgcaaaaaatatatttgacaaaattcagcactctatcgagaaaaacctttagaaaactttaagaaaatttggctgggcgtggtggctcacacctgtaatcccagcacttggagaggccaaggtgggtggatcaattgaggtcaagagtttgagatcagtctgaccaacatggtgaaaccccgtctctactgaaaatacaaaaattagccaggtgtggtgttgggcgataa

SEQ ID NO: 555644 - DNA, 420 bp, Homo sapiens
  misc_feature (279)..(279): n is a, c, g, or t
  misc_feature (305)..(305): n is a, c, g, or t
  misc_feature (346)..(346): n is a, c, g, or t
  misc_feature (349)..(349): n is a, c, g, or t
  misc_feature (356)..(356): n is a, c, g, or t
  misc_feature (361)..(361): n is a, c, g, or t
  misc_feature (366)..(366): n is a, c, g, or t
  misc_feature (384)..(384): n is a, c, g, or t
tgggtggatcacctgaggtcaggagttcgagactagcctggccaacatggtgaagccccatctgtactaaaaattcaaaaattagccgagtgtggtggtgggcacccgtaatcctagctactcaggaggctgaggcaggacaatcactagaacctgggacgtggaagttacagtgagccgacatcactccactgcactctagcctgggcaacaagagtgagactccatctcaaaaaaaaaaaaaaaacaaaaaaaacacacaaaaaacctaattgtggngggatgaagaggattcccagcaaaancaaaaaacaaaacactacactacttgtgaaagaaagggtantantggtgtntgacntggtncacccggaactattattnacatagttattttaagggcaaatagtattcccccca

SEQ ID NO: 555645 - DNA, 443 bp, Homo sapiens
gaattcggcacgaggggactaggttttgctatgttgcccaggctggccttaaactcctggcctcaaggtgatccttctgtcttggcctcccgagtagctgggactagaggtgtgcaccgtcacacccagcttcaagtctcttattataaagttctggccacgcacagtggctcgcaactgtaatctcagcactttcggaggccaaggcggtcagatcacctgaggtcaggagtttgagaccagtctggccaacatggagaaactccgtctctactaaaaatacaagaattagctgggcatggtggcacacgcctttagtcccagctactcgggaggctgaggcaagagaattgcttgaacctgggaggcagaggttgcagtgaaccaagatcaagccatttgcactccagcctgggcaacacagtgagactccgtctcaaaaa

SEQ ID NO: 555646 - DNA, 613 bp, Homo sapiens
ggtggcacacacctgtaatcccaggtactcaggagactgaggcagtagaatcacttgaacctggaagatggaggttgcagtgagccaagatcacaccactgcactccagcatgggtgacagagtgagactccgtctcaaaaataataataataatagagttgtagctgggtgcagtggctcaagcctgtaatgccagcacttcagagcctgaggtgggaggattgcttgagccctggagtttgagaccagcctggaccacatggtagaccccatccctacaaaaaaaaaaaagtcgggtgtggtggcacacgccttgtagttcccagtttactcaaaaggctgaagtgggaggatccctagcccaggaggtcaaggctgcagtgagccatgatggcaccactgcaatcttggggtgacaaagactctgtttaaaaaaaaaaaaaggtgtcgggggttaaaagttatcctcaaggagggtcctattctccagtagaagaaccctttttttctactaacctgacgaatggcgagtttaactaactgttgctcgctgcatagagtatgcggagataaggacctaggttgcacctacctgtgagaactgtcgtcaag

SEQ ID NO: 555647 - DNA, 1366 bp, Homo sapiens
  misc_feature (1366)..(1366): n is a, c, g, or t
tgcgctccctgggtggcaagatggtggcgcgcaggaggaagtgcgccggcgcggggacccgtgaggaacctgtatccccagcccactgggctacgcagctattccaatcaagttctctgaaaatgcaacagtgcttctcacgtaccatctattgtgacgagcacacgtgcgtccgagcaatggcaccagagtccaacctggaccatcaagacagatggacatactttcaaaggtacctcaaaatggttgacccaccaattactggcagacaagaagtcgagaagccactgttcaccgcacatcctgtgtccaccatgtgggaccatacgtaccagtgcagtcagaagttagcacggagaaagccgggaacctgggcttgagaagccccaggacggagtacaaagggaccgcaaagtaacaaagacatcccacaagagccaggtaccggggtatacccacgggtacgacataatagtaggaaggacccaggcaaaggccccagcgctggagagatgtcaaagaccgggcccatatgagccaccgtcgaaaagcggccccccaccatggccatggcgatagtaccacacagaggatagaacggccaacacccattgggttggaacagcaagatggggcaatattccacacaaaagtgtgagacatcagagtgtgaacctaaccgccaaggacccttctcttggttgccccccgagaacccactatgaagtggcaccactatgtacagcgcagctgggcgaactcgttgggaaccaaacagttatcacacttagggacaaggggagccaaacatcatgtgtacatccaaggaaaaagacaatcacgacacagtaaaagagacaaagcgaaagcgaactaaatgcggacgccacaaagaggtgaaagggaaaaagtacaagcgggagagaactaccccgatggaaacccgacacagacatagcagaccgcacatgtgcaagatgaaagaatagagagtggacacccactacatgtgagatgacaccgacaggatagcacagagtgagggctacccccacggaggaacaccaacagagacaacgcgcaacccaacacaacgaaaacaggacagcagaaacacaccatacagaacgaaaaacggagaaagacatcacaagagagaacgaacggacagaacaccgtgaaacaaacagaaaggcaagacggacggcaacaacaggatgtaacgaaacaccaccatgtgcgcagcaaccacaaccaagagaaggaagaacgaacgaacccacagaaaccaacgagagaaaacagaacataacagccggcgagcaaagtagccggagcacaggaaaagaagactgaagaagcagan

SEQ ID NO: 555648 - DNA, 221 bp, Homo sapiens
gctccaattacaagcacacgaaggaaggatccatcacctccaccaggatctcgatcagacacgggctcgtactcatgccacacaacatgatcacactgacttctgagtaaggagtctaggcagagaacgctgcagccgtttctacaagagcagccagagatctccgtgcttaggtgctgtattttactccaggattgcggatccaagataaacccaccaga

SEQ ID NO: 555649 - DNA, 367 bp, Homo sapiens
acggttcactgagttgttatgctgaaccgtcctagtgacaattattttaaaagagggccagaggctgatgcaggagaatcgcttgaacctgggaagcgaaggttgcagtgagccgagatcgcgccactgtactccagcatggggacagagcgagactcgtctcaaaaaacaaaaacacacatacaaatacaaaattagccgggccgggcatggtggcgcatgcttgtaatcccagctacacaggaggctgaggcaggagaatcgcttgaacccgggaggtggaggttgcagtgagccgagatcacgtcagtgcactccagcaatgggtgacagagcaagactcattctccaaaaaaaacggagataa

SEQ ID NO: 555650 - DNA, 368 bp, Homo sapiens
tgaacattcgtgtcctttcgtacagggaggaatttgaagtaaattgaaaccgacctggcattactccggtctgaactcattatcatgtatgactttaatcgttgaacaaacgaacctttaatagcgcctgcaccatcgggatttcctgttccaacatcgatgtcgtaaacaccctattgttgttatgaaactctagaatatgattgcgctgttatccctacgtgtgatctcattccgttggtcaatattattagtatcaattgaatataatatattcgctttgactggtgaactcttagcatttactgctcgtacgttgggttctgctcctaggtcgtaccgaccgaaattttttatgcatgtttgtt

SEQ ID NO: 555651 - DNA, 386 bp, Homo sapiens
agttatattcacgagggacatccaacttccgccaggctcggtagttttttcgcctcaacctataaatcttcccattattttgctacatacgcgggtgttctatttaacctgttcttaggtagctggtctggtttcggggttctaagctttggctctcctggcaaagtttttcatagttaacacattacgcagaaggtatagggtttagcccttgttatattaggctcggcaatattttttcctctttcccacacggttatatatgtattgccacagatctctatctctatcgcctagacttcatttgggtaaatggtttgtctaagcttctcgagtaataagttagagtgtgtttgctatttcaaatcaggcacgctctcgtgcca

SEQ ID NO: 555652 - DNA, 879 bp, Homo sapiens
tcctgagtgtcgcgtggatgtaaaacccatttcacaagaagaagattgagagtgagagagccctcatcagccagtgtggaaaaacagtggtaaatgtcagctacaggccagcttatgaccagataatctgaacaccagaggaaatcaaaaagatactagagggcttcatgtttctgtaaactaggtggcccagttgaaatccttcccttcctctatccttggaagtgcctaccatgcatcacaaggtgcgagattcctcgcacagaccgtgcacagtcatcagcgccgtgctgagatgtctcccgacggactcgtccggagggcctagtcagtgacccacgctagcaactatcaatatggatccctgtggaagactaggctaacacggatgaaattagttcccatgtttctaacgaagcaatagacttcattgactgtgtcagggaaaagggaggcacaggtcctaggtccaacggtgaggctggggatctcccgattacacctccaccatctagcatggcttatcttatgaagatcaagcagttccgcctgaaggaggccttcgatgacatcaggcagaggaggaacatggtctcgcccaagtttggcttcatgggccagctcctgcagtacgaatctcagaaattcgggggtgtccaaagggactaatgctgcgaggcccccctatcgtgcctaagggggaagcagacactgtcttcactgatcgggcgattccgcgacagtcgagcactggaggttctgggtggctactggacataccctgcctagatgccggcacccggtgctaaccaatcaagagcccagagatcagaaaggccttgtgaacagccatcgggtcacagggtggagaacggccgc

SEQ ID NO: 555653 - DNA, 802 bp, Homo sapiens
aactaaccccgctaataaaattaattaagccactcattcatcgacctccccaccccatccaacatctccggatgatgaaagcattcggtctcacctccttggcgcctgcctgatcctccaaatcaccacaggactattcctagccatgtcactactcatgcagaacgactcctcaagcacgccgcttattgcgatcgaactcgcccctacatacagctgcggaggacgatagaagttgagtgggcgtgagatcagtccgcgtgagccgtgtcgacgcacacatggcgcctcaagtattcatttaatcgtgtccactctctcctacaccatcgggccgaggtcctaatgttatcggaatcattgctactactcacgaaacctgagacatcggcattatcctcctgcttgcaactatagcaacagccttcataggctatgtcctcccgtgaggccaatatatcatgctgaggggccacagtagattacaaacttactatcctgccatccctagtacatgggacagacctagttcaatgaatctgaaggaggctactcacgtagagcagtcccagccctcacacgatgctttaccttatcacttcatcttgccctgtcagttattgcagccctagcagcactccatgctcctattcttgcacgagaagcgggatcaaacaacgcgcctaggaatcacctcccattccgataaagtcaccttccagccttactacacaatcgaaagacgccctcggttagtgctcttccttctctccttaatgaattaagatattctcaacagact

SEQ ID NO: 555654 - DNA, 1010 bp, Homo sapiens
gggtcaattctattttatgggttctgaggagggaggattcacccaggggattcctttttccctatacacttctccccttcccccaaatattgtgaggcttctcttcccaactatacgtgccatatttcagcatttcttctatattcttaaccctctccttctcccctttcatacttctccatatatacatactccttacccgcgtgggccgaggcgagttcaccccgagaggggccgagggcccttcgagcctgtgtgtgcggcggcgggtgtgtgtgccgtggagccacccagaggcagagagggggaggcgtggagcccgcgggcgcccgagcctctctctccaggtgtcctgtgaggcgcagggacacacacagcggtgtaacacagaggggtgtgacgccatttcagagagagagcgctctctctgtggcggtgtgccctctctctgtgggcccgtgtgtgtggcgcagagattctcccacacgcgctctcccgagcggcgtgcgcgcaggcgagcgacaaacgagcggggggtccccgccaccgcgagggcgcaaacccccgaggggagccgacacacgacacacagggagaccaccacgtctcgagccagggcgtgcgcgcctccactcgtgggcgcgagcggtcctcgaggggccaacgcgcccatatatgtgggcgcgtgaaccctcgtgggttcagcgtccacgcgtcgcgcccatctgtggccccgcgcgcacacggcgcccttgtgcgggcgcgcagtgcgtctcccggcgtgcccgtgcccgcgtgcgcccacaccacacacgtggtggccggagtggtttccccccgccccacatgtggtgcgccgccagcgtaagcacccgcggccgcacacgcgggtgtggagaaggggagacctccccgtacacacgcgtgtggaccacacaagcgtgggcacaaaagccgcggcgaaaagtcccccgcggcgaacacccgttttgttctcgccccacgcgcac

SEQ ID NO: 555655 - DNA, 103 bp, Homo sapiens
tcaagcttctaacgatgtacggggacatggctctcccccctagcccgggagaccaggggccttcctcttcctctgcttttatttaataaaaactaaaaccaga

SEQ ID NO: 555656 - DNA, 156 bp, Homo sapiens
cccgaggctagcaatgatagcttgtggggtggggagcagcatcaccagcccacgagatttgacgtgggcttggtctacggccagcagtggaacatggaggcagcatgagttagcagcaggcacacgtacactgctattgaaacttctaaaactagg

SEQ ID NO: 555657 - DNA, 436 bp, Homo sapiens
  misc_feature (33)..(33): n is a, c, g, or t
cgagctcggtttcccgccagttacaacagctgnacaacagctggtgggtgacttgcgccttgccgatagcacggtcaagtttggggatagcgatgcgttctatcaacttgacctcaagagcttgtcgggccaaggcacttttgtcatgggcactgatttcgctcagggcctggcggacttcctgaatattacgggtgacgcaaccggccatcacgacctgttgcttaccagcagcggtacagaaccggtaaacccaggtgatgtgcatatcgttcacacgggtggcggtgacgcacagtttgcgctggtaggcggtaatgtggatgttgaggcctggtcctatggcctccagcaagacggtaatgattcggtccttgacccgaataatcgcactgacagcccaggcacgcggtcggtattggccttgttcaacact

SEQ ID NO: 555658 - DNA, 857 bp, Homo sapiens
acgctgtgacgcggtggacgtcggaggcagcggggagcggatcgtggtccgccgggtcctctccagggagcgtagaggcagcagttgggaccccccgccgccggacgtcggatcgaagaacgcaggaatggggccggggaggaactctgcacacacacagtggttccggggacagcgagcgcattgaagccatcaataagagcgatgaggaggaatcctatccaccctactatcactcgagtcctgtcgtggtgatactagagaggtgaccgatacatgatcggtataaccatctcgaattgtcatctaagggtcatattcccgaagcagagagagagagtatctaatgtagactcactagagtcgaacatccgcaagggaccactgaaggaggatcactaatattagctgtgaagtttcctggtgtgccgactcttaagagctcggatgtgtggcggaagcgatcattcgcttgccttcctccatgctcagaggtggcatatctttccgtgtagcgcaatgattctttccaactgcgtacaacggatgcgcgcagcacaaaattggcgcatgacttgtgctttacaacagctggcttcatagtagggacctgtgacgtggtgagcgttgggcatccgagaacttacatgtcgtagacccatcaatagtgcctggatgaatcatatcatagaccccggattctggaactcaagcgagtgaggctgagccaactggtcttggagaacctacgacggaggtactggcaagctcgcgagccccgtgtgtctcacctggagagtacacgggggggcgccgccgggtgcagcggtcagcgtgcgaagcccggtctggccctt

SEQ ID NO: 555659 - DNA, 150 bp, Homo sapiens
cgagtctcatctgggacaagaatctaaagtttgtgatgcttcacaaactggagcagttcaatggggaagtgcactcatacgatctgggtatgaaccacctgggagacatgaccagggaagaagtgatgtctttgatgagttccctgagag

SEQ ID NO: 555660 - DNA, 178 bp, Homo sapiens
tagtgagttaggtctgtggtagcctgtcgtggtccttgtgctgtgtagacgcctagggtatgtataacattaagtgattccaaggtgattttagtcccccctgaaattgtcagctgcctatgttggagtgtttcgaatgttattagaatgttctcggtactttggaaaccccatcggc

SEQ ID NO: 555661 - DNA, 119 bp, Homo sapiens
agcatctccctttccatccacagacaatagctgttgtcagactcgagccaaatatactggagtcctcactgagctgaagttaccctgtgaaatggacttcagtggaaaagatgtcagtg

SEQ ID NO: 555662 - DNA, 1559 bp, Homo sapiens
gaaaacccatctctactaaaaatacaaaaattagccaggcatggtggtgcatgcctgtaatcccagctacttgggaggctgaagcaggagaatcacttgaacccgggaggtggaggttgcgttgagtcgagatcacgccattgcactccagcctgggcaacaagagtaaaactctgtctcaaaaaacaaaaatttactaggagaaaaatagttgaacctatctagtgataaaggggtcaatctcaagaagacttaaccaattaaacaactggtgtttgcacctaacaacataccttcaaaatacttgaagcaaaaccggacagaactgaaaggtagaattttccggaaaacaataattatagtgggagactttaacacctcctctctctcagtaatcaatagaactagtagaccggaacaatcagtaaggatttaaaagaactgaacagcaccagaaaccaatatctaatagacctattttggaatactctgtgttacaaacagaaatactcaatctttccaagtgcctttaaatattccccgaaatgattttttccgggaccattatattaatcttaccaatgtggcaggtctcgcaataattccagttgttcctcgccaaatggatttactgaaatcactggcggaaaggtatttgaacatttcatcctcttagttaagacatcttctgggcaggagagccattgccgttgacccctacttgcgggaggcagacacccagcggggggaaccgccgaagtgacacgatttaacacgcatactctctctagcaacactacgatcgaaatataaaaaaaataaagggtgactgctttcctcctactatatttttcagagggagcagagacaaggggaagcagacgagaaaagaacggaacaaagaagaagaagaaaaaggaagaagaggaggaaaaaagcaaaagggaagagaagaaaaaaaaagcaagagcgaagaacagcagggagaggacgaaagaagagaagagggaaagagagaagaaacaacagaaggaggagagggaagaaggagaagaaggaaacaaaaaaggaaagaagaggagaaagagagaggagggcagagaggaagccaagagaagacggcagaaggaagacgggaagaaggaaggaaaagggagagagagaggagggaggagagagcaaggaggaagacgaaagaaggaagaaagcagagagaagaaggcaaagcgaaaggggaggaagagaaggaaacgaaaaggagagcaggcgaagagagagcacaaaagaagataaggatagagagaagaaaagaagaacaaccagcaaaacacagcaagagagagaggaaagcagagagagacgagaaagagaaaaacgagcaaagcgagagagaggacagaagaaagagagaagaaaagagaggagaagcagacggaagcaagagacagaagcagaaaagagagaaggaataagaaagaagagcagcgaagaaagagaagggaaggacggaaaggaagacagagaacgagaagaagaagaagaaagagcgagaaaaagaa

SEQ ID NO: 555663 - DNA, 948 bp, Homo sapiens
ttcccagctactcgggaggttgaggcaggagaaatgcttaaacccaggagtcagaggttgccgtgaggccatcgatagcacaactgattccagccatgggcgtgacatagcgatactatgtctggtgaaaagcaatgcagcaatgctgaccgtctatgaacaccgcagtggtttcaatcaatttttccccggagttctggtgaacctcaccaaaggtgaggatgtccaaaaattaatttcttgagttcctggacataattttgagaccctttatggattacatgatgtggacccctatgtaagagggtcggagtcaagaattcaggccaaaagggagaaatgttgggttgtgccactacatggcgtgtggagggttcaaacctggggggtgcgtggaacgacctcatttctagtggatatttttggctcgcgcacatatgattgggttcctcacgggctttttttcttgagggaaaatctttcattctttgccccgcgggggagtacaaattctttgccactagaaattgctgcggggagccgggaaggcctaataatttaaaaggcttgtgggactaatcacgttgttccattggacaaaacgatagggagaggaaaaggccgttagttaatgggggagattaaaacgagctggctgtggagcacgcacgaggaccagcctttaatgcgggaggagcaaaggagctgattatttggtgaccaaaaagaccggcgggaactcttcgaggagaggcggccctgttttggcgcgaacaatgtttcaaagtttgaaagaaattacccactggtgtccttcttgtccacggttattgcctgacctaaacgcgtggggtctttaggccgcaatcggggtttacaagccttgggcaggggtggagtatagaccacagtgttttgttacacaccactattcttctctcctacagg

SEQ ID NO: 555664 - DNA, 233 bp, Homo sapiens
taaaactgacctagaagctatcagcaaccacaaagagacagaagaaaagactgcttctgaggctctctcatggaacctactgatgatggtaataccacgcccagaaataacggagtcgatgatgatggcaatgatgacggcgatgatgacggcactgatgaccccaggcacagcgcgagtgatgactactcaacacgagccaggtctttctgaaggccgagagagctaaataa

SEQ ID NO: 555665 - DNA, 370 bp, Homo sapiens
  misc_feature (205)..(205): n is a, c, g, or t
aaaacaaaaagcagaattacaaactgttattacaataattctaatttttatactggctcatgcactttctactaagatttttatttcttcatacagctcagaggtattgtccagtatgcttacatttcacttcagaggactcccttaagcatttcttgcagtgcaggtctagtggcaaatagcaaagctaattcccttagctttngtttatttgggcgtgtttaaatttctccctcactttattccctcattttactgctgaaaaactaattttttctttctttaagagacaaggacttgctattttgccaggctaaacttaaactcctgggctcaagtgactctcctgcctcagccttccaagtagcta

SEQ ID NO: 555666 - DNA, 266 bp, Homo sapiens
cgcatcacaggagtataatggagagctctgaagagcctccctcaagaagagagccaggacacccccatttacacggagttggatgaggatttcgaggaggaacccacatcccccatatggtcactagtgtggccaatctaccactattgaatgggtccagctgagggcactaatctctagtggccagagggtgaatgacctacagtctatatggaagaatgacaaatggggacgtgctggaccctgggtcagtgcggaaatgaggg

SEQ ID NO: 555667 - DNA, 512 bp, Homo sapiens
cggacgcgtggggtgttgcgaagcggcctgggccgcacccaggcactgctggagctcagtgtctgagtagagccccttggtgctggacatcagcagcttccggtaacaaagtaccacaacccgggtggcttaaacaataggcatgtattgtctcacagttctggatgctagaagtcaaggatcacggtgtccgcagggttggttcctccttagggctgcaagggaacatctgtcccaggcctctcccctaccttctggtggtttgctggcaaactttggcattccttagcttgtggatgtgtcgcccgatctccaccttcatcttcacatggcattctccctgtgtgggagtctctgtccaggtttcttctctttgtaaggactgggccaggggcctgccctactgcagtgtgactgcatcttaactaatttcatatgcaacaaccctaattccaggtaagggacagattctgagatactggagttaaaacttcaacatatgaattttaggg

SEQ ID NO: 555668 - DNA, 669 bp, Homo sapiens
ggaactgcttagagtagtgggttctccagtcctaggacctatggtcacatcttaatctcggcttttcaaatcagagtaggtatccttgggccaaattacatttggttccatgagagaggcaggaatattctcttggatggtgggcctgtagccagttttgtccaaggaagtaatatccccactgtttctctctggggaggataccaaaccagtatcagattggctgtcccagccttgacttccttgttcggtaatgggggttgactgggaagaattctggaaggagatgtgagttgattctccatcagagtcactgaaaagctttggggactgagatccccctgccactgtggaggaagggaagttttccaaactctaatctgtgatttcatcattccttttaaggaatacttccaactggggtccatccccatcagccttttgcaggtgaagtccagagcccagatctccttgcagggaacttgggattcctactccttctttacttccactgtgggattcttcacaatctacaaagttggtgaaacgggagttctgcatccactctgcttttgaagaacctggggtttgtctcagtttctcagggctgcttttctgaacctgcgcgccatggatacctcaggttggttcccggtttggctttgtgct

SEQ ID NO: 555669 - DNA, 156 bp, Homo sapiens
gaacagcggaacgcgaggggtgtgtgtcattcgcaaactccactgaaccttgattgaagacctacagtgtggcagtccatggcctggggactgatgatgtctaccgtagaacaagcctcacgaaagacagtctcagcagaaggctaggaagatgaa

SEQ ID NO: 555670 - DNA, 110 bp, Homo sapiens
gaattccctagtaattgcatgctagcaaggatgtggaaaaaggggaatccttgttggtgggaatgtaaattagttcaccccctgtggaaaacagtagggaagttccccca

SEQ ID NO: 555671 - DNA, 559 bp, Homo sapiens
ctgggagtctgggggcataaaggtcccagcacggtccttcccggcccccgccagccttggtcctgaggctttagccaccccacggccctctgggagacaggctgtctccttaccctgcaggagaaaggatcctgcacccatgggtccttaggcctcctggccccaaggcctgcttgctgccccagtccttctgtaaggcctgtggggggcccccaagtggggttcccctgcttgaagagtgccatctggccccatccccatccttagtgccacaggtcctaggtgtggatgcttcagtacccaccagaaattccatgcccagctgccagcgggatctcctgtcctgtagcctctgccctgtgtggcccctcacaagcttgtcatgtcgctccttattatgagccaccagggctccctattactttctgctcctccagccctgacctcagcatgctgctcagacctcttgagcccccgtgcctcgggggagctggctcccagccccacatgctgcagtctgagatccgacccgggctgtcccaaggaggcgtgcgcagaa

SEQ ID NO: 555672 - DNA, 385 bp, Homo sapiens
gggggggaccgggtttccccctgtggccccgacgggttttaaattttgggggccaagggggctttttcttttagtttcttgggggggggggacggggggggggggccccccccccggggtatttttttgttttttttttttttgggggggcacgggtttcccccggttggccgggggggtttttaattttgggggtgggggggtcccttccccccccccccccaaggggttgggattaagggggggggccccggcccttgggtgggtttttaaaaattttttgttcccccaaaaaggaccccccccctttttttgggcccccccctcttccgggtttttcctttttaggggggggggggggttttagggggggggtgggttccca

SEQ ID NO: 555673 - DNA, 241 bp, Homo sapiens
ggcaggtgtacgagcagacaagtgtcaacgcagatgacgtgaagggactggagcaaggtcgtccgggcctatgagcctgtgtgggccacttggtacgggcagacgacgtgtcgaacacccctatcatggcccaggcaagtacacgagaagctccgaggcatggcgtgaagtccaactgctctctagatagcggtggcgcacgagcacccggtatcgattcactggatggctctagtgactc

SEQ ID NO: 555674 - DNA, 532 bp, Homo sapiens
gtttggcagggcgtggacgtttgggccaccttggggccttcatcggacaaaagaaaccccgcagacccccgcccggacttatccgggttatttctgtatcgtggttgaaaaaaactttattcacgacagcgactcggtgaagagtcccccgcgagatatccttcttgtttccgaacagacgacttcctttggtgggaggacaccgctggacactgtttttataattaccccggaagatgcgcttaaaagaggctctaacactccaccctcctccagggccaggggggggggtttttgcccccaccccaaagcgtttggacactccttttggaggggttgttaaacatccacttttttggactttgagtggggggtggcgcagccctctcaaatccctggcgtaagggttttcctccccggggagcttctccagggacctgcgggctcgcctgaaaacgttggcggacactgtcctggtgcccagcccaacgtggtccaacgtttttttataataaagtcctcgttttcgtta

SEQ ID NO: 555675 - DNA, 263 bp, Homo sapiens
tttttcccccccccccccccccccccccctttttttttttggggggaggtttttgggggtttctttttggccctttcttttttggggggggggggggttccccccccctctcccctttttccccgggggcccccggggggttgggttttccccttttgggttgggggggggggcccgggggttttctcccccggggccccttccttttaattagggggggggggggccccccctttccccccccccccccccccccctttgga

SEQ ID NO: 555676 - DNA, 411 bp, Homo sapiens
tgtatatgtacaattgactgtcattcagctttaaaaaagaagaaagttcggacatatgctactgtatatatggaccctcaggccattatgccaagtgaaatgagccagtcacagaaagagagatacagtatgattttacttgtatgaggtacctagaatagtcaaaaccttaaagacagaaagaatggaggttgccaggggccccggatgtggggagtgtggaatgtggaattactgtttaatgggtacagagtttctgttttatatgatgaaaaaagttctggatatgaatggtggtgatggtaacagaacaatgtgaatgtacttgataccactgaatgctacacttaaatataattaagatagtaaatattatgctatgtgtatttctctacagtaaaaaataattag

SEQ ID NO: 555677 - DNA, 216 bp, Homo sapiens
  misc_feature (73)..(73): n is a, c, g, or t
  misc_feature (86)..(86): n is a, c, g, or t
  misc_feature (97)..(97): n is a, c, g, or t
  misc_feature (157)..(157): n is a, c, g, or t
  misc_feature (181)..(181): n is a, c, g, or t
  misc_feature (208)..(208): n is a, c, g, or t
  misc_feature (212)..(212): n is a, c, g, or t
gaagctcccgggtatgccaggcccatactttgaaaagcctgatctcataaaatcaagttatcattgtcttgangaacagttacccncagatcaagtnaatgcatcacagtccacgggtggtactaacagaactactggtctaaaacaacactaatcntacagtccgttactaagtttcccncttaaaccaaacctaaataactaactncctntcct

SEQ ID NO: 555678 - DNA, 434 bp, Homo sapiens
cgtctcttacaggatcccccctcaaatgtggactcagcgaaatacagcgaatacgtggtcacgggaccggcctccgccaatcgctcgtcctgggctctgggtggataacatatgagcattatttggttgacttgattcgcaaactccagaggaccacgaccaggataccactgagcccccattcctacaccagtgcctcacatgctctctccccgatgccgtccgggtctccagaagagcctagaggaaccttttcctcatccccttcgaaggacaagatgagtcaggatctccgcgttggaggaagagggagtcgaattgaggcttcctctctttgaataagacccaatggtggtcgggcttcgggtcacgtgacaccttctttgtggctcctaatacaattactcttttcttttccagcttttatcttagca

SEQ ID NO: 555679 - DNA, 394 bp, Homo sapiens
  misc_feature (59)..(59): n is a, c, g, or t
  misc_feature (157)..(157): n is a, c, g, or t
  misc_feature (191)..(191): n is a, c, g, or t
  misc_feature (252)..(252): n is a, c, g, or t
  misc_feature (288)..(288): n is a, c, g, or t
  misc_feature (319)..(319): n is a, c, g, or t
  misc_feature (337)..(337): n is a, c, g, or t
agagatatgccatggagagcaaagtggtggaaattctaaaagactttaatgatcagatnaagaaattgtttagaggagcataatatacgtgctctgtcttagtttgagaatactgaccacagtttggctctcctagccctttgcctgagcaaaaccnacaacccttctcacacccagaccatgttccaagncacaacccattgctcagctttctaacctgcctgcgaaatgtgctgcctgttacacgagggnaagcagatcagtgaggcaaggacaactaacaggacncaaaagcaaggcagtggattccctttgcttnatttcttcccttcttagngttcacttcgcaatgaactaagcccattctggctttcccttctggcggcttcttcgc

SEQ ID NO: 555680 - DNA, 224 bp, Homo sapiens
ctaaatgttataatctggcgtggcagctcacacctggagggctagcacttacgggaggccaaggcggacggatcacttgaggtcaggagtttgggaccagcctgtccaatatggtgaaatcctgtctgtactaaaaatacaaaaattagctgggtgtggtggcaggcgcctgtagtcccagctactcgagagactgaggcaggagaatggcgtgaaccatggag

SEQ ID NO: 555681 - DNA, 222 bp, Homo sapiens
ttttttgtgttactttttcacaaataaatccaagcagataatgaaataaacacatttttttagtgtcccatcctgggttctctgccaaactgaatgtattattcaggaagaatacagagtgccttcatttaacataaagttgaatgaaaagtcaatttgcacttctttataataactctggtttagaattagaaattgttaaaaccttgataattgtcattt

SEQ ID NO: 555682 - DNA, 927 bp, Homo sapiens
cttcggcctgtgaaaatgtggcccatcctcgtgctgtgttgttacccaggttttacgcccctcggggcccctgggtctcgctctctcgatgcagcgggtttgctgcgagcttgcgtttttataactggtgcgccacacacatgtgtgcactgagctcacaggtgtcgcctacagtgctctatgtatgaatgtatatgcccaagagagagcttcgtttggggccctccaggggctctgaagtaattgaaaggcttgtgtggggccaaaaataggggggacatgttgcccacacccggtaaatgagggcaccacacgtgtctccttttctgaatctcaggggaagtgttaacaccccgtgcaacacacacactgttgggtgggaagaacaccaagagaaagttttcacatcttggtttggtggattgggcaaacagcagaacctgtggagttccccctgtcggagactggggtgtggttgtttttttgcgcttggaccactcgttttgtcttttaaaatgtggggtctccacttactgccatttatcaaagaggaaagagccaaaactggggacaattttaagtccccacagagatagaacctgtccaccccctgtttcccctgttaccacacaggtgtaacatctgggaaaaccaaggcgctttggctaaactggtggaaactatcaggacccaattaccaatgaccagatacgatgagatccccccgtcactggggtggccaatgtcctgggtcctaaatctttggctcgtattgcccagcttgaaaaggccaaggtttaagagacttgcccctaatactgggtttaatgtaccctgttgaattttttgtacattaaaatgattgaaataattaaaaaaaagattaagatactcgagcattaactcgggcgagaagagagtggtgcg

SEQ ID NO: 555683 - DNA, 149 bp, Homo sapiens
cctctgacttcggcctggccaagaagtagcgggacgcccgcaaccagggggggacattccctaccgggaaaacaagaacctgatcggcacggcccgatacgcttccatcaagacggtgctgctcttggccagcccagatgatcagcagc

SEQ ID NO: 555684 - DNA, 611 bp, Homo sapiens
attgaaaaaaaaaaattttttttttgggaggaccacaaaaaaaaacaaaaaagggaataaaaagtcataaaaattatctcccaccgcaatcaaggtgattaaattaaaaaaaaaagacttgccggggtgcccgttttggcccctttccttgttggccaagagctattttttggggggggcggcattccccgcttctttggcaattttctcttttggggggcggctaaacactggcgggggggtgtatttccctcggtggggtagaaaaaacctggggtaccccaaataaaaggccttccggcccacctctcttttgggggtgggaaaaaaagggaagcccctgtgaagaccctcctgaagggggggtcccctttgaaagtgaatgtaaatttcccccttttttttttcaaaaatgggaaaatttttataaaaaagatttttttttaaacccgggggcggggggggaattcttttttaaaaaaaaacttccccccgaggggggggttttttttcagggagaaacagggtctttttttaaaagaggggccctctccccggcggggggggtttttgggggggggggggcgcccaaacatttattgcggccctta

SEQ ID NO: 555685 - DNA, 315 bp, Homo sapiens
agccggactaaaacgctggtgctggctggctggcaggatgaacagcgagtctaagaactgtgcctggctgcgggtgctgagcctgcaggcctgggccacagcctgtgatggccgagctgcgagcagttcgacaagacccagatgataaaggaagccagaggacccctcccactcctgtctaaagcaggccatcagcgatcagcaaatgccatcaacacccatggaggcccccgtgaaggagaagcacgcccggctgcatcattctgggcacacaccacgagaatgggggctttcaccttctggtcctatgccatt

SEQ ID NO: 555686 - DNA, 216 bp, Homo sapiens
aactaagaacggcatgcaccaccacgcgcacacgaggagccacacaacgggccacacgaagagccaccctaagagccccgccatgagcacgctaggtgcccgcaacgaggcacaacgagccacactaagagccctcccaatgagccgcacaacgagccacgctaggagccacacaaggagccacgcaaagggccaccccacgagccccactatgag

SEQ ID NO: 555687 - DNA, 294 bp, Homo sapiens
  misc_feature (123)..(123): n is a, c, g, or t
  misc_feature (142)..(142): n is a, c, g, or t
  misc_feature (236)..(236): n is a, c, g, or t
ctttttgccggctgggcgcagtggctcatgcctgtaatcccagcattttgggaggccaaggtgggaggatcacctgaggtcgggggttcgagaccagcctggccaacgtggtgaaaccctgtntctactaaaaatacaaaanttagccgggcatggtggcaggcgcctgtagtaccaggtactcgggagactgaggcaggagaattgcttgaactcgggaggcagaggttgcagtnagctgagattgcaccattgcactctaggcaacaagagcaacgtgacactccatctcaa

SEQ ID NO: 555688 - DNA, 1064 bp, Homo sapiens
gagcggccacaatcacagctccgggcattgggggaacccgagccggctgcgccgggggaatcctgtgcgggcgccttccgtcccagtacccatcctcgccgcgctccagcacctctgaagttttagcagcgcccagaaaggaggcgaggaaggacgcggagctgtgtgacgacgcgacgtggacgcaacaaagctcaccctaaaacatttatttcacaggacgaaaatgaaacacacggggggcgcgcaacacaatggctgggcgcaatttatacgacaacacatagagcacccaagaagctgtgcatcgctccggctgggcattctagctcgtgttcgcaaatcatcgccctttctaggtgggcaggctagcattgctccagggcccacaacgtgcagtgtcctacagtgtcgcgtgaacctgtgtgcgctgcccgtaacgacaccatcacaagacacacacatgcgcttcgctgccttggggacccacatcatctgtgacaagcatccgacgacattgacagaggcaattccaaggcgaccttgaacgccaatgacatcgtcgtcctctgttcacatttcccctcccccacatggcgcatgagtccttggttaccaattcagtgctgcgtctatccttgcaagcctggaccattgcccttcacagctacaaccaacaagctcacgagaaacctgctctgaagtctccattggcacggttccctggccttaccgtgcatgacggcattcagcctgcagtgcacctgccctcggcccccatgcacacaccaagctcacacgggcacactctaaattgccacatgccacattctccaaagaactccgaagccaatcaccggggcggtaacataagaccatagtgactggcaccatccctttaacatgcaacacatcgggcgcaagcgcgtccactaacgttacacgcgctccgaacaacttcggcagatgcctgcgcaactcgccccggctgacaatctcctggttggcgactctgccacatcacaccgccaacgtgcagagagacgaacacccaaacgcggcgg

SEQ ID NO: 555689 - DNA, 371 bp, Homo sapiens
gggagccaagatcacgccattgcactccagcatgggtgacagagcgagactccatctcaagaaaaaagaaaaaaaaaagaaagaaagggtattcaaataggaagagaggaagtcaaattatctttgtttgcagatgacacgatcctgtatctagaaaacccccattgtctcagttcaaaagcttcttaagctgatgagcaacttcactgacaaaagtcactcagggccaagccttaactgaaatggctgattaacctagtgagagcagtactgggtcaaaactgatcaaaaggcagtcatattcaacaaagtactggaagttctggccagagcagtcaggcaagagaaataaagggcccggtacatgcaag

SEQ ID NO: 555690 - DNA, 280 bp, Homo sapiens
cagagatgatgccactgcactccagcctgggcgacagagcaagactccatctcaaaaaaaaaaaaaagctgctgaattcaggcagcgcctttaaaatcccgggcccaggtgattccgaaactcgggggcaccggggttagtgcctttcttaggcccggccattaccctcttcctccatttagcactgggccaaggtctctaacattctctttacccagttttaacaggggcgtggtaagacgctttcacccatgggaacaggtacaacctggcggggggg

SEQ ID NO: 555691 - DNA, 113 bp, Homo sapiens
actcttggttgtctatacactgctaggcatgcttaggcatgtaataaatattttttttcttgagacagagtctcaccctgtcacccaggctggagtacatgtggcacaactca

SEQ ID NO: 555692 - DNA, 837 bp, Homo sapiens
cggaagcggctagtctccgtgctcgacagctgggtgtcaggccatggggcagccctgggctggctgggagcactggacggtggcgccctgtgcagctgcctctcgtgctcacctgctgctgtgggcctgcggcctgtgggcctgtgagctggcttactgtgctaggtgctcgtgtccctgtggcctgcctgcctgctggtgacccctggcaccgggtccttgcagcttggctgctggccagccttccagcttgctcaaccgtgctatggcaactgtgggggcatctatcctgcgactcggaatacccaggcatacctgtggcagtagatagcaggcccggcctgtggacttgggcctggtggctagcggcttactagctagccaatgccaaaagcacaggtgccggccaacgcagcgggacaactgctcatgccttgccagccgtacttgcataccttgcgtactgggaaccacacacttagccagactagctagaggccagctagcgtagggcctttcggccaaactaacacgagccctataccttgtagcccttgctagctatcagttgagccgacaccgggcatgaatccagtagcgcatccccacgaggataaatacagtagggaagccattggatatagggagaggacccacaatgaacaagactatgggtacaggagaaaccccatggcagttaggacgaaaaggcaccaccaaagaagacaggcaacgccaataccaagccagttgagaaatagatacgcatcacagatccccgatggcgattatacaccctagtggctaatcgaatagggtatagacggacacacaatg

SEQ ID NO: 555693 - DNA, 100 bp, Homo sapiens
aactatctgaaaaagagaagagtgaactcagtactctacttgattacagctctgatcaacaaacctgtcagctctggcaaaaaaatggtgatgtagcaac

SEQ ID NO: 555694 - DNA, 208 bp, Homo sapiens
ccactccgctcccccgcgggtctgttctgtgtgccagtggacggtattgtcccaaatatggccgttggtacaatagcggggatctgacgatgcttttctctactatgtgtcactaacggaccgtttatcatgagcagtaactcggcttctgctgcaaacggaacatgacagcatagaatgttcacagcgtgacagtctgaagatgcag

SEQ ID NO: 555695 - DNA, 226 bp, Homo sapiens
cgtctacagtgaatggtattacataggtgacacagtaaagatattgattagctcagggggtgggggtgttaaaaggacataagagattaggtacagacttgccaagctataccatgagcctagctgaagatggaactcttacacttgtactaagtagatgaaaaacgatccaagtccttccaagaatgtgtggcagcacaggaggagggacactcaacactgcttc

SEQ ID NO: 555696 - DNA, 880 bp, Homo sapiens
gaagtatgtgctgtcataactaaaaaaaacgaagaagaatccacttgtagcgtcatacaatacagagtatttgtcgtcgtgtccctgtacaagaagcagatcagagatttctcatgtggggctacagctattgttccagatggtcaccagaggttcaacaaactcatctggatacatcattactatgtccacattcaccttacaaatcaactgcgtgacgactgcagtcagtgcttctcgagattagacacagatgtacacccccttgataacttcgcacagcagtaaggagctacaacagctttcatccacgacacaggacctcgtgctcagaagccatctaaagagtccaagatcactccgtatcaactacttgacgccattgaacttcagccaagtactcatcagccgccacacatagaagccagcctacaggttcactccaatgtgctcgcttgatgtcgctcgtgtgatgctgctgctactcactcactattactacttcatatcattcctactcactaggaaacgaccacccacgaccatcaacaaccactaagaccgcaagcgagcgaacgaacaaacaccaaataaaatataatagaaatacaaaacgtaactactatctcgtccaaccccacaacacaactcttatctcaactaaacagaagtcgacaattacgtcaacttatagcataaaacgactaacacaaatacgaacgcaagaagcagccatcaaaaacaacatactagccaacacacatagaaggactacgacatgatacctccatccaccccctgaacttataccagtcatactaaccctagcaaataacttaaattaagttgacagtcagctttaccgtacccaccaacgaca

SEQ ID NO: 555697 - DNA, 224 bp, Homo sapiens
ttctcgtatgtgatatggtctcgtgccggtttagctgatgagtttacacccgctttgagctgcagtcccaagcatagcccgactccgtgaaagatccgggtccgtggcgccgggggccagttaccggcctcacaccgtccacgggctgcgcctcggtctcttccaggtgggtgaggggggagagtcaggaataaggggatccccagaagtgcgcctgggtgcgt

SEQ ID NO: 555698 - DNA, 506 bp, Homo sapiens
  misc_feature (26)..(26): n is a, c, g, or t
  misc_feature (67)..(67): n is a, c, g, or t
  misc_feature (72)..(72): n is a, c, g, or t
  misc_feature (83)..(83): n is a, c, g, or t
  misc_feature (107)..(107): n is a, c, g, or t
  misc_feature (131)..(131): n is a, c, g, or t
  misc_feature (301)..(301): n is a, c, g, or t
  misc_feature (310)..(310): n is a, c, g, or t
cctaaaaattacaacggcccccgggncaaaacaacacccctaagacccttgggaaatgtaaattccngtttnccccctaacanttgccctcgggtgatggaaacagncccacggaaggattggatattagnaaaagaacagaatgagagaaatgtttaataaatgttaggcacccccagattaaacaggtccaaaatccatgaagcctcagagcaataatgaaaaggatcctcctgtttcctggcataaaaactgccttcctctgcctacacaggggcccaggaagagctgaacgaactgnctaaaatgncttccccatagtgtctgggattataggcatgagccacgggcctggccctgaaaatcttaaagtttagctttgggacctctcccattttctcagaaatctcatttggatccaactgtgttttataaacctgtgagtccacattacaatgttttgctgtctcatgactacaattctaaaatgaaagctataaggtctt

SEQ ID NO: 555699 - DNA, 114 bp, Homo sapiens
tctgtgcaactcctggctctaggtacatatcaaaagctaagtcatctagcggagagatatagtcagatttcctgtgcgtacgtaccttctaagagcagggtccgctggtgtatt

SEQ ID NO: 555700 - DNA, 771 bp, Homo sapiens
gatgacggctaggtacgaggctggggtggttaatcggccgaggactgtgctcagctgctgcagctgagaaggagccagtcccagttccagtccaggaaatagagattgactccaccacagaattggtgatgggcatcaggaagtagagaaagtgcagcctccagtgccctgtgaatggaaatggcccatggattcacagtgatgtgcagaagctccatggtgcagattgcatggtgcgtgctgaagtccactaggtgaaccaccgaattcttcccatgtgattcatggagcagttccagataaaatccctgacagttacaactgtgtgctgtcctgacgagaactacacctggtcacaggactatacttgacctggagtgtcagggtgccatgatacccaagcacgtggtgaagggaaagcaggtctcagttggcccttagcagcagctccattcgtgtggccatgcttggaggaccacatggggagtgctgtccttcatgtgtaaggggacagctcacccgaaaagaatcaacacttgagcagatctcttctgggaagtctccaagccctggcgcacgttgccgtataatggggtgcacgccgttggaacgcccatggttggggccgaaacgtacttttggttgtgcacgcgccaataccattgggatcgggaagaagagatggacccaagatctataccctatggaccagagaatccccccacaattgcgaagcctgcctccccaatgtgtggcccacccaggtcgggc

SEQ ID NO: 555701 - DNA, 1093 bp, Homo sapiens
cagccacccatccccatcaccgacctggaggacaactatcggagcgcctcagaaggccaacgatggcctcaagttctcccaggagctatgagtgccatcggagccgggacagccagtatcacgtggcgagaattcaacaccctggcaggctgaccaagcccccagaaccgctactgccacactgtcactcgcctacgactcacctctcgagctcattcctctaccctctactcgactggcgtccccgggacgctgacctaccctcaactgccaccctaccagtcgcacctggcctaccgcaacgcaccacagtgccctacacctcgccaccgcacgcggcccccttgccccgacgaccaccggcccgactctctgggccgacacggccgctgcgcaaccagcccgccactgcacccacctgctccctccacgcactcgaccacccggcctaccacgcgcacccaacgtccccggccgctacacccacgcctgcactccacgcccaccctgccctccacgcccccggctgacccaacgccgcacgcatctcctgtctgcggcccctcaactccccaccggcctctgaactccccctagcctccgccgcaccaacacggccggcgcacccccatgcgcccccaccaactcacaacctagacggcccgccacccctacaccgccaactctcaccaaccaaccgcacctggcccctcccacaagcctgcaccaaagcgccgatcagactcacccgcccgcacccgaccccccccacgccctcccccgccccccatcgaccccacagcaaccccaccgcgcccgccctccccccccgccacgctcacccccccaaaccaccccccccaactcccttggggcaccccaccccatcacgcgaaccacgaacccacaaacgggcccccctgccagccaacccccccccatacagcaacccctaaccgggaccccccacggccgcactccaccgcccacgctaggccaccccttccccccgcacccacacccacccccccgccaaccccgccacctggcgcccccccccaccccatgcactctcgaccccccccaccgcacc

SEQ ID NO: 555702 - DNA, 546 bp, Homo sapiens
cgataactgagatgaggcaggtacatgctggctcacagagattggccccattagtctgagctgacgatttctaatgttgtttggggagtttgcgtggcacgaactggagtgaacgatgatgcagaggtgatcagcactagtggaacacaacaggtgggactgtccatccttgtccaaagaagcagcacagcaggaccacggagaaagggtgggggcaggaaacagccggactccctctgaccctctccgtcgccttggagggcccagacatccaaatggtcacttcccaacgctcttcagaggtcaggaagcggggagggacaggggagagcggtcatcaccacagagaacttcggaggagggagggcagagcattatgacagaggctgaaatgcaagtctggtggccaacagaacgtagcttcccaacttctcccttcgctggtctctagggtctcacagccacttgccctagttctccttctctggccctggaaccaggaggaccttgaccacattcttcttctcctgcctctatgtcattttc

SEQ ID NO: 555703 - DNA, 118 bp, Homo sapiens
tatggttgtcacgcaggaaaaccagagagagcaggaaggccgcatggataggatccgagttgtcccagcagctgaatgagaaggcgcacattgaagccacgcacgtaggtagcccgac

SEQ ID NO: 555704 - DNA, 554 bp, Homo sapiens
  misc_feature (52)..(52): n is a, c, g, or t
cttaaattttgaattcactcaacattcattcagaaaatacataataaatacntactatgtattaagtgccatactaaagttgggcacattaaaaaaaacagtgtccctgctctgaaggagctcacaatttgaagatatacattaagaaaactctattaattggtgatacatgccttaaaaataatatgtggccattagagattgttcaagagacctttaacagaggatttgatttttaattcattctgaaagatgagtgctgtggcagacagaagacacagaatgtgcataagcactatgctatgaaaaatatatttttagagcatgttgcagtttaagagagaagccattggtgaaactgctgtaattctttgactattttctccaaatgtggaatcaaagagacgtcttgaggagctctggatgtcactcctatggattattctagacacttggctggctccagttccaggaaaatgggctgagtcaacagcaatgaatataaaaccatttatgaataataagcaataaataatataatagtgaagaataaa

SEQ ID NO: 555705 - DNA, 823 bp, Homo sapiens
aacgctaggtacgaggctggtttaattcggccgaggctcgggagctcctgacggacggagcgcccccgccccgcctggcggctgccgcgctgccatgcccttctccaacaggcacaacgcactgaagctgcgcttccctggcgagtgacgagttccccgacctgagctgcccacaacaaccacatggccaatgtgctgacccccgagctgtacgcggagcttgctgctgccaatgagcacgccagagctgtgcttcacgctgtgacgactgtcatccagacatggctgtggacaacgccgggccaccctgtacatcattgaccagtgggctgcagtggctgtggctgactgagtgagtcctacgaagtgttcaatggatctcattcagaaccccatcatcgagggacctggcactggctggctacaatgcccagactgatgatgcacacagaccgacctcaaccccgacgaaccttgcagggcggcgaaagaccttgtgaccccaactactgtgctgaggctcgcgtggttgcgcacggtgccgaagcataccggtggcgttacttgacatccccaccggacttgcaagcctgcggtgaagacgccgagcccatcgaggaagcatcgcggtgggaaagcccatgtccagcacttgaactggcgatcactggcgggtccgaatactaccgcgcctacaggagcattaactgaggcgggagcagacagcaggctcatcgaacgatcagctacctcttcgacaaagcccgtagtcgcccctactgctggtctcggtcattgcccgcgacaggccgacgcccgggta

SEQ ID NO: 555706 - DNA, 126 bp, Homo sapiens
ggccgtcctcatcattctacctttgatggctactcaaatcaaatcaatataacttggggtcaggcatggtggctcacacctgtaatcccaacacttgggaggccatggtaggtatgatgaaggacg

SEQ ID NO: 555707 - DNA, 323 bp, Homo sapiens
gatttactggggacaacaacctgaaatcctgtgcttatgtcaacatgggagtaagctacttcagttgcaataatagctagcaatgttacataacttaaaagtttaaggccgggtgcggttgtcacgcctgtaatcccagcactttgggaggccgaggcgggtggatcatgaggtcaggagatcgagaccatcctggctaacaaggtgaaaccccgtctctactaaaaatacaaaaaattagccgggcgcggtgcgggcgcctgtagtcccagctactcgggaggctgaggcaggagaatggcgtgacaccgggaggcggagct

SEQ ID NO: 555708 - DNA, 465 bp, Homo sapiens
atctgttaatagttgttcagctcagagacaccacgtcgtgaaagagataccaagaggctggagtgtatccagaatggtagtgacatgagagtgagaaacagctggacaactagaatcatttaagaaagaaaaatgagtacaggatggtcgtgacaactctcttgaaatacttgaggaattgttatatagaaaagagagtcaaattgctctgttgttctagaggacagctttcttttcttttctttttctttttttttgagatggagttccactcatgttgcccaggctggagtacaatggcgcaatctcggctcactgcaacctccacctcccgggttcaagtgattctcctgcttcagcctcctgagtagctgagattacaggcacgcatcaccacacctggcaaatttttgtattttttagtagagatggggtttcaccatgttggccaggatggtcttgaac

SEQ ID NO: 555709 - DNA, 111 bp, Homo sapiens
  misc_feature (85)..(85): n is a, c, g, or t
tgggtgcatgatgtgggacttcccaaagcattcccattagtacaagatgactgatttgcccggtcggggcaatgactatcttctntctttgaagaaacttggaaggcagaa

SEQ ID NO: 555710 - DNA, 350 bp, Homo sapiens
ctccatacagcaacgtcatctaaaatttccttcgacatggattcaggcttgcctacagcagtatttctgcaactcttgaatgtacctatcagtggaagagctagtgaaaatgcagattctagttcagcggaatggccctcgattcaggaagttaaacaaggggtcaggtgatgctgatggtgctcgctctctggaccacactgtgggagacagaaagggtgttggcctatgctgtccaatagacggagccactagctggaggtacgcgatgtgaggtgcttgaacatggccggtaggtctgacacagagagtttgccatagtgtaaattacagcaccagattttgacata

SEQ ID NO: 555711 - DNA, 130 bp, Homo sapiens
  misc_feature (80)..(80): n is a, c, g, or t
tcgaattcaagcttctaacgatgtacggggacatgcgctggttccagcagaaagtatgatggcgatcatcctttcctggnaaataaattcccgttttctatccaaaagagcaataaaaagttttcagtga

SEQ ID NO: 555712 - DNA, 509 bp, Homo sapiens
gcttggttgttggtgagtgttgaatgagaggatcaggttaaaatcaaaatccctacctggctaaatgtggctctgctgcttggggtaggagattgggccacaagtccagctgagtgccaggaggaggaaggggtaaaaagggagtggaaaacccctccaaggacccactgaccctgctgacagacttcttattcaagtgtgaagaaatctgtcagaatctgagggaaccaaagacaagaaaaaagtacaatgtttggacataaatttccttaattcttgtaaatgtattaggattctaataatcttctataaggaggatattaaatatccttaaataatttgctgtacttgggacagtggtttttcttcttcagtttagagctagaatctcagttacctatagttgcctggagtcaattggtagaatgggtctgaagccattgaaaattgagcgtggatatgaatacagtttaatgtttacatgtgatttctgccacagggtaccgagc

SEQ ID NO: 555713 - DNA, 1255 bp, Homo sapiens
gtcctttctctctcccggtgacagcatgagtcttcaccactcgctccatcttctccaccaactcaccggtccctgggctctgtcacaggcagcccagcatactggcgacccgggacgggatcagacagcgacgagacatgcgctcgtatgcaaggcgacttgcgaggagactacttgagttccctggactcatcctgtgatcccgatcgcatcagacttccagagggcgggcgatgggggtccaggtgggctctggcctaccgagtgatcacgcgcggcgagagtcattggcaatgggcaatagtggaagggccgatcccatgaaacagcagcaacgtgcatgcaccatagtccacatatgccgcttgacacagcagccgtcctgggcccggctgtcccacgcgtggggaccagtcagatgcagcgcagccctggggagagcatcggcgaacaaaccagggcagagcactgtggaagcaagccaacacaattcacagggcgacagcacacactgggggcatgcacagcacaggggcacccaccaagcggaccaaagcaagcaactcggtgaggcacaactctaaacgtcccgaaacgcacttccaactccgcaaggggacaccccttggaacgggtgccctccacggaacttcgtttccagccaaagaatcaccttggttggcgaaccgaaagtctgcccccatgcaaatccacgttccacatcgcaaacgaagtttcgccccacaattgggccagctggtccttcggcataagccatgcagacggacatacagcaacaacagcgtccaaatgtaagtcgaaagaacccaaggaaggcatagagcccacatcgggccagggccaaagacgaacatcgacggcaacagacacacgagggaccgagtacccaaaatcgagggcccgttccacggccccagacggggcacccggcgtggaccgcagcccaaccccacaactcaattcgcagcgagcgggaacacatggccacggcacctcggcgacggcgcagcacggcaaggacaagtcgggaacgagccctcccacccgaacaggggcacggcgcaaggccagggccgtgccgaatccaacgtgcgacgcgcacacggacgacccgaacgagaaccagtacaagggacaagattacagacacatgtggcccgttaccacaacgaccaccacaaacgtgcagccacagcgactcacgtgagcggactggcacgaccggcggcggcag

SEQ ID NO: 555714 - DNA, 346 bp, Homo sapiens
  misc_feature (58)..(58): n is a, c, g, or t
  misc_feature (95)..(95): n is a, c, g, or t
  misc_feature (127)..(127): n is a, c, g, or t
  misc_feature (324)..(324): n is a, c, g, or t
  misc_feature (337)..(337): n is a, c, g, or t
ctgaaagagttctgcctcaaaaccctattctgaaaaaggaacttgtcaaaacattttnaccttaaaaaaatttcaggccgggtgcagtggctcanacctgtaatcacagcactttgggaggtcgagncgggtggatcatgaggtcaagagatcgagaccatcctggccaacatggtgaaactccgtctctactaaaattacaaaaattagctgggcgtggtggcgcacacctgtagttccagccactcaggagactgaggcaggagaattgcttgaacctgggaggtggaggttgcagtgagccgagattgcaccaccgcactnccagcagagcaanactctgcct

SEQ ID NO: 555715 - DNA, 318 bp, Homo sapiens
tgaaaggaactgtccgttccgacaaccggtcccgagcgaactgtatgaggaggacgcgtcggaagtccaagaggaagaagggcggggtccggaagtcccgtctccggacgtcccgagccggcatcctcttccagtcccgggtcccgaagtcgtcccccgtgaacaattaccgtaactccaactacctgcggaggaggagtgagaccggaggtctgtccttccactagggtcactgtcgccccccgtgacacgccgcgtcgcgacactgccagcggtaccgttagaggagtactcttttgaagactcacgttcgtaccg

SEQ ID NO: 555716 - DNA, 417 bp, Homo sapiens
cggcggaatcacttgatgagctcggtactagttccatatgatcgtatatctctgtatcggtaccagtaccatgctgttatggttactgtagccttgtagtgtattttgaagtcaggtagcgtgatgcctccagctttgttctttttgcttaggattgacttggcgatgcgggctcttttttggttccatatgaactttaaagtagttttttccaattctgtgaagaaagtcattggtagcttgatggggatggcattgaatctataaatgaccttgggcagtatggccattttcaccatattgttcttcctacccatgagcatggaatgttcttccatttgtttgtatcctcttttatttccttgagcagtggtttgtagttctccttgaagaggtccttcacatcccttgtaagtt

SEQ ID NO: 555717 - DNA, 471 bp, Homo sapiens
  misc_feature (86)..(86): n is a, c, g, or t
  misc_feature (260)..(260): n is a, c, g, or t
  misc_feature (332)..(332): n is a, c, g, or t
  misc_feature (360)..(360): n is a, c, g, or t
  misc_feature (408)..(408): n is a, c, g, or t
  misc_feature (415)..(415): n is a, c, g, or t
agggttattgaactgactgccttgtttctcatgcaactccagcattttccccagaagttgaactatggatagcagcttggtttggntttcctaaatcttaacatttgaagcagcttcttgaggctggcaactatcctggtttctttcttggagggggtggtttgttttttggggcccaacgtctgtcccaagtggtggggtgagagtaagttaactttggtgccaggtgagacgcgggggctctttgctttttctccctntcatggaaagattggagttttctctgcagggcactggggaaaaggattgctgattctgactgtccctgttcngagagattatgattgttttttgacctangatttggaacccctctaattgttgaagttccctgtgacagctctcctnctgcttntccttctcctggggcttagcatccccccaatgagagctctgcttccttttccacct

SEQ ID NO: 555718 - DNA, 1224 bp, Homo sapiens
  misc_feature (54)..(54): n is a, c, g, or t
  misc_feature (66)..(67): n is a, c, g, or t
  misc_feature (80)..(80): n is a, c, g, or t
  misc_feature (82)..(82): n is a, c, g, or t
  misc_feature (88)..(88): n is a, c, g, or t
  misc_feature (116)..(116): n is a, c, g, or t
  misc_feature (119)..(119): n is a, c, g, or t
  misc_feature (535)..(535): n is a, c, g, or t
  misc_feature (666)..(666): n is a, c, g, or t
  misc_feature (668)..(668): n is a, c, g, or t
  misc_feature (683)..(683): n is a, c, g, or t
  misc_feature (706)..(706): n is a, c, g, or t
  misc_feature (710)..(710): n is a, c, g, or t
  misc_feature (712)..(712): n is a, c, g, or t
  misc_feature (736)..(736): n is a, c, g, or t
  misc_feature (739)..(739): n is a, c, g, or t
  misc_feature (742)..(742): n is a, c, g, or t
  misc_feature (750)..(750): n is a, c, g, or t
  misc_feature (752)..(752): n is a, c, g, or t
  misc_feature (768)..(768): n is a, c, g, or t
  misc_feature (770)..(770): n is a, c, g, or t
  misc_feature (773)..(773): n is a, c, g, or t
  misc_feature (780)..(780): n is a, c, g, or t
  misc_feature (782)..(782): n is a, c, g, or t
cagcgcccttttgaatgacacagcattattttgctttttctagcctcttatatnctaatttattgnngctatgcctcatntncatgcngctttgccctgccccacccccttggcanatngcccccactgctaaggctgctggcttcaggagggttagcctgcaccgccgccaccctgcccctaagttattacctctccaattcctagccgtactccctgcagccctctcactttttttctcgtttcagtaatttatatggtgttaaaatgtgtatatttttttatttcactattttcactagggcttagggggcctgcgcccagagctggcctcccccaacagcgctctgcgcttgggtaggttttgggtggcggttatggcaggcccgggctggctgcttgggatggcgaggcttgggccttggggccgggtgctgggggcacagctgtctgccaggcactctcatcaccccagaggccttgtcatcctcccttgccccaggccaggtagcaagagagcagcgcccaggcctgntggcatcaggtctgggcaagtagcaggactaggcatgtcagaggaccccagggtggttagaggaaaagactcctcctgggggctggctcccagggtggaggaaggtgactgtgtgtgtgtgtgtggtgtgngngcgcgcgcgcacgcncgagtgtgctgtatggcccaggnagcntnaaggccctcggagctggctgtgcntgnttntgtgtacnanttctgtgggcatggcngnttntagagcntngacacccccccaacccccgcaccaagcagacaaagtcaataaaagagctgtctgactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaagaataaaaaaaaaaaaaaaaaaaaaaagaaggacggacgcgatttatgaaattaagatagataagaaggaggaggacacattagtagaatagagagaaatttaatatataacaatacaacaagattatatataattgtagatagagtagaataaaaaagcagaaagagatataaaatagtaaagaggatataagcaaaaagagaagtctagacaatgatgatgaagagagcgatagaaaaaaaaaaagaaactaaaaatgaaatagtaaaagtag

SEQ ID NO: 555719 - DNA, 314 bp, Homo sapiens
gtgaaacagtgaattgctgaaaaccaaaatgtctgaacttgggtctaatgtgacctcttaatgagaagttatacaatacaggaatttgttacaatgatgagaatattcatctctagtgagagaacatgaatgagggtctttctgcttagtgcacgtgtagacattcatcacaaggttgaggaatgtgtgaagatagcaatggcaagtttaaactgagatgtttcaattgaacatatggatccttagtttctctgtgtaaattctctgttaaatgatgagggtctgtagcacttggctttcgagttagggggggt

SEQ ID NO: 555720 - DNA, 243 bp, Homo sapiens
gaacctgggctcataatcattttgacgttacgggttactggtgtgggtttcttcatgcttcatgtggactcagatttaagccttacaaagggaaagcctctgagcgtgagacgtaggactgcatgaaggtcactcgtgatgacagctgacatgctcacacattacaagagtagagagggaccctcctaagacagaggaactccagagatgagtgtctggagcgcttcagttcagaacgtggct

SEQ ID NO: 555721 - DNA, 793 bp, Homo sapiens
gacccacgcgtccggacccacgcgatcgcaggcccaccatcaccaccgcctctggaccgcacacccccatcattccaccatgtgccctcaccaccacactacacagacacaccagcacgctgcagggctcccatggagctgagtggggagcagtatttcccactgagccatcagttacccaagctcacccccgcccgaccacaacagcaaatacacaacactgacccatccgtggacccaaaggcataacaaatcccaccattacaacagcaaaccacatagcacactagcatagcagatcacccagcctaccactaagcgtagggatagagggacacatcagcatccatccatcggcgagcccattcccctggagatatccaaggatagagcatacacgccactcatacatcagaccatcaccataacacacactgatcaccacacatcactcgcgaaataaccacaaaaatcagagttgacggagcccaattggcagaacgggaggtcaccacacccatgcgacccctcctaaaacaatctggggagcaccccaacaactgacacaaccaccaaatacatacaacatacacaataggcgacaaccacagcaacaccttaacacctacccacagaccttggacccccaaaatagaacgaacagacaaccgcacaaaaagaatagctagaagccaacaaaccaataagacaaagcacagcgaagacaacagaacaatacgaccacccacccacatgggcgaaaatcttacgaccaaccaaaagaaaaaacaag

SEQ ID NO: 555722 - DNA, 452 bp, Homo sapiens
taccaccatgggcacttgcggtttatcttggagggcgccaggctgcagcaggattgcttcatagtcatggccagcactactggctcatactcttgctctgggggtggctgtagcacccggatgccccagtggatgccgggaatgggctcggcctcctccagggacacccacaacactgactgctccttccctgcagaaggcaggaacccaactttcagggttggaggtaggctgggtgtggaaaactgtgccaccatgaggtcctggtcaatagtgagcacatttcagctcccacctgaccctccagctgtgagggaggtcacagtgcccacttgggtgtccacagcaaacaggtcctgccggctgcgctgagccgagtcaaaaacactctctggctgtcagctgaccagaatcccaaaggcaaaaggatgcagaaaatcccaaagaagtac

SEQ ID NO: 555723 - DNA, 319 bp, Homo sapiens
tggggggggtgagccccggaaaaaaaagggggattttcaacattccctttttaaaaaaaaaaaaaaaaaaatgggggggggcaaacccccctggtctggtttaaaagggggggtttttacgagagaagaatactcttacagcaataaggcggggggaccaactgcgacggggtggggggaaattctttttttcctcgggggggggagcgttattatttgacaagagggagatttttcctcccccacaatagtgggggacgtggaccactacactatattgcctctcgacgcctggtggggtgtgggtactccttttatc

SEQ ID NO: 555724 - DNA, 335 bp, Homo sapiens
gagtgtagagcgacctaccgaccttatctcactgttcagagaaagcaaaggggttacagttacataaaacatgtggtattggattggaatgaaagatactgatatgatctcataggctttatatatataaatatacagacagataaagaaatagctacttatagaaagtacatggggtgtgtgttgtgtatagtgtctattgtgtacattacatatattctactaccctcttgtctgctgaaaagggactataaaattacatggtacttccagttaccaaggagccattatatagcgatcccaatggctttctaaaattaaccatttttccccaa

SEQ ID NO: 555725 - DNA, 256 bp, Homo sapiens
atatctcaggacggctacggcccaatgtgttcgttcatctcatcgacagcatggccgatgtgtcattcatctcgcggacggcttggctgatgtgttcattcatctgcacgatggcttgtactatgtgttcatccccctccggaccgcttggccaatgtgttcattcatttcacgatgcgcttggcccatgtgttcattcatctcacgaccagcttgtaccgttgtgttcattcctctcccgacgcgctcggccgat

SEQ ID NO: 555726 - DNA, 432 bp, Homo sapiens
  misc_feature (11)..(11): n is a, c, g, or t
  misc_feature (41)..(41): n is a, c, g, or t
  misc_feature (53)..(54): n is a, c, g, or t
  misc_feature (69)..(69): n is a, c, g, or t
  misc_feature (115)..(115): n is a, c, g, or t
  misc_feature (159)..(159): n is a, c, g, or t
  misc_feature (272)..(272): n is a, c, g, or t
tcatgattggnggccactgtccaatcatgatgccgacagtncaatcatgatgnngacagtggcccggtnactgtcggcatcatgattgggattccgttcaaagatgattccattntggcccattcaatctattccttcggttctattcaatgatgattncattcatgtcgatttggtgattccatttgacttcatttgatgatgattccttaagttcattagatgattccattcgattccatttgagatgattccattctagcccattcaancattccattcgattctattcaatgatgattccattcatgtcgatttggtgattccatttgacttcatttgatgatgattcctttcaagttcattagatgattccattcgattccatttgatgatgatcccattcgagtccaatcatgatgccgacagtgg

SEQ ID NO: 555727 - DNA, 226 bp, Homo sapiens
actacgaccccttacggtgctgacagtggtatcatagttgatgatgagtgttttgtattctattttggtgcatatgtgatatgtttcataaagcttcataagaaaaaaagattttaacttaatgaatatttgagtggactgcaattgtgcactcactaccataatggccctgtaatacaaaagcttccaggtgaatcaatgtagagtgatgtggatgtgatctatc

SEQ ID NO: 555728 - DNA, 195 bp, Homo sapiens
agcagtactacagactcatttcattttgtccagtgtgggcagtggtccagccagatttaaggttgtgtttccagaatatgtgacaattgggaaaggaaagacatttgacaaattatgtgggaatactcatggggaattttaaagctcgtagaactattcaggctttccagttgttgagtctgtattaactgcttg

SEQ ID NO: 555729 - DNA, 158 bp, Homo sapiens
cctgtcatcatggcatcagtggactgcgagcccagcaggcgcccggctgagagcttccctgaccttgtcccgtgaagcccagaagttcgccttggccagggaagtggtgtacctggaaaggcatgtaccacttgcccgtgcacgccctggctggcccc

SEQ ID NO: 555730 - DNA, 655 bp, Homo sapiens
gatgaaatagagactgccgttagtctatagtacttgctttgaaatatgaacgctcacatctgtgattatccatagttgtaaaacgaaacattcttcatgtcctggccacttgttatttgagccgacttcagtataggggttcattggaaatatgtgaaacagtctttccattcacttgctctttaaggggcagaaatggctgcttatttgtggggcaaacaacagtgtggacgtagcagcagcctgcactggtgtggcattttcatgcagccaagcatgggatccgaacagcgaggggtgatgcataggaatggcgcatacttcgtgtgtgtaagggaggtcagaagaggggaccaagtgctttccacttactcatagtaacagtaatcgctccatgagtgcgtccagttaggtataatgctttctgttatggacggcaataaacattacgaaaggaagatttatgccaacattttcaagtctccactattagtatggcatcattctggagcacttcagtcacactcgttgtgagcgtctttaggcgtgttctaagaactattatactctatcatttctgctgcgtgtgatgactttcatggtgaataactaacgctacaacaaataaacgaaacactcaggttaacctccaacc

SEQ ID NO: 555731 - DNA, 470 bp, Homo sapiens
taaaatactgagtttaatttcacatgtatatttatggttccccccaccatttccagtgtgtcgtgaccaccggttactacatagtgttcctattcataacatctccatacattacttaaaaccaagcaagggggtggagtccactctttaaaaactaaacgaggcttttgggacaacaaaattctggggcaaataaaaccgtggaaacaccattttactcaaacccgcggatagggaacagtttcttcactcgtgacatttatataacaagggaccaccccagaaatattcaaccgtggtatacagaaaatgtgaacattaagggacggagagaacatttttatatatacacccaagatttgtgagtattaaccccatattagtttctttttaaagaggagagaacaatctccactcacaactgtgtcgcaagaagcatctcttgtggaccaatagggccctctttggga

SEQ ID NO: 555732 - DNA, 409 bp, Homo sapiens
  misc_feature (53)..(53): n is a, c, g, or t
  misc_feature (409)..(409): n is a, c, g, or t
taattgctaggaattgcggcagccatgagtgagtgttcactgcctgctgctgngtccgcagtcccagctgtctgattcacttccctgtttattgcttgctctaccgtagacagacagacagacagagcccacattggtgaaggctccagcccaggcagagaggatccctgaggacctgcaatttaatttcgagcactggctcaatgtcatggtcccagtgcctccctgagttacacagagcaactctggagttattatgtatacctgatcccaatgttaaggggagggatcattcctttacggtcacatggtccagatccctcagtctacaattaagtaactgggggctcagtgaggcatcgtagcttactagatgcccacagagcagatagccaggtacactctctgn

SEQ ID NO: 555733 - DNA, 123 bp, Homo sapiens
tgtgtgtggtgactcttgaggatcccactctgactgagtccctaatggctaaataccggcacgagacctgatagtcaacaatgtacctgttatgggaaagcagtggaactcggtcagagtgtg

SEQ ID NO: 555734 - DNA, 1321 bp, Homo sapiens
cagtgggagtagcaggattggtggttgatgtgtgaaacacgatgatagtaggtagtcgacgcgtacactgccagtagatgtggcttggtgtggggaagctttggtgcccacgagtgtggacctgcgcgggcgtaggaagcagcgtcggactgcgtttgtgcgggggatcaccccacctcgccattggcggcggctcgcctgtgccccttggttgtgggtggaactgcggggccaaaactgtggctggggcgcttctgtgcgagtaataggggtcccacgaagtaagcgttggtcgcgggggccacacaaagatttttcacttatactggatgggggtgtggaaattcatcatgggctcgccctgaccccgttggggtcgctgtttgttgcacaggaattctttgtgggcatgcccgtgtagacagcgccgacgcgctgtgtcactggttgccccgtgtgggaggtgtccccacgatacccttgtgtccgtcccacacatgtcaagctattcgtggcattggtgccgcccggtgcaagggtgcccttggaccccgtgcctggtggggagttcatgccatgcggcccttgtgtcccacccgcgggcacgaattcccggatttcaccgctatcggccccacatggaggtgccgctctcctgttcgagagtcggaatataaagcataaagggtcccccgagtgttatcacacccaccgcgcttgtcttcacagtaatatttcccccgaccacggtgtgagcacaggcattcaccgggcggtaacccttgtccaccgcgggaattctggtgctctttctgttgcccccgcaatgtgtgtgaatgaaggtgaaacgctgtaaccggttctggggcccaccacaccccgggcacaactggcacccacctatctgtggaggacccacccccgtaacccgggcgaagttccgcgaaagaactgtgcgtgtcaccgaacgccggaacttcgaggcccacacactcactcgaacacattctggcccaaggccacgcaaagatcgagaagtttatcccgggcacaactgaggccgggccttctccgcgaacccttccggcccacattctaatcgggcacccgcgggctccggcccgggaacccacggacccacgccacccgcgaccacaatcacatgctgcaacccacagggcgctttgactagtgcgccccccacatcaccgacgagctgtggggacaccgcgccgggtcctggcaacccaatttgcgcatgacggtcgggcggagcttctgtttttcccagcccatcatgtccacccaagggaaacttcca

SEQ ID NO: 555735 - DNA, 364 bp, Homo sapiens
ttgctcccatagaacagacacgaagggagaggtttagttgttgagataaggtcttgttctgtcacctaggctggagagcagtggtgcgatcacagctcactgcagcttctgcctcctgggctcaagggatcctcctgcctcagcctcccaagtagctgggtctacagacgtgcaccaccatgcctggctaacttttgcatttttcgtagagatgggctttcaccatgttgctcaggctggtttcgaactcctaggctcaagtgatccacccgccctggcctcccaaagagctgggattatagacatgagtcaccacgcccagcagagggggagattgtatgtattctgatgggagaagactgcg

SEQ ID NO: 555736 - DNA, 870 bp, Homo sapiens
gagtgctgacattacatggtctcgccacctccgcgtactcagacatcatgagttggtccttgtctcccccgtgtaattctacatttcatctacgttctatgtctcctgggtgatgttgctcctcgttccaagcaatgctgcttctgtcagtagttgttggctagccacgatgcagcgaatctgtatgacatcgtgtaaggaatgaaacgatttcggatagcttatttgtcccagattagcctgttggctcttgcatcattttgcctgtcgtccattatcaaaacctcaatgtagacatatggattctatcgagtccttcggaatacagtcttacacttcgatgttgactgacgaagatcaatcatgaagtctatggtcgagctgattcaacatatgcctaatcccatatttcagcgtataatcaataccctagtagtcgaacatctatgccaaaaatcccttacagttagtgactacgaacgggcgttggcttaacttgtggtgtagaagttcgcagggaggccaattgctctagcaagcaccttgtttatgttgaaaaattagatagatagcctacctcttgagctattctaaccaacaagttgtagcactccaccgctaatttccgatctatctctctggccatcggagatagattagatcctaagattcgatatagatataggtcgaataggctgattccttgtgcaataccctctgaatagaacgcacggatagagagtaaggcacccaattgtcttttggaaaggccaacaatgctcgcccactgtgtagacccactttggcccaaagggaccgaccgggttcgcttaaaacttccaatagaagccctccagtgtagggggacca

SEQ ID NO: 555737 - DNA, 1529 bp, Homo sapiens
  misc_feature (942)..(942): n is a, c, g, or t
cgatgattgtgaagctatgagtcacgtgattgaccgagacgatagaatagtagcaggaagacaaagtactatactaaatagttcccagtaccaccacttgcatagcacgtcatagtaacgagagcgaaggccataacgcaggaagaagccatatgtaccagcataggctgacagaaccagagtaggatgcatgcagcggataacgctgattggcatgtgataggctgattgacgagaacagatgaacacacggtgtcttgatagacgaccggacttccactgggatatgaccatggtatcattataggagaagcccaatgttgccaacgacaattgactcctcgaggaatgcttggacctattgaacatcttcgcactagcattagactccgcgacctcgcactcgccaggacaaccgtggcctctagtagagcactagcgctatacagacccgtggaagctgactttggccgcacactctgatgggattcctatgatagccacctacgcgacaatagcctatcgttacaattcacaccttgaactatgttgcctacattgagccccccataactgtgaatacttgcacgtaacgtctcgagagacattgttgcggaccacctagtgtgtaatagaccactcaagcaatcttcgttacattttcaaggcctccctgagtccactacccaaccaactggctacccaaagagaactggagcttgcacagcccaggcggctgagtttattcggaccaacccaagcgccaaacaatatagggggcggcccacctccgacccgttggttaaccccttcagtctgccaccacgttcctcatgttcgtacacctggaacgaccaaggcatcctaacacgcaagtgccattttcaacccagcatactttctaacgacagttagagcacaccaacggacacgtgggctccnccgagtgagtctttccacccatgcggtgaaagcttcgtcgcctcaacgccgttaactagagaaactaaacatcccgcaatgaggtgccgcacgcttgcacacacctttctgttttcctacgccctacaccacttcgttcgtacgccacacctactttacgcaaacggtgaacacgaccctcccctcccttatcagtgtatcgccaaccacttaggcgccacgtagacataacaggatgtggggtcgcgcagctagagtttaacatgcccctttcgccgccattactgtacacacgcaccacgcccaggtaaccaacactatacacacacccttcttccatctacgcaacccatatgctccaaccactctgataagccactaactaggctacctcacaattcacaacaacgtaacaacaccctaccacatctaaccaaagacttacacaacacacccgatacatatactcagactacggacaaaacacacatcacttctcctaacaccatcacgaatcaacaccaccctgctataaccattatccacacataaaccacgatacacacctcacaataaccacatcaaac

SEQ ID NO: 555738 - DNA, 591 bp, Homo sapiens
aacctatggactatattgaattaaacttttttttaaattatggattctaagaccgggagtgatgggttactttacaggggggtgaatggattactgtatccaaatggtgtttgagagaataagtgctagtagtaatatgttgattgcaaaggtttgcatatctacaaagactagactttgggagcttgttttatttggactttgaaagccattctttctctcatactccgtttctttccctccggccccccaaaatttacaacttcagaacttgtgacagaaatctatttgcaagcatttacaattgctattggaatagtagcattacagtctttgtttacaactcgggggcaactcagactttactagactgtacactaatgtcaacagtgcattgcgtgtgcttccatgagccaatgttccacccctctatccatcatatttatcttgcccttgccttgcgttggcatagaacatctttgagactcagactgacacctgctatactctctatacctacactgatattagtgtcttttgatgacaactgtgtgagagagctctggtgtaagagctctacgttgaggccaa

SEQ ID NO: 555739 - DNA, 507 bp, Homo sapiens
gggcatcacaaccagcctccccctggggggctgggtggaaactgggccaaggacaaaaaaattgtgtgcatgttgagcaacccccacgccatttttggggggtggggtggcctggaccccaagttttccctaatgtatgccaaacgggcctttgttccctgggacgttgggggggggatgggggaaggggggttttcaagggcccggggggacatggcggccctttaaaaggattataaggggggtgggggggattttttttaaggaggggggggggaaaaagggggggaatactaaagtttaaacgtcccaaagggggcggttttacagggggggctttttttgttttaaccattgaaaaggggggggttgaccagttaatttgtagggggcgggggagggttttaaaaacaatttttgccctagggtttaaaaaaggaagggtttgttacagcccccagggggccctttttgggggggggtttgaaaaaaggattcccggtttta

SEQ ID NO: 555740 - DNA, 847 bp, Homo sapiens
  misc_feature (137)..(137): n is a, c, g, or t
  misc_feature (153)..(153): n is a, c, g, or t
  misc_feature (160)..(160): n is a, c, g, or t
  misc_feature (214)..(215): n is a, c, g, or t
  misc_feature (223)..(223): n is a, c, g, or t
  misc_feature (281)..(282): n is a, c, g, or t
  misc_feature (304)..(304): n is a, c, g, or t
  misc_feature (334)..(334): n is a, c, g, or t
  misc_feature (402)..(402): n is a, c, g, or t
  misc_feature (412)..(412): n is a, c, g, or t
  misc_feature (416)..(416): n is a, c, g, or t
  misc_feature (435)..(435): n is a, c, g, or t
  misc_feature (438)..(438): n is a, c, g, or t
  misc_feature (469)..(470): n is a, c, g, or t
  misc_feature (478)..(478): n is a, c, g, or t
  misc_feature (480)..(480): n is a, c, g, or t
  misc_feature (488)..(488): n is a, c, g, or t
  misc_feature (490)..(490): n is a, c, g, or t
  misc_feature (493)..(493): n is a, c, g, or t
  misc_feature (503)..(503): n is a, c, g, or t
  misc_feature (520)..(520): n is a, c, g, or t
  misc_feature (528)..(529): n is a, c, g, or t
  misc_feature (546)..(546): n is a, c, g, or t
  misc_feature (556)..(556): n is a, c, g, or t
  misc_feature (558)..(558): n is a, c, g, or t
  misc_feature (565)..(565): n is a, c, g, or t
  misc_feature (584)..(587): n is a, c, g, or t
  misc_feature (668)..(668): n is a, c, g, or t
  misc_feature (674)..(674): n is a, c, g, or t
  misc_feature (677)..(677): n is a, c, g, or t
  misc_feature (680)..(680): n is a, c, g, or t
  misc_feature (689)..(690): n is a, c, g, or t
  misc_feature (694)..(694): n is a, c, g, or t
  misc_feature (724)..(726): n is a, c, g, or t
  misc_feature (733)..(733): n is a, c, g, or t
  misc_feature (743)..(743): n is a, c, g, or t
  misc_feature (754)..(755): n is a, c, g, or t
  misc_feature (759)..(760): n is a, c, g, or t
  misc_feature (765)..(765): n is a, c, g, or t
  misc_feature (773)..(773): n is a, c, g, or t
  misc_feature (775)..(775): n is a, c, g, or t
  misc_feature (780)..(780): n is a, c, g, or t
  misc_feature (784)..(784): n is a, c, g, or t
  misc_feature (788)..(788): n is a, c, g, or t
  misc_feature (791)..(791): n is a, c, g, or t
  misc_feature (794)..(795): n is a, c, g, or t
  misc_feature (815)..(815): n is a, c, g, or t
  misc_feature (818)..(818): n is a, c, g, or t
agcgggccttaggggaacgtggctttccctgcagagccggtgtctccgcctgcgtcctgctgcagcaaccggagctggagtcggatcccgaacgcaccctcgccatggactcggccctcagcgatccgcataacggnagtgccgaggcaggcngtcccancaacagcactacgcggccgccttccacgcccgagggcatcgcgctggcctacgnncagcctcntgctcatggcgctgctgcccatcttcttcggcgccctgcgctccgtacgctgcgcccnntggcaagaatgcttcagacatngcctgaaacaatcaccagccgggatgccgnccgcttccccatcatcgccagctgcacactcttggggctctacctctttttcaaaatattctcccagngagtacatcnaacntcctgctgtccatgtattnctncgtgctgggaatcctggccctgtcccacacnntcagcccntncatgaatnangtntgtgccagcnagctttccaaatcgacngtaccagnntgctcttcacacagggntctggggaanancaaggangagatcatcaattatgaannnngacaccaaggacctggtgtgcctgggcctgagcagcatcgttggcgtctggtacctgctgaggaagcactggattgccaanaacctnttnggnctggccttnntccnttaatggagtagagctcctgcagcctcaannntgtcagncactggctgnatcctgctggnncggnntcttnatctacgnangtctnctgngtanttnggnnccaatgtgatggtgaccagnggncaagtacatcgaggaacaataaaactgag

SEQ ID NO: 555741 - DNA, 347 bp, Homo sapiens
cttctatttacggtaacgctctaagactcctgcgtccacttttatgtacctggctttcctaggctgggcgcttgaactaagtcatgaagccaaggagtgcagatctagatagcagagaagtcagtctcattctaaaacattgcaactactgttagagtccaccccatgaagctgtaacagattgtgtatctttgactgaattctataagtatctattgttcagactaaaacaaatgttgctagctaggttggctgtcgcaggtctcagtaggacattgacagactccagctttcaccctctggagaccttggacttccgtgccacaatgcatatatgagacccgcaa

SEQ ID NO: 555742 - DNA, 484 bp, Homo sapiens
gaggtggagtctcccaaacaacctaatcacttaaaagtaaaatatgagtggctggcaagatggcctaacaggaacagctcaggtctgcagctcccagtgagatcaatgcagaaagtgggtgatttctgcatttccaactaaggtacctggctcatctctttggtacaggttagacagtgggtgcagcccacatgagcacgagccaaagcagggggggtgcatcacctcacacggtaagctcaaggggtgagaaaacaacctcccccaccaaagggaagccatgagggactgtgcaatgaggaatggtgcattccaacccagatactatgcttttcccatggtctttacaacccacagaccaggagattccctcgagtgctgacactaccaggcccctgggtttcaagcgcaaaacagggcagccgtttaggcagacaccaagctagctgcagaaggttatattttttttttttttttcccatac

SEQ ID NO: 555743 - DNA, 597 bp, Homo sapiens
taggaacaaagatgaaatagaagtattgcccaattaatagtagaaagaagaacagagaaaagaagtactagaatacagcatagatacgacagacgacacataagcatagcgaaattggtgcatcagaaaagacgaaaagtacaagaagaagaagattaaaaccttactaataaggaaagggaagataaggaagaaatccattgagtatccttagagaaagaagttaagcagagacagaatcagataatgataaagcagttgagcattaatggcttcctccctagtaggttcacaataggctacaattcagaaggtcgtttaggaagagcaaagagtccttggtgaaacttcagcaagaggaattgaacaaatattcccacatgatagcgaatgatccacagtttaagtggtgtgaaaaataacatccagaaactgtgaatctcagtatagtagacattcatggcagtttaggaatttgtaatctcatgatatttttgatgtatttatctattgggagggggggtgggtaggggagttaattagtgacttcgtaacaataagaagttattatctagattctaagaaactccaaacaat

SEQ ID NO: 555744 - DNA, 977 bp, Homo sapiens
  misc_feature (974)..(975): n is a, c, g, or t
  misc_feature (977)..(977): n is a, c, g, or t
actgacttttccctgggtactgcaagaaagccagggagggcagatcttaccagttggctggattagtgtccaatgttggatgttccggttggatttggcaaagggcctcctggactgcagccgcacgagggagagagagagaggaagaaaaaaaaagggaggatgagggaaaagtgaagtgagagaaaagatggggcatgtggccagagaccctcaggatccaggaattaactcaagatgagctgctgttgcccactgcttcctgggttgcaagagagcctctgcccccagcactcatcccgggtttgggcaccaaatgtaagagttaaagaaaggaaagaaacacaaaacgcggctggcagttaaagacaggtttattttagacaaaacctgagaggcactcctggccgatttcgttaagaagtgtttccttttacagactaagaatatatatggttttagggcgagggggcttatcacaagcttggaatatttatgtgtgtggagaattttatggcggggttggaatctcttgggaggaggggaggttatcttggggcagacatctttccggcccagagaggggtttattttgaggctagtgtttttcttcctttagcttgttgatgtgatggatacattaattgacaaatgttaaccagttctggcatacctggaataaatgtcattggtcgtgactgtataagtatttatacatggtggatcagggtgaaatgtttgtggcaatttttgaatctgtgttggagagattggcggagttccctttaataatgatggcacagtttgggtaattttggttgaggtacagggccgggggtgtggggtcgggtgtatccgatggaaggggggaactgagggagttacacctggggagggctgttgaaaaaagggggtaatagcgcacataggaatagtaagggaagaaagtgcttttaccagactgtttgtgtganngn

SEQ ID NO: 555745 - DNA, 115 bp, Homo sapiens
gaatggattggccgccgccatactccttcaggacgcgccgttgtcgctgccataatatgggcggtctaggtgagctcgccaatctactattactggtgtgcagtcgtgatgagga

SEQ ID NO: 555746 - DNA, 729 bp, Homo sapiens
gctcactgctagctccgcctcccgggttcacaccattcttctgcctcagcctcctgagtagctgggactacaggcgcccgccaccatgcccggctaattttttttgtatttttagtagagacagggtttcaccatgttggccaggctggtctcgaactcctgacttcaggtgatccacctgccttggcctcccaaggtgctgggattacaggcatgagccattgcacccggcctcagctttactttcctaacagggatctgatagctaaaggaaaagcctttgccagtcacgatggctcaggcctgtggtcccagcactttgggaggctgaggctggaatattgcttagagcccaggaggaggctgcggtgggctgtgatcgcgccactgcactctagcgtgggcaacagggcaggaccctgtctcaaaaaaaaaaaaaaaaaaacagaagaagagaaaagccttacttcagatgtagagcagactgagctcattcatcatgatttcttcgggatattactggcaagcagattataagctcatctttgggtgaaaattggcgggatcttctgcagtccaagttcaaccaaacagggctttgatcaaacctttagagggcttcaacccggccttgaagactttccaaaccttcaaaatgagcggcttccttgacccagttaaaaagttaaaggaaagtttgtcttgcatatagagaggaaagccccttgg

SEQ ID NO: 555747 - DNA, 834 bp, Homo sapiens
gatgccgctgaacaagcatcgttaaggtggtctcgtttcaccctggccgtcatgtcgtaagttgcacgagtctcctaaagagccacgtaacagctgaagaggctcttcgaactccgtagggtcgagcttcgaaccaacggatgagagcctgcaggagccatttggacgcgaatgagggcaacgctgcagcggacatgtgtgctaatgcgagatccaagatcaccaagggctccatggtgctctgggtcagtcaccatataccactgtagagtgacgctgcgatgccgctatgacatgcatggccgacagctcagggtgtagtggagacgattcagctgaggaaaccgatggacgcagcatgcactccagaataaagagttgcgtactccgaggcagagtggcaccacatgataacatgtgaagatcaccagtactgtggccaagctgtgcagtcggagtaaagggcactaaccggaaccatcacctcaatccgtcattacctcccagggaaccagggcactgggaaaccacctagcaaaggtgggaatgcgacagatccttgcccgtgaggcagctggcacaactgggacacaaccccaggggtgactcgggaacaccggggctaatggccctcgagaccggacacccggtcactctcacgacaaagagaacaaggtccaatgcccgacaagtagacgagacagaaggacacaagtgccacaagcccgttccgcgtagatgcaaccagctcacgggcccgaagccaaacagcacggggatcatgcgtgccataccagggccacaaaagagtcgaaaggcagagcccgcggaaaa

SEQ ID NO: 555748 - DNA, 634 bp, Homo sapiens
  misc_feature (307)..(307): n is a, c, g, or t
  misc_feature (394)..(394): n is a, c, g, or t
ccgcgctgagcacgcccgcccaagaaaccaactagcccaacagccaccaccaccaccagatgaggcgcacgcccagcaacacccccgccacgccgcccaacggccccgatacgctggccatgcacgccaagcaccgcgcctccgagggcctgcatttgagcaacagccccatgacagccgcagcctgcgccccaccagcaaacagcagctctcttctgggcctcgcccccgcccagccaccaggcgccctggagcccgccctccgcccccaccaccgtccaccaccgccaccgcccacagcccacgnggcccccaggagcacagcaggggggcgcccagcagaaacccatggcgccattgaccgcccagaaataagattgaacccccccggccnttggcttgaacttggggcaaccccaggtttgtgggaacacagaagggccaggaagggggaacccggggagggcagggggtttcccgaagatcgcactgaaagattttataaaagaatttttgtgggtcggggggacagtaaacttcctgggccacgtgggtccttcaggagtttttcaggcaagtttttcctctgtttttaatatatacctataatatatatgaatagataaatataaaa

SEQ ID NO: 555749 - DNA, 856 bp, Homo sapiens
tagttctagatcgcgagcggcgccttttgtttttttttatttatttattaaaaagagagaaacccggataatgatgtcggggttgagggataggaggaaaaggggggataggggtatgaccatgagggggttccccgggggaacggagggtttatgttgtgaagggggggggtgagtgggccccatggtgtgggggtcaatatgtacaaaggagagtaatagggctggtgcactcatgtattgttagagccctggtaaagtacgggaacaagtggatattggactcgaggacaacggtggtcctaccaccagaagaagttcctccccagtgcggtaaacaaggggggcgggggcggaaaagcgcagacgagtcaagcagaggctcgtgcaaaacagctcatccaaaaaaaaactaactacggggggaaacaagagtctgagaagtcctctgaaaaggagggactcatagactgccacaggtgaagaggcacgcccagaactaaggaggttgcgactaaggcacaaaatacggaacgtgcgagcgatgagtaaccccggggggcgcaacttagaaaactgacgtcggcccgggaaaaactacaggggcggtagacctgaacacgcgggctggtccacaaccgacgggcacgtgggcctgactagcaagagcattgccaggaccaacaacaaagggcccggagaggatagacaagaaacataggcacgttgttaatactaatcgccacaaggagaaaaccaggacggggcaaggcatgggattggccaggggggagcaaacgacggtgagcgaaaaaccaagcgccagtaaaagacgtggaagacaactgccgaagcg

SEQ ID NO: 555750 - DNA, 357 bp, Homo sapiens
  misc_feature (336)..(336): n is a, c, g, or t
gctattatccttagcaaattaatgcagaaacagtaaaccacatacttcatattctctcttataagttggagctagaaatgagaacttacgaacacaaagaaggaaacaatagaaaaaggagcatattggagggtgggcagtggtaggaggtagaagattaggaaaaatatttattgggaatgaggccttgtatctgggtgatgaaataatcagtacaactaatgcctgtgacataagtttacctgtatggcaaacttgcacacctacccctgaagccaaaataaaagttataaaaaaggtgatggtctcacctattctctttggggaaggctccanaagtaacagctacctctagtt

SEQ ID NO: 555751 - DNA, 975 bp, Homo sapiens
aagagagagatatagtacaatttgcaggctagagtcatttatgtgaaactgggatggggggcatcaataaaagcaagccaagaggagtgctgctgagaaattactatgcctatatgttagtaatatatctccaaagaagccacattgctttaacaaatgtagtaggacattctttagagatgtacttggcattccttgaggagattctcctggtgaaaagatcgacttactgaaaagaagcctccttagtattcctaatacagattacatccaggctgcttagtgaaattgccaaggaacagaggtttagtataacatatgtgcatataggatgaactgagcgccaagtggacaatgatcaatgtcttgctgaactgtccaccagccccatcacagtctgtcatggctccggtatctcctgtggccaatgcacaaaagtgatgcagctcacaatgctttgcaagtatttaaagatcatagcagaaacgaaagtaaatctggagcaacttaaaaaatctttcagtagcacataggaagttcccctctggccccttcccaagtaaaacttttaccgtagatgtttatgtcttgtactaaatctcttcatagattcatcacactccagatttaattatctcctcatagttgttattaaagcccctttaaaatgggttcactttggtatcaggaatacgtatttaataacgttgttccacaagagaagcatgtagacccattttacggtggcggcctcgagcagaaactgcgtttggtggggatgactaataaaagtgtaacaagattcatatgaggagtaactattggcaagtcttaagggacacgaacgcaaatagctggggcgacagcctaaagatgagagagagacgaggaggggtatcaaaacgaggagattaagagggaaaaaaaggcatacacggaggagtacagcacacttgtgctctttgccgcgcgtga

SEQ ID NO: 555752 - DNA, 327 bp, Homo sapiens
gctttgaggcagccctgggcgttatgagaacactcacatatgtggaggatgcaccggtgacaattcatatgggcatgaggagtacgtaggatgctgcttctgcgggactgggaatgcgctgtttctcaatgacctggtctccgagacctgaacggatacacctaatgcagactttccatcttgatgacttatacttgtgccaacttctcaaaggaatccactgtgcatgaccacacgacttccataacgggggctatgacgggtacactatccgacgctctggcaatctcatctgacaagtgggccgatggtgggctgacagcgtct

SEQ ID NO: 555753 - DNA, 112 bp, Homo sapiens
ctgtagtcgctcttgtgacaaatacaccagagaaggagggaagaaataaagaaatcaggactggaggagagctttgtgcctgtttgctgcacccctaggtcatccaagagcg

SEQ ID NO: 555754 - DNA, 129 bp, Homo sapiens
tcaagaaagttgcaaatatttgaaagtaacaataaagtgtaacgagtaatattgactaaattcacagcagtccctatggtagaaaggcagtgaattcatttctctggtagacggtcgggcagaacctca

SEQ ID NO: 555755 - DNA, 189 bp, Homo sapiens
ggtcttgctcaatccggcggcgatcgcgaggagcgtcttacccgtaccggctttacccacgagcgacacgagcttcacctcgtcgttgaggaggagatcgatggcgaacgcctgttcggcgttgcggggatacacaccccacaagccttcctgcggcttcatcacggttaccaccgcgttctgcacgag

SEQ ID NO: 555756 - DNA, 107 bp, Homo sapiens
ccatttctacacgtcaatcaattgaaatctatcgggaaaagcacatcgcatccaagcctgcatgcttggtgtcgcacacattgcacacgggtcaccgcagctcgcac

SEQ ID NO: 555757 - DNA, 230 bp, Homo sapiens
cctgatgtcaaagaatgtggacgatatgttgaaaccaccgggccgggagaccatacctgagagaattgttcttataatgcgaggactacctggcagtcgaacgacacatcttgcaaaactttttcgcgctaaggaggccgaatttggccgcccttcacccagaggtctaatcctgcatgcctacttcaccactcaggtggaaaatgaagaaaaagagccagtttctggca

SEQ ID NO: 555758 - DNA, 104 bp, Homo sapiens
agaggagtatgtcacagacccagagcagcgatgggaccacctcgtcttgaatatgaccttgtccagaaggctggatgagagaccttctgtccctacccagaggg

SEQ ID NO: 555759 - DNA, 162 bp, Homo sapiens
tgcggtgcatttcccatcccgacactctgggatgcatgtctagtgatatcatatttcctccactggaaatagaactctttttttgtatggtttgttttgggacggagttcgctctgttgcccaggctagactacagtggcccaagtcttggctcaactgcaa

SEQ ID NO: 555760 - DNA, 774 bp, Homo sapiens
tactagaaatattgggttcttttaatcagctatccagggggtaataaaataaatttaaggggcacctaatttaccatttaaaatagttcattaaaagataatctacaaaacaaggttatgcctatgggtcaaaagtaacaccttttttttttcacaagaagggagaaattaagggcataatctcaaaattgagtggctaacaagggtgggtccattgtggacactctacagagtgatccgtgtaggcatactcggcgggcacgagtgttggaaaaccacactccacatagattaaaatttagtgggtaagataaaaaagaaaagatacactttctcagaggtaggtggttggaaatttaaagaaaaattatccaccattatttttacaagcagatcttttaaatggacatagttttagccattaaaagagtgggtggtttggggaaacactctatcctccttggaaccatttctcacataaattttccaggggtataaattaccgtgaacagaaataagttccggggtccgtgtacaatttatgggctccctggagttacataacgcccctcccagccccaccaaagctcaattgggcggggttccagcagaaattagacggcccaaattttaaccagaattcatagcatcccaaagtttcagaacccctttggtttcctccttgggtgcttacccccaaggtttctgggcgactggatggccgattgtcgcttttggtgccccggtttatgggctaccttcatgggggaactg

SEQ ID NO: 555761 - DNA, 168 bp, Homo sapiens
agcacgtcaggccccactgcccctaaatagtttgaatcttgatgttttggtttccaaaggacttctgattctagctacagtagctttgttcattctcctgcgctcactatacacagaagaccactttgcttttctctgcacaccaccactggcaccctagcatggaag

SEQ ID NO: 555762 - DNA, 82 bp, Homo sapiens
gaggacacacaggcctgagcaaagggcctgcccagacaagattttttaatgtttaaaaaccgaataaatgttttatttctag

SEQ ID NO: 555763 - DNA, 1160 bp, Homo sapiens
taatagttaaaaaattttattcctaatagctataattacagggctggtttggtcgaaatgaaaactgaaaacaagttatacaaaacagttgattactaatcgtgttcttgaaagcagtaagaggttccaggaacaccaaatagaccagttctgaggtttccccaaaataaatttaacagctccagcttcagggttaatcaaaatacaaaaagaaaaaatgtaaaggtgtgacttattccagatggcaaatcgagacccttgcaggctagagggaaaaaaagctacatcacacacagagggtgggggtgcccccgaggggcatgggggctacaagggtggaccgccgtgcccggctagcacgcgactccgtgcctggtgaggccccaaacatccgtgccaaaggggttcgtgaccgagcacaagtcgtggggacgaaggacccacctcgtggccacacggagaccgagggacacgaaggggccctgggacccaaaggcggcctgaaggagggaagggggccatgcgagacaaaaaagaggagaagagaagagaacatcccagccctggcaccctgggaaacagtggacaacaacagggaaacaagcacgtgacaactcggaacagccgggaggcatccaaggaccaagagaaaacgcggggaaacactcactggggacccgcatggcagaacatggaccccacacaccgcgtgcgccaaccgaacgaaccacagaaacccgaaggcgaaccacacctgccaggacaaacgggacatcaagccagcaacatgtacacctacatcacagcaagggtccccacacggagggcaccgacgaccaacatgaaaccaagcaaagaataaacagcaggccagagtcagggcaaaaaaccaacaacgaagcagggtacacaccaccaacaaacgaaaagaggaggcgaggtcaaaaaaaacaactatgaagcgaaggcagaaagaacagccagataaccaaaaacgcgtacgatactaaccacaaaaaaacactaacaagctattagaggtcaagcacagaagagtaacaccactcaagagcgaacaaaaacaccacaacaccacaagaaacacacaacagcgcgacaactgaactggactctcgctatgctatgcacaaccaggaagt

SEQ ID NO: 555764 - DNA, 332 bp, Homo sapiens
cagtcagaattgtgtaagctgaaccagttggaatgtctgtggcgttggctatggtttgtactgttaatcatcagtactcttcaattagggcacaaacaagattttttttttccttgcaaattgatgtagtttgtcttctatagtgggcttcatcttcaacatcatctcatcttttcttaaaataaattattcatttgtaaactgccaatttcttgtggcattgcccccactaacattttgtaaagcagcaatgatttcctgattttcccaccccaactcccccacctcgggtgtaagcgacaggaagaaataataataatttaagattcaaa

SEQ ID NO: 555765 - DNA, 164 bp, Homo sapiens
caagctcgacatggtgatctccacgcgcgcctatgccaacctggaaggctttgcgctgcgcacctcgccggtgtggtggatttgatcggcgcaatacattcactcgccgagcgaaccgctgccgatgattctggtggatgagccgagcatatatcgtagctatg

SEQ ID NO: 555766 - DNA, 288 bp, Homo sapiens
gaggggcacaccctgcagtgcattaaaagccaccatcaaatgtggacctggactcagtttccctctgttccctcccaccctcgagtgtggacgtggactcagtttcgctgtgctctcgcacaatctaaagtggggacggggacagagtccctctgtggtctctcacactcaaaagtggacgcggacacagagttcctctgtgctcgctcacaatcaaaagtggacgcggactcagagtccctctgtgctctcgcacactcaaatgtggacgcgggctcagagtccctc

SEQ ID NO: 555767 - DNA, 134 bp, Homo sapiens
ctaggctaacctagacgaacctacgccaaatccatttcgctatcatattgcatcggcgtaaatctaactttcttcccacaacactttctcggcctatccggaagtgccccgacgttacatcggatctaccccga

SEQ ID NO: 555768 - DNA, 507 bp, Homo sapiens
caagcagttaatacagactcaggttgtgattgatgcaggacgaattcgctgtctttcccagcctgctcaccaaccccaaaactaacatacagaaggaagctacgtgacccatgtcgaatatcacagccggccgccagggacccagataacggcaagtggtgaatcatggattcgtcccatcccttgtcgagtgtgctctctaaggtaggattgaaggacacaaaaggaagctgtgtagggccgtgacacactataccagtgttggcaactgttgaaccagatagggtaccttgtgcacttgtggggataatagacaccgttgatgacacctcttaactgccatggatacccaagattaatgcgggttatccctggatgcctttcctattatctttcgggctgctgagccacttacggtgacacgtgcgaaatttagtatagtgattgcagattgtggaggtgtagaccaagattgcagctctacaaacccatgaaaatgaggtctgt

SEQ ID NO: 555769 - DNA, 442 bp, Homo sapiens
cgacgaggggccaagcaggttacataatttgtgtacaccatttttacttattacaagattttcaaaaattctgtgcatattttaacaaggccaaatgttctcagtagcttaagaaataaaaatgtgtggttttctcttcactttttcattcaacaaatatttatgcaacatctaccatgtgtatgagacacatttctctattttctacgttttaaaatatatgcctataccttttgtatgaaaaaaatgctttaaattttcaaaataacaggttaaaagatacattatttaagcttaaattttttaaacataagattatttcactgcatgccctgtccagcagaaaatataatgctatagaatcgcatctggatagcacttcagtttgttttaacctcacaataatcctgtgatataagcaggaaagtgactgactgacatt

SEQ ID NO: 555770 - DNA, 102 bp, Homo sapiens
agatcaccataggataagcacggagactaccatacgaaaagttgatagagcagacgttcgaatggaggcacccgtaggtagtaggcacccgcgtaggtagta

SEQ ID NO: 555771 - DNA, 325 bp, Homo sapiens
  misc_feature (91)..(91): n is a, c, g, or t
gcaaagtggaataagcctatcacaaaaaataatattacataattctacttatatgaggaatctagagcagtcagtttcccagagacagaanatagaatggtggttgccaagggctgggagaagagggcaatggagagtgagtgtttagtgggtcagagttttagtttgggaaggtaaaaagttctggagatggatgatggttatgggtgctcaacagtgtgaatgtacttaatgccacagaactgcacatttaaatgtggttaaaatcatcacttttatgttatgtatatttaccacaataaataaagaagttgatatttcttat

SEQ ID NO: 555772 - DNA, 319 bp, Homo sapiens
gatgtatcccctatacatggcaaaggactgaaccccctccctcaaagcagcgcaggaaaagcctgctttggacccgggaaaaaaaaagcccttgctaacttcttccactggcagaaaccttcccttgaaaacaaagattttaaaaaatccctttctttttcttccgcccttaaaaacaaaacaaaaaaaactgtcccttttgcgcccaaatttttcgagggggcccttttattcatctcctttattttgatgtttccctaatgggtaatttcctttttataagcatgatcttttaaaaaaaaatttggcttttaaagta

SEQ ID NO: 555773 - DNA, 343 bp, Homo sapiens
gcagagtaactaacaacaccctaatacctcagtcacagggacaaagagtaatccaatgtacacacagggataagtagttgaagccacaattaatagaaggtacaaatcagattcattaaatgctatgatagttaaatcgagaataaatcgtctgaaatttcatcttggtgagttcgttggatatcaaagttgtatacgcacatttagtgggagctgttataaaataattagaagaatatgaagtacctgtcagggttacaaacgataaaaatattaatttaaaagaccctatttggtaatagattagatatatacaattgatggtgatgctcaaagatctttg

SEQ ID NO: 555774 - DNA, 202 bp, Homo sapiens
atgactcgaccgtatctcttagctggattctctctattgtactactcaaatcccatgagaagccttgattgacacgatcctgaagaccgaacctttatggctattcaagacgagtgtacctagagcttctccatcagcatcttcagcgattatcaccaaaggcttatggtgatcattggcgatttcaagaagcaggaacagg

SEQ ID NO: 555775 - DNA, 589 bp, Homo sapiens
  misc_feature (4)..(4): n is a, c, g, or t
  misc_feature (172)..(173): n is a, c, g, or t
  misc_feature (193)..(193): n is a, c, g, or t
  misc_feature (196)..(197): n is a, c, g, or t
  misc_feature (199)..(199): n is a, c, g, or t
  misc_feature (207)..(207): n is a, c, g, or t
  misc_feature (211)..(211): n is a, c, g, or t
  misc_feature (256)..(256): n is a, c, g, or t
  misc_feature (274)..(274): n is a, c, g, or t
  misc_feature (291)..(291): n is a, c, g, or t
  misc_feature (299)..(299): n is a, c, g, or t
  misc_feature (306)..(306): n is a, c, g, or t
  misc_feature (311)..(311): n is a, c, g, or t
  misc_feature (316)..(316): n is a, c, g, or t
  misc_feature (325)..(326): n is a, c, g, or t
  misc_feature (353)..(353): n is a, c, g, or t
  misc_feature (383)..(383): n is a, c, g, or t
  misc_feature (387)..(387): n is a, c, g, or t
  misc_feature (397)..(397): n is a, c, g, or t
  misc_feature (399)..(399): n is a, c, g, or t
  misc_feature (405)..(405): n is a, c, g, or t
  misc_feature (416)..(416): n is a, c, g, or t
  misc_feature (569)..(569): n is a, c, g, or t
agtntcctggagcacagaccgacagtatccattctcttcccttcccttaccaagcgaacccctgaattctagctgaatatcttggctatacagtctcccctcaagctgaactgtagctgtgggaatcagttctggtccacaggaattaacggaagaagtgtgtacaattttnnaactatgctctttagaagantgnngnggggtgtntttnttcccttcctcctgtgatgtgatggctggatggagctggaatggncattttgcaccatgaggnatctgatgtcctgcgtnggggaganctcaggnttcanttgcncactcaggnntacccgttgctctgccagctagatggnacacttcattgccacctgttcatccccgcncgcnacttctcggntnatgttnaggttcatttnctctgctttcttggtcttctcgtccatctggcgtggctgtgcccatccccctgggggggaccgtgcctcctgggaaatgctacctccgggatcgcctgggagaggcgggagaacaggagcaactcagccaggccgtgtggactccggcgcggnccaagccctgtgtgtgcctc

SEQ ID NO: 555776 - DNA, 126 bp, Homo sapiens
ggatccccggtacattcagcagaggaagaaagccgtctcaactttggtccagcgtaacgtgaacatctttaagtttcatcattcttaactgttgtaaaattacagcccgaactgcaacgttgctta

SEQ ID NO: 555777 - DNA, 422 bp, Homo sapiens
  misc_feature (8)..(8): n is a, c, g, or t
  misc_feature (95)..(95): n is a, c, g, or t
  misc_feature (414)..(414): n is a, c, g, or t
ctgcttcntcccttaacattcaaaagttttagggtaacttccttaaaattggccaacattgcttcttgttgcccaaaggaaaaaccgaagtgtcnaagcttaagaatagacgtccttcccaacaaaagaccaaactgctatttacttatttatttgacaaagtcttgctctgtcgccccaggctgcagtgcactggcgagatcatggttcattgaagctttaaattccctgggttcaagcaatcctcccacctcagtctcccaagtagctaggactacaggcacatcaccatgcctgcagtcccagttactcaagaggctgaggcaggagaaacgcttgaacccaggaggcagagattgcagcgagccgagatcatgccactgcactccagtctgggtgacagggcgacttcgnccccagaa

SEQ ID NO: 555778 - DNA, 439 bp, Homo sapiens
aagcggcaaagctgacggccaacttacacgtagtcagctgcaagaatatcagaaatcaagtacaaacaagatatggacaggtgttacagacatgcaaagctatccttcaagcgcaacgacattttcaacgaaatcacgctagcctatattaactcagactgttttacggtcaacaccaagctttccactctcgcggcttcagctgaaactagctacttaacctcacttgagctctccctttcccaccaggcaactgcttgggcaactggccagcaaccagcaacagcagcctactcacctccctctaaacttccttcttactgccacagctgcttacatcccaacccaccttactctctcacctgtgagcttctacctgtgcgacactgctactgcagcagcgcaacacctgcactgctcctcttctaccacactgcgc

SEQ ID NO: 555779 - DNA, 763 bp, Homo sapiens
ggggaagtgctctaacttttcttaaggttagttgctagcccttcaagtgcactgagctatgtgactcggatggtctttcacgcggcagatcggacattgccaggaactaccatggagcatggtttagacgggaattcgatcgcgatatcgacggggtcaaaacatcggtatatgttgaccccgtccacgtcctccaaggtcacgaccttggagcctcgtgtgagctggacttggaggaggacgggcttggacagtgggagagcagctggtccagacctaggcctctggagcacacacatctcaagacggcagccatgatgggcccgcgaaggcctccaggaatagggccctagccagaggcactttgtgctgaagtctcttgggtcgggcagtgacagtgtaaggtaggaaggcacttgagaaatatgtcgttccctagagcgaccttttgcaaccatcctcgtggggtaaagacgggacgaaaaacctctgggttctatcaattaagtcggagttaacattgtgaaaactttttcctgtgacagtggggtgacaaacatgcaaagaaagttgtactaaacacaaatcatcatcaccagaaagcgagcaattgggtcgcaaactgatcttacgtaggggccccgtgcattaggacgtttacttggcctaacagatctacaaaatcataagctcttcgctaaggatacttgactgtctctatgagaaacattcctttcggccatggaggtgcgtcagatcatat

SEQ ID NO: 555780 - DNA, 371 bp, Homo sapiens
  misc_feature (66)..(66): n is a, c, g, or t
tttagccaagccaagcaccacgtttcattcaggtcataaggtttggagttagactaggttaagttncaggctctacaattaactaacagtgtgactttgggcaaagtttttacttaatttttcttgtcttcatctgttctgaagaaagagaggaagccctatgttgtaggactgttgtgaggattacacgagttaacatatgctaatgctgcacggtggctggcatggtttatggtcttgtccaaaggccattttgttggactattacaccaattttggacttctcaatataaaatggatgtgaaaatgtgaagttcaaatagtggaatcactgggttaaaagtaggagttaggaggaaattccaggttgg

SEQ ID NO: 555781 - DNA, 343 bp, Homo sapiens
  misc_feature (286)..(286): n is a, c, g, or t
  misc_feature (330)..(330): n is a, c, g, or t
ggcacgaggagagagctagcaccattaccctggtccactcgctgacatcatctacctgcttaaaagtgctagtagttctcggttgcctcatcaaggtagcatctcattctcaggaaggagttaggccctcctcaacttgactccaggaccctctggggttgacctctcgtgccccttcccacacagcatggaggagaccagcatttctgccctgcctcatgctactttcccatcctgaaatggtctccccagccttgtttacccagcgaactcctactcagtcatnaaggcccagctccaacagccattcccttcttagagtattgtctngagcccagtgaaa

SEQ ID NO: 555782 - DNA, 318 bp, Homo sapiens
cagaggaaaatgaaagtaatccaataaaattctacctgtggccggctgcgatggctcatgcctgtaatcccagcactttgggaggttgcggtgggtggatcacttgaggtcgggggttcgagaccagcctggccaacatggtgaaaccctgtctctactgaaagtgcgaaggttggctgggcatggtggtgggtgcctgtagttccaggtacttggggaggctgaggctggagaattgcttgagcccgggaggcggaggttgcagtgagccaagattgcgccactgcattctagcctgggtgacagagactcttaaga

SEQ ID NO: 555783 - DNA, 536 bp, Homo sapiens
tcagatgtgtaagaggataaacagacactcgtaatgaataaaaatcctcctgcacgcggactcagagggagggactgaccacgaatcgtaaagtgggcatttagctgagcatggtttccactaatcattgttatttttctgagccagtatataatagttaaggacaagggagccctgcttgcttctgtttgggcttagagtccaggcttggctactcattagctgtatgactcatggcaagttatttaaccttcctgatccccaaatttctcatcaatacaatgagggtatgagagtagctactttctatgaacataatatgaaaaaaatatttagtgaaaaaaaatgcccgtgagatactttccaaaatggacggtgttgtttaaccgttactggtatatttttttggggtataaaaaactctcaaaaaaaaggttgcccttacatttaatcccctttttgaaccaataactcgattaaaaaaaaaggcccccccccggggtatttttggataaccccacgccccttttgggggc

SEQ ID NO: 555784 - DNA, 104 bp, Homo sapiens
gttaacgcagtgcaacggcatgaagaacgtagcacacagaggacaacaacaatgagcagaagtcgtagtcatgaacgaaagagacgcaacaagtagggacacgg

SEQ ID NO: 555785 - DNA, 832 bp, Homo sapiens
ggcagaagcttctgtgagtaatagattccactaggatgtttcaccgtgccttatcaagaccattctcagtctacttttttaagctaccgtatcttacaatcatggaaaagttgataaatggctgaatatttaataaccttgtgcttgtatgtaaccgaacaaagtggtttaagagccaacattatagagtatgacaatgtgagctgaacagtttttaatggcgcaagcagatctggtctggtgtatgacttgtaagcttaatttatggtgtaaagatggttacatgattatccttagcttggtaggtgggagacaaatagagaatgcttgtgacgtatgtcaagaacaatcttatctggtagaataagggtcacatgtattatacgagctatatatagcatttggcccagaaagacagcttgtataacggctttgggaagtaactgctcgtgtacagtgtcttaagagctgagagtctgtgaggtgaggtaatattcttcatgctagagtgtcaagatgggtggtattgtagaaacgtggtcacaagatccagaggtcttaaaggttaggggggaaaatctatatggggaatggatctgtgtctagcatataccagatgtaatatatgccgtggaaagtgggcattgtgcacggactatggttgtcagaaaggccagttttatcaatatggcgtgtttgaaattagcaacgggtctactaatgaaatcgggtggtagttttttacgaactataatttgtggcaaaggtagaaagaaaaaaataacaaaacatggtggtcgcacgtgagctgaagaaaggttttcgaaacccc

SEQ ID NO: 555786 - DNA, 1068 bp, Homo sapiens
ggttctcgtggccgcggcagcgcggtctctgcggaggcggctggggtgctgcggccatgccggacctcttcctttccacgagctggcccctgctggctgccctgttcctgctgggaatggctgggctgggatgtgctgtgactgctggcctaacctcgactgtcgactacctgcgccgccctgccgatggtgaagctgccttataaagcctgctgccctgtgcctgtgccctgaagccactctgcctgccactgcctgcccctgcttgcccctgaactgcgggtgccatacgcatgcctccttgtgagtgactgggccggaccctgtgactgaccctggcactggacagacctgggactgaccctggctggtggctgctgcctcctgctgtgggctggggctgtgtgctgtgctgggtggccttggtgagaggcccttgtgctgcggggtgcatagcgtgctgacaatgtgcctcgggcgcgtagtactgacaggacacagatcgcctcgagaacatgtaccgtagcagccaggctgctgcgtgtgaacggccatccagaacagaatacatcgaacagacggcgcggcagaccgaacaccagtactacgcaggatcccgcaacgtgaaagtggatcagtgaccagaacaccgatgaccacaaccatgccaaccagccacgaccatggccgacaccagggggaccgctgacaggcccacggccaggcgaccacagccctcacccagagaacgcgcccgaacagggcccaaagggctgatgcaggccaacgactggcgcaatcaacggcaggaccaacacacgaataagaccagcgcaaaccagaggcaggcaaaacacccacaacaaaacacatcaagcaccgccccaagccagccaccatcagctagactactaactatagaagaccactaccagacagaagagacaaaccagcaagaacacacaccagacaacaccacccccacacaacaaactacgcactccaactaaacaactacaagccaataactactagactagtctccaccgtgacagcacacaacaagaa

SEQ ID NO: 555787 - DNA, 343 bp, Homo sapiens
cagcaagaatggcatatcaggaaacatgcattcttttcattcgaatcttcagaataaccctgagctgccgaagaccagcaaaagccatgatgactttctgcttaattcaggtgcttacaggattcttcagagtgtgtgtgaacaacaagctttatagtacgtttttttatgcgatacaaatccatacagagactatggcttggggtgagaatgtactgattactaggtctacagacaattaagacacagaaacagataggtagagggtgtcccgcatctggtggtttgcttctcatggtgcttgtctgtgcaccatattatttctgatttgcccttcttgctg

SEQ ID NO: 555788 - DNA, 101 bp, Homo sapiens
  misc_feature (16)..(16): n is a, c, g, or t
gtgactgacgcatatntctcccacttcatcagtttacaaagataaggggtaccttctaacttcacaacacatacattagctccaggcttcagtggctgacc

SEQ ID NO: 555789 - DNA, 480 bp, Homo sapiens
  misc_feature (57)..(57): n is a, c, g, or t
  misc_feature (195)..(195): n is a, c, g, or t
  misc_feature (343)..(343): n is a, c, g, or t
  misc_feature (409)..(409): n is a, c, g, or t
  misc_feature (420)..(420): n is a, c, g, or t
  misc_feature (467)..(467): n is a, c, g, or t
tcctcttgttcttttttttggcaaagcgtttttttttcttggtgcgcaccacgtgcncttgctgcggactgcttttcttggcaagttttggggttgttcaagggggtatggttaaggctgtgttactggttggtgctggttaatgcttcacaattttttttgtctcgttgcttccttttgtttccgatttagtgnctgctgctgtggtatctgtttgcaacaacgacaacattattaggttttgaactatgatttagtagcaacttaggttcccaattttaaccccttggcagcaagatccaagttccctcatttgcacattagcacctaagtgtcaaggggntaaataaccagcacaaaagatactgcacttctgattgtagcatttggcagaactgaaaggaaaggnagttgtgctanatgttcaagggattgtgggccacataaagatgacaccaagaaaagantaaatgtcacatg

SEQ ID NO: 555790 - DNA, 388 bp, Homo sapiens
atctaggccggtccttctactgccttactcctatggctagtatttgctcgcctcttcttttcttactgtctcccgccgcttctggattctccttgaactgcttgcaaaaaatatattccgcaaaattgtgacgatccatgagcaattcttcaacagacaacttacttggggtcaaagaggaagttactcgcccatctccttatagagggtctccctgttcgaatgccttatccgcagcttgtaatactttttcgtgtgcatccttcacaaagctggtcattttttcaacaaacttgtctttttcatctgtggcagctgggaaattctgaacatcacgttccacatcagaaatttgtttcttcatctgatctaggttcttttgcaagtt

SEQ ID NO: 555791 - DNA, 606 bp, Homo sapiens
gcgccgagtctgggcgcggggacgcggggtcggcgcgacgcggggccctctgccgccccgcgctcccatgtacgccttttactcgttgctcatctacctcttgctatcagcctcttccgcagggatggtggcgccgtggcggccgcggagcccggggaccccgcccagagatgcccgaatgccccggggtcgctcggcgccctagtacctgcccgcgccagagtctgtgagaccgagactgacctggcctggcctgccagctccgagacctgaggatgggtcggaaggcgcagccgagggtcgctcggccgcggtgtccctggcataggccctacttgtcgcctcgccgagtttcctctccgtccagactgggggcgtgcagagatgctgcggggtgcccggcggtagctgggtgctagtctggcgaggttccccgtcactgttgatcgatgtgaccagtacaggatcttgggcccttctggtcatggcttcagatagtcaccagcggggaggcagtgccctgctccaggggacgtcagtcctagtgctcctcgggtccggtcccccatctccaagatggtatccaacattcccagagaagaaacg

SEQ ID NO: 555792 - DNA, 362 bp, Homo sapiens
tcatggtcgtggttgtagtccgtgcgagaataccaaaaaaaaaaaaaaaaaaaaaaaaaaaaaaaaaatttttgggcggcctgggcccgggaaattttaaaaccaggtgggggccgggggcccaagtgggttaggtgtgaaacgtgtgccactaacgtggctccccaaggaagaaccggggccaggacaaggttgctgtggtttcctctcacaaatataaaaaacgccgggggggcaaccggaagggttccgtgaaaaaactccaagaagagggagctcggaggctacacaacgggactccatactcaccagagagcccagaccggacgcgatattactaaaattaacgcccccggcgagga

SEQ ID NO: 555793 - DNA, 664 bp, Homo sapiens
gcacgagcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaattcgtcgttttgaagtgtcatcttctcttattctacgcaaccacaacgaaccatttctcgatcggattgtgacgtgtgatgaaaaagggattttatatgacaaccggggacgaacagctcaggggttggaacaagaaaaagcctcaaagcacttcccaagaccaatcttggacccaaaaaagtcaagggcactattggagggccggctgcgggtctgaaccaccaaaactttttgaatcccgggg

SEQ ID NO: 555794 - DNA, 342 bp, Homo sapiens
atcatgccaagtgaaagaagtaccgtccctatactcacctatagtccccaccactcaggaggctgaagcaggagaactgcctgaggccaggagttaaaaaccagtctgggcaacacagcaagaccccatctctaaaaaaattaacaaacattagccaggcatggtgtgtgcacctgtcgtcccagactacacgagaggctgaggcgggaggactacttgagctcatgagttcaagaccagtctaggcaacacagccagacctcctctctaaaaaacacagacaaaaacatttatatgcagattctagaacacaaatcaaatctatcgtgacaaaaagtagat

SEQ ID NO: 555795 - DNA, 110 bp, Homo sapiens
ttccccaattatatttagtacaagagctcaaagtacctcacaaaattaaaatgcttgtgctgggagtgctggctcacacctgtaatcccagctactcgggagacgctgag

SEQ ID NO: 555796 - DNA, 165 bp, Homo sapiens
aggaggcgcctgtaccggtcatgtgcattctgggactgagtcagtaccctggagcctagcccgcgtgtcaggtacagattcgccgtggggcagtgctgctcccgaatgatcaccaacagcctgaaccatgactctccacccagcacaccccccaggcgcccggac

SEQ ID NO: 555797 - DNA, 995 bp, Homo sapiens
gcgcctgcggcagtgggggtgaccgaacggctcgcggccgcgtggaggctgatcccagccgcgcgcgagtcgtactcgtgagtgggggtcccggcggtggttgtggtggatgtggtgcgagcttgtcaggtggctcttcgcgcattatacagagggccccaatggtgaagaggcggggccgctgctgtctttgccgaccgcatgcagctccgggagcacgagggcgtggtgtggagtatacgccggtctttagcgagatgcgtgacggcggcccaaggacacaatggatgaacttcgcatactccgactcggtccttggatggcgcgcccgatcaatgtcggtgcgcgatgtgaatgcactcggggttaatgccatggtagtgaccctgaatctgggagcaagatgcatggagcataacggtgtagttggagcaaacagtccacacgcctcatacacgagtattgacggtcctgcccgatggaggcaggtctcctgagcggagctggatcgcggggcgcgttggctcgaggagaggacggaagcaggcttgagtctgagggtgacgccagtgtgcagcctggaccgtcggaggcatgatcgaatgagcacaggctggggccggagctgctatcgagcgacctgctgagtgaaggagtacagtttctcaagtgtgggaggaggtaccatgaatgctgagggacgtccgggtgctcaagactcggtgcaagcctattggggggacgccactccgtggaagcagggaggataggagacggtggcaccactgagttgagaatagcgtggaacgtggaaggggaggtcgccctgtgcgcgttgcaatgcggtcagagaagaatagtgacagcatccgggacgaagatccggttgaagggcgtcagccacgaagacaagcctgggcccacgggagagtgggaccaagtcggaagatacagggttggtacacggacaattttcggaagtcgctaacatcacg

SEQ ID NO: 555798 - DNA, 182 bp, Homo sapiens
gggggattgtcttaaactatatttaagacaggtgaaactgatatgctttcttagtttgtcttatacagatttaactagctaatataccgacttgtgaatgttttccggttgctgataaaactattgatcggctacagtcgagtagcaacctgtcatccgtgggattggtgcaccatttttct

SEQ ID NO: 555799 - DNA, 449 bp, Homo sapiens
cgagtctgaagttgtagaacaagatcaggtctcaacatcgtgttatagatcttgctcatgagatacttcctggaacgcaataaactgagtctttggaaaccccgtagagaagatcggagaaaattggttcagaacgagcatttaaattaagtcagcaaagatccgaatttaaaattgggcaataccttgtctacatatatctttacactcaaattgtaccctggacaacagtagtctagtctcctggaagacatggtgcaaactgacatgcacatgtgttggtatactcatagtccaagtgggtgcacaagtgatggtccaactttgtgccatggtaaggattctcagggttgtttggccagaacaagagaaataactgcggacaacacatatagttggaaaccatgcgcttgtgactttttctgtagcctatgggagtggaccgagtg

SEQ ID NO: 555800 - DNA, 429 bp, Homo sapiens
cctactccgcctcatcctccttgtcatcacgtggcagcgtctcatccgacacgagggtcagttgttcctccagatcatatttgtaggccttctactcattcatggtctcgtctcatcatcgccctcagttagctgatgtgacctagtagctgagcagctcctcctgcacagtgctcagacagtgtatgcacacagcgctaggtaatatcatcagcgactcagtgccagttcacatctgctgccatctctgccgctcggtctgctggagcgagctcgggctccggactctgtctccgccgcgtgctacaccgtggcctgccatccagccaggaatgtcatcagccgcgcagacctcagcaccttcatcgtactgcctgtgctcgtccagtctgctcctcctcaagtacgtctctcgtgccgaattcctgc

SEQ ID NO: 555801 - DNA, 185 bp, Homo sapiens
  misc_feature (32)..(32): n is a, c, g, or t
  misc_feature (36)..(36): n is a, c, g, or t
  misc_feature (45)..(45): n is a, c, g, or t
  misc_feature (47)..(48): n is a, c, g, or t
  misc_feature (50)..(50): n is a, c, g, or t
  misc_feature (53)..(54): n is a, c, g, or t
  misc_feature (182)..(182): n is a, c, g, or t
ctgcgtgtgcatctcgacgagctaccccgagngggnaacatccantnngncanngcaggttcaagtgcatggttcaagtgcatggttcaagtgcatggttcaagtgcatggttcaagtgcatggttcaagtgcatggttcaagtgcatggttccccgggtgggtcacggcagctcgcaatcngtc

SEQ ID NO: 555802 - DNA, 332 bp, Homo sapiens
  misc_feature (294)..(294): n is a, c, g, or t
cctgatgtcacgctcgagcatcactcgctgactccggcggcatgatgctggtgaaatggccgaagcagttcgacgtcatcgtcaccgacaatctgttcggcgacatgctgtccgacatcgcggcgatgctcaccggctcgctcggcatgctgccctcggcctcgctcggcgaagtcgacgtcaagagcaggaagcgcagagcgctctacgagcccgtgcacggttcggcgcctgacatcgcaggccaaggcctcgccaatccgatcgcgatgatctcgtccttcggcatggcgntgcgctattccttcgacatgggcgatctcgccgacaag

SEQ ID NO: 555803 - DNA, 374 bp, Homo sapiens
agtatctcatcgtcatcagaaaatgatgaaagtgtctcatacagccggacgctctcaaactcttgcttgctggcctacactcgcaaagcacttgacgtgcgaggacaaaactccaacgggagggctctaaatgttgtatgaaagctgccagagtaattcttttcatcaacatgcaccatcaaccatttatgtccttccccagaaccttcatctgcagcataaggttcagctttgaaatacatgtactgcatttctcccctactcttgccactctcatcatattcactatcagttccagagtcttcttctgctgtatcccatgtttcttttttcccttcatttgctttcgttcttctactacttgtgatactgta

SEQ ID NO: 555804 - DNA, 575 bp, Homo sapiens
  misc_feature (230)..(230): n is a, c, g, or t
tgaaattgggacggggaacacttccccaatctcggccccagttctttctcaaaaataaggagcttcttggccttgcgcccgctattccagtatgcacccgtaggcgtccttcatttcttttgcctctgtgtcaggctgttaacgggcgtccgtgagggccctggcgcctgggtgcacatggtgaggtgctccagcaccctccaaataccggtcaatacacgtctaggggnccaaggaggcaccggggccaggatgattaaagagacagtccgaggactaaccccaaaagattgagtaaagagaagagcagaggcgcgagacgtgaggacgagggacccgggctcagcacccagggtagaagaggcaaggactcgtaaacgggaagacgggggctcagaatgcgggtgggcctggtgaccccgtggatatcaggggtgaagcgacaccagggggcaaggcaataagaggcagagctggaggtcagtaggtgtcgcaagcactcgcaggccttggaatggccgcaagacggcatgcctccttccattcgtcccccgggcgccaatctgtaaaagcgt

SEQ ID NO: 555805 - DNA, 956 bp, Homo sapiens
gtctcggatcgcgttggcttgtgggtgtgatcgtccgggtctgtgtgtttgtgcgcggcaattattcctgtgggtgtggtcaccggtaatttgtcctcgtggcgcctataatttgcgtgttcgggccgggtttgaatggtttcgtttgtctgcccccgttccggtggccgatttgtttgattgctgccacgcgctttggccgctagggttactttgttggtgcttgcagccgataggggcgcggtccggcgccttgtttgtgccaacttcgtcgccatggagggtgtgggtgtcgccagcacccgggtgccgtgtgtggccgccgcctgcccctgaggtgccgcgtgccaatggaccgctgtttttgccctcaattaggggggtgttcacttatcgcggaggtgtgccccctgttgttctcggggtcacccccctggtgcccccatgctttgtgcggccgatgtcccgttccgggcataactaaattgtcgttcgggcggttattcgtaacctttgtggtgccggcacacacagcccatgtgttgggcggcctcattttcccgcgtgatttgcccccgcgccgtttttcttcgcgtggtttcccccgcgaggcactacacccacccatggtgacactgtcgtatcaatctgtgaggcggctactttcacatttttccgtacaacccggtgaaatagtgaaaaatgttctcatgaagatgtgtgagaaacgccttcttccttctgagaagcgcgaaaatcgccttaatatgtaggagaagacccgctcgccattaacgctggggtgagccaataatggggagcgccccccccgctgtcgccaccagttcggaggaccccgtaattccaattaaaatcttttccgcccaaaaggagaagggattgacccccccaaaggggttcaaacccacccccgggcccccagattttttcaaaaa

SEQ ID NO: 555806 - DNA, 373 bp, Homo sapiens
ccccactgtggcactatggatttgacgttcttcacctcattctcactcgtattgttccaggaccagctggtactgatggcggtgaggggccccacgtttccaggcaatgtcgtgactggaaccggtgtactggacccagtgcacagtccccgcattaatccacacgaggtctccgggtcgctgcatgaagcggtacacaggaatattggatgcatagagatcatccaggattggtcaccaggaacccgtcaagtagtccacgccgtgccgatcacagacagcgctgatggtctcccagtagtgctcgtgcaccgcgaaccactcgcagtcgcctgggccaatgttgatgtcgacggagcagaagttgttattc

SEQ ID NO: 555807 - DNA, 615 bp, Homo sapiens
gagagaacgagcctcggggaagatgcctttctactatcattttaagaacaaggtcttttaaaatgccctgcagaataaccttacgaagcaatactctaatctacctattccttggacaatgaagcacatggtcccatggagtgtacaaggttgtggccacaaccgaccctgtgataatgtgcgcagaccctacatagaattcacgtatgaaggccgtttgtcaaggggagcagtatacacagagctgtagttctatagctgtgaatacaagtctatggttcaatgacaggcatcttgggcgtctcgcacaatccgtgggcctttggacaaagacgacatggtgtctagaagactgacttacgtgtgtacatgtaagtttgtaagccagtgagctcacgatgcactgatgcctgtacactaggcatcctgagatcacacattgctagagtgtctcgtttgtagaacgcgagccatcaatccgattctaactgttcacacacctaacgatttaatctgtggtgcggacttatagctgtttcggccttctctgtggagctcacttatgaactcgaagggtattgttactccctacgggtgaactctcaatgctggcct

SEQ ID NO: 555808 - DNA, 1170 bp, Homo sapiens
  misc_feature (7)..(7): n is a, c, g, or t
  misc_feature (10)..(10): n is a, c, g, or t
  misc_feature (879)..(879): n is a, c, g, or t
  misc_feature (886)..(886): n is a, c, g, or t
agcgggngtncgccgggggcgctggggggctctgcggcgggcggcgcgcggccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcaggtgccttgcagagagaggagtagcttgctggctttgaacgcgtggcgtggcagatatttcagaaagcttcaagaacaagctggagaagggaagagttattcctccatattcacctgcttcaactactattcttattgggaatggacaatggaatgttctctggttttatcatgatcaaaaacctccttctcttttgtatttccatgaacttatccagtcactttggcttttcacagatgccaaccagttcagtgaaagatgagaccaatgacaacatcacgatatttaccaggatcttggatgggctcttggatggctacgacaacagacttcggcccgggctgggagagcgcatcactcaggtgaggaccgacatctacgtcaccagcttcggcccggtgtccgacacggaaatggagtacaccatagacgtgtttttccgacaaagctggaaagatgaaaggcttcggtttaaggggcccatgcagcgcctccctctcaacaactccttgccagcaagatctggaccccagacacgttcttccacaacgggaagaagtccatcgctcacaacatgaccacgcccaacaagctgctgcgggctggaggacgacggnaccctgntctacaccatgcgcttgacatctctggagagtgccccatgcagttgaggacttcccgatggatgcgcaccgcttgccctctgaaatttggcagtatgcgtacctaaatctggaatacgctacgtttggaacaagggtccacaagtcggtggtggtgggggaagatggtcccgagtgaaacgtacaactgagggcaaagggggctgaaacatagaacagacgggaatacagttgcaggcatcagctgaaagaaaggtatgcacagaaactccgaagaggggacaa

SEQ ID NO: 555809 - DNA, 307 bp, Homo sapiens
cccccccccctttccccaatgggggggggggggggccgggggggggttttttttacacaacccttttttttttcccccccctttcccggggggccccccccccctttttttttccccctttaaggaccccggggggggtcccccccccgggttttttttgtggcgcggggggggggttctattttttccccggggacccttttttccctttggcccttttttggggcccttttaaccccgttttttccaaaaaccgggggggggccgggccgggttttcccgggtttttttcccccccccgccccca

SEQ ID NO: 555810 - DNA, 563 bp, Homo sapiens
tagaggatccctgaggtgaggtcaatggtattctagttctagtcttgaggatcaccacactgtcttccacaaggttgaactagtttacagtcccacaacagtgtaaaagtgttcctatttctccacatcctctccagcaccgtgtgtttcctgactttttaatgatcgccattctaactggtgtgagatggtatctcatcgtggttttgatttgcatttctctgcatggcccagtgcatgcatgcagccattttttccatatgtctagttggcatgcatacaatgtctatcttttcagcacagtatctgctccatcatcctttgccccactttttgcatggggttgtttttttctatgtaaattagtttcaggtactttgtcgcattctggatattagccctttgtcagatgggtagatgctacaaattttctcctattctgtaggtcgtctgttccatctgctggtcagttcttttgtctttctcaaccactaaagcatccttagaaaccacgaggaagcttatcttcttcaattccattcatcatcaataaaggtattcaa

SEQ ID NO: 555811 - DNA, 850 bp, Homo sapiens
gggttctagagtggcatgcaccttgtccctgttcccatggggggccccttgccttggtgccctgtcgttgccctagcgacaattcaccatgttctgtgttctggtgtgtaagtgtctcagtgtgtctgggattttactgggtgaggtttcctaggtttatgtgttcacccagggcctgataggtgggatttttgctaggactgaccgggctgaaggacatatggtcttcaggatgtaatcttgggggacagtttggcaatgtcaagggagaggttttagctgtgctgtgtttccctaatggtctcggttggggctcgttggatggttcttctcgtggattgccagtgagtagtagctctgtgagttatagtagactaatgtcagaaactgggggacgtccgcacagggttaagtgcatttggatgcgcagtttcagtcgagggttcctgtttaatcgcgcgcctgcatcccgccttcctcgtatctccttttgcctatctggatggtcttctcagaagcctcggccctagtcgctccctggccttggtcgggtgccagagcccacctactgctgatggcagctcttgctactcgtcatgactgtgttgcctgaaactcaagatgtcttgcagagggttatgagttagagtagctggcctggggagagggtgcctacctgggtttgatctttagcggtctgactttctgccagagaagatgttttacagatgtgtcaaagctgatgtaaagtggttgggggaggaaatccagacccaaagtgtatagtcagactgggtgtacaactgcctatgtagatcctctggtcttaaaacgatctcagtattacccc

SEQ ID NO: 555812 - DNA, 273 bp, Homo sapiens
ttatataacttgattattgagaaacatgtggtacgatgccaggtacaaagttgataaacgcaaaaggatattagtaaaaatctccctcccatgcctacccagataggaatccagctctcctttacataagcagacgagtgtgtataatttcagagattatttatgctcgtggaagcaaatgcatctacatacagttgaaccttgaacaacacaggtttgaacgggatgggttcccttattcacagattggtttccaacttttgcaattctatt

SEQ ID NO: 555813 - DNA, 152 bp, Homo sapiens
tttaaaagggtccgtaggcgggctaataagtcaggggtgaaatcgttcagctcaactgagcaaactgcctttgaaactgttagtcttgaatagttgtgaagtagttggaatgtgtagtgtagcggtgaaatgcttagagattgcggtgttga

SEQ ID NO: 555814 - DNA, 110 bp, Homo sapiens
acgacaggcgactcctgtacagtatttcaggcatactacttttaattaatacacattaaaaagtttctcaaggccaggtgcagcgtgcactcacacctgtaattccagca

SEQ ID NO: 555815 - DNA, 110 bp, Homo sapiens
tacagagtgaatgttcagagtgatgtattttattccagtggaacaagcttggatctatgttagtctcagtgtccaactaacacttgtgatttgtctcagtattttatttt

SEQ ID NO: 555816 - DNA, 300 bp, Homo sapiens
acgcttattgtgccgcactggtgggtcaggccctgtattcaccatagaggtacggcgttacgatacccgcgatgaagtgatcgaagccttgaagcaggggggcgtggattttctcggttccgccaatggctacgaagcggccgacccgcaactgcttttgtctcgctcctacgccaacgatcaaccgaccctggtgactcgcagcggcgatagccaggtgttgaacgacgacctggcgggcaagcgcgtagcgatgctgtatcactatatgcagcccgacgccgttcgggcgttttaccc

SEQ ID NO: 555817 - DNA, 834 bp, Homo sapiens
gctcatccctcttggactgattttgatgtaaggtttcatattcatataatataatctcgtttttaaggataatctttttagagaaaactctttgtgtttatctaaaatttagggacttggttaaaatttggacattttggaatactctggttttttttcttttattcattctgctgaccagggatggaatggtctagtttttaattcacttggccggctagtacaatgatgatataagattattttaaataagaatacttgacgacatagatatgctaaaacagaaatgagtttttcttgggtgatggtttttctttgggcaaccagggtgaggataatgggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555818 - DNA, 1711 bp, Homo sapiens
ggcggcgcggcgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555819 - DNA, 1183 bp, Homo sapiens
gctcatccctcttggactgattttgatgtaaggtttcatattcatataatataatctcgtttttaaggataatctttttagagaaaactctttgtgtttatctaaaatttagggacttggttaaaatttggacattttggaatactctggttttttttcttttattcattctgctgaccagggatggaatggtctagtttttaattcacttggccggctagtacaatgatgatataagattattttaaataagaatacttgacgacatagatatgctaaaacagaaatgagtttttcttgggtgatggtttttctttgggcaaccagggtgaggataatgggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataaaaaaaaaaaaaaaaaaaaaaaaaaaaaacaaaaaaaaaaaaagaaaaaaaaaaaaaaaaaaaaaagaaaagagaaagagaagacaaaaacaaaaaaagaagagcggcgggggcacaacaaaatatcacagcgggagagacagacgaaaacgaacgccacaagttgaaagaagcgagggcagcaacgaaggggttgaagaagaacggcgagaggcatcaacgaaggcgtggaagaccacaacggatcgtgaggagacacacacctcggggggagatgagagccccacgaaaaagagggcgggacaaaaaagggtggagagcacccaaatcgggaaagaggcgctaaaac

SEQ ID NO: 555820 - DNA, 278 bp, Homo sapiens
ttacggaatgcagtggtgtgatcttggcttacagtaactcggcctcctgggctcgagccatcctcccacctcagcctttcgaatggctgcaagcacgtaccaccactccaggctaattttttatttttttttggtagagatggggctttgccatgttgcccaggctggtctcaaacttctgagctcaagcggtcggcccgcctcagcctcccaggatgctgggatgacaggtgtgagccaccacccctggccctgtccactgctttatatttggctcc

SEQ ID NO: 555821 - DNA, 2060 bp, Homo sapiens
ggcggcgcggcgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataaaaaaaaaaaaaaaaaaaaaaaaaaaaaacaaaaaaaaaaaaagaaaaaaaaaaaaaaaaaaaaaagaaaagagaaagagaagacaaaaacaaaaaaagaagagcggcgggggcacaacaaaatatcacagcgggagagacagacgaaaacgaacgccacaagttgaaagaagcgagggcagcaacgaaggggttgaagaagaacggcgagaggcatcaacgaaggcgtggaagaccacaacggatcgtgaggagacacacacctcggggggagatgagagccccacgaaaaagagggcgggacaaaaaagggtggagagcacccaaatcgggaaagaggcgctaaaac

SEQ ID NO: 555822 - DNA, 339 bp, Homo sapiens
ggaggcagcgctctcgggaacgtctccacatgtggagacgggagggggggtcacgtgtgtcttggggtgtccgcgcgcggcagcgtctccttcccgttctccaggtatctgcggagccactccaggcacgtgccctccaggtaggctctccgctgctccgcctcaggggccgcctcccattggcgcggggtgatctgagccgccgtgtccgcggcggtccaggagcgcagatcctcgttcagggcgatgtaatccttgcggtcgtgggcgaacgggttatacccggggaggaggcgccggtccggccccaggtcgcagccaaacatcctcggggggggg

SEQ ID NO: 555823 - DNA, 496 bp, Homo sapiens
tagattcttgccatcatttattaattgaagcacagagattagaggcaaaatgatttaaggaatttatgtcccatagacagggagtggtctatcctccaactagaaaaaaaaacaggtgaatctgctttcgacctgggatgctttctgttattcttatggatgggtgagacgcttttaaatgagatgccataagcctaagggggcttgacttggaccaacaagttttttaccctcctttctatggcttgtttacttatgggcaggcttgcattacttgtctacaaaagctgaaaaatcatccattaccgctttcagaagctcttttggtgccttgggcttgtgttcaacaagcttaacacgagcagttgtgttccagatcttgcggtccttataaacaagtgtgcatatatttgccttgaaggtgaatgttgtattttttaagtgtccaggaactgttgtttgattgactttcagagataaccagggtggcttcctg

SEQ ID NO: 555824 - DNA, 1374 bp, Homo sapiens
ggcggcgcggcgtaaagcgccattacgcagagagaaagttacgaggttcgtggccgcggtttccccaggcagctggcgctggaggcttcggcgtcacgtgctgaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555825 - DNA, 1316 bp, Homo sapiens
ggcggcgcggcgtaaagcgccattacgcagagagaaagttacgagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555826 - DNA, 1658 bp, Homo sapiens
ggcggcgcggcgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555827 - DNA, 772 bp, Homo sapiens
  misc_feature (772)..(772): n is a, c, g, or t
gaaaccttggggaaacgggcccttgcagaacgaagtgtcataagagggaggagatcattgaggtgacccagaaaagtctcttgttgaagaagacagacgtacctcaagggagtagatataaagaggaaagcacactctcttcatttgagagatgctgagctaactttcgcgaatcaggactagcatgacctcctggtaccccatctgagatgtgcatttttagcaaggtacgaggggtggatcaatgttgaagagagagagaggctccaattgggcgacgggcacagtgcaacacggagggaagagcagaagcggtggaagcaacatgatcggggtaacgacaacggaaatggacaatgaacagcattccatcacacaatggcttacccccacaagggactctggaggggcaccatgaggcaaccccgacagcgacggatacaccatcgagacgggacacaaaagggaacctagaacaacccgcgccggagtacacactaagtgcaacacggagcgcaaccacacataaccaacgtagcacgaagcgggaacaccaacctgggtcacaacacgcacaaccaggtaccacttacagcgtgcgcagatcaccctccaccagcgttcccccaggcaagcaggacgaacacagtgggggaactaaaatccaggggaacccgacacctggcacataggacaaccatccctcgaagcaaagcagaatcagggaggacaagcctaaacccataaatggggcactggaaagaacagtccn

SEQ ID NO: 555828 - DNA, 205 bp, Homo sapiens
taggaggtagcgtcctaaggtcgctatggatttctctacaggataatgaaaggttctacaagttactgctatgtgatccatgcacagctcttttattattctaataccctactgaatttgctgattttctttaaattcagtccatttaatagggtattgtgaatccatcatatgttctcctattttgcctacacactacattcca

SEQ ID NO: 555829 - DNA, 989 bp, Homo sapiens
agtctttcggccgccctttttttcaagctatgcactttatgattcaaaacagcgttgtcaggatccataaactttttcagaagctccggggcaggtgttaaattttcggattcccaggcatctctcctagagattgtccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555830 - DNA, 705 bp, Homo sapiens
cgcgcccagagatgggctccaagggcaaacgaaagcggctgtgctagctgcctcagcccgcacgcccacgtgacagactgagatgcggtgcgcgcagagtcaatgtcactctgccgagacccagtccttcaggatatgagtgcggagcccggagagcagtctacagcaagcgggttacgtggtgcacagcggctgcgcaggcggcacgtgctgaggcaaggtgtgagctcctgcgcgagccggcgaggactggagcgggaggtggcccaataagcaggcgcttaccggcagcgaggctggctcctcaggctgacctctcgggcctgcggcttgggcgcgccaagtggcctgccccaggctttccctgggggtccgtcggccccagactggcattcacgggtcccagcccacgtgggtgttgacacaggcgcccctcctgatgctgggctgcggttcatccgtcgtctcattcatgccgagttggtgggacccacccagctggctccgtcctgcgtgacctgagggccccactgcggttctggaaaggatagggacttattgctgtactgtgattctgtcgtcgctcacagtggcgtgctctggtgcggccctggagcggtgccactcctttctctcccgggcaggcactcgctgtcacttctgagtcagtgttgggatcgagtgttaactgtgattctcaggtgc

SEQ ID NO: 555831 - DNA, 312 bp, Homo sapiens
ccgagatgcgggtcacggcgccccgaaccgtcctcctgctgctctggggggcagtggccctgaaccagaactggggccgcttccacttcaatgtggtatttctaaaacccccatgtccccggcccgcccggggggagcccttttaatggaagtgggttaggtggagcgaaacccagtttgttgagtttttgacagacagcccgcgagtacccagaagcagaccgcgggcatatggatagataaaggtggagccgcattatttggaacccaaacacagttttatagcgagacacaaacgattttcgtccgaca

SEQ ID NO: 555832 - DNA, 1256 bp, Homo sapiens
ggcggcgcggcgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcatcctgcaggacggactggactggtgggccgggggcttttggggcgatggggcccaaatcacgctgcagatcccattataaggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctata

SEQ ID NO: 555833 - DNA, 302 bp, Homo sapiens
  misc_feature (141)..(141): n is a, c, g, or t
  misc_feature (266)..(266): n is a, c, g, or t
  misc_feature (280)..(280): n is a, c, g, or t
aaaagtgttgtaagagactcctgaggaagacacacagtttatttggaaagaagctctgtgagagccaccatgccctctgcccatgcctcttgggactgaccaggagcagctcatgggcgtgagagtgggaaccatctcccngcggcagtggcttccgcgtgccccgtgagctggagcggttcccaacaaaacagacaggaagggtgtttgcgaaatatgatcaactggaacccctggatcaagcggctgaattccctttttccctnacccaaaaaaagcnacaccagaccgaaaaaaaaaaa

SEQ ID NO: 555834 - DNA, 1977 bp, Homo sapiens
ggcggcgcggcgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctgggagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataaaaaaaaaaaaaaaaaaaaaaaaaaaaaacaaaaaaaaaaaaagaaaaaaaaaaaaaaaaaaaaaagaaaagagaaagagaagacaaaaacaaaaaaagaagagcggcgggggcacaacaaaatatcacagcgggagagacagacgaaaacgaacgccacaagttgaaagaagcgagggcagcaacgaaggggttgaagaagaacggcgagaggcatcaacgaaggcgtggaagaccacaacggatcgtgaggagacacacacctcggggggagatgagagccccacgaaaaagagggcgggacaaaaaagggtggagagcacccaaatcgggaaagaggcgctaaaac

SEQ ID NO: 555835 - DNA, 115 bp, Homo sapiens
aaccacaggacatggcaaaaggatgagagaggggaaaaggcctcaggatgggacataaagtgcaaaagtctcttacacgtctgcctgtgctagctggagtacaggatggagagcg

SEQ ID NO: 555836 - DNA, 605 bp, Homo sapiens
attaatcccctggcccaacccgtcatctactctaccatcttgtgcaggcacactcatcacagcgctaagctcgcactgatttttatacctgagtaggcctagaaatacaacattgctagctttatattccagttctaagccagacaaaaataacacccctcgttcccaccagaaagcgtggccactcagagtatttccttcagcgcaaggcaaaccgcattccattacatccttctaaatagctatccttcttcacaaccaattatacttctccgggcaccaattggaaacaataaaccaaataacttaagcgaaaatcaaaatcacctctatccatgccaattacattccatcacatggcgcttatcacgcacatagcaaacctaaggggaatcagccccccttttcaatttcttggagtcccacgacggttaccccaagggaacccccttctggacatccggagcctgtgcttcattctcacatgacgaaaaacattaggccccccatcttcatatcatattacccaaatcttctcccttcagtaaaccgtaaggccttctccttcactctctcaatcttatccatcatagcacggcagttgg

SEQ ID NO: 555837 - DNA, 1530 bp, Homo sapiens
  misc_feature (456)..(456): n is a, c, g, or t
tatctggtctgcccggatggtgatgtgcagtccagaaaggtggggccgcttgggatccgacttgtctcccattagatgactggataatgggccaatatgagctcgatgcacatcgctgtactatgagaggtttctattgcctccacggactagtgcaatggtcgagtgtggggtggtaagaggcacgtgtcagacgatgcactaagacacgtgcacagatacgtgagggctaggaaattccgtctctagcttgaattgcctacgatgagatttaagatatatacacttaagcatgcgtactaggacactacagcaaagtaaaggttaattgacaaagcaagcgagggggggtcgactgcttctattcgcataagacctccatctccgtgttagtggcaaggtttcgtgagaatagtacttggtcgccgcgaagaaagtgcaacactcgatggaatngtggtacagttctctgagttggcgcgagatttgcgcaacaagataaagattgttgcataaccctgttggtaggcaataacgagtacgcgggacgaaatcgcttttgggaagaattgccaccatttaaattgaggcagtggtctctaattctagaaaccagcgttatggatgttgtcttgcaccgggtggggacaaaacgaacaaactatggaactacgagtcggacattaccttctatgacactaaaatagttattagaccattctttcgtgtgaaattagcgcaaagggcaaagggttaggtcctcttaagactaagtatgtatctaccggagtggtggggaagtgtaagacctgggccccaatttaatccacaacattgccatgcaaatccgccgcagtcccctctaattgtcaaattcaaattcatttagtaatccattagatcaagggtggcaccccacataatttcgcgcaaatttcgacccacagtcgcaagaaattctagtcctccttgtggaggaccctttttaacccaaatattggcgctacataagtccaagtcgggggggtgtttgccaggtcgggcgaaccatacatttcccgccacaatgcttataatccacgctaggttacaacttttttttggtgtgacagagcgccaatatttgaagcgaagggagaaccaggggagagagaccctacggtgagacgcactctaccactaatcctatattaccatggtgttttaggatagcattgtgtgggatcaggtcgggatccgcacgacattaattggaccaaaattaccttatgtttatatacgaagctgggtgggcaaattggtttggggaaggttgcctggtcagtgggatatgggaaccctcaattgacgaagggcgtgccctttggacaaacttttgcacggggggaaggtattacatagcgtttcgtggggcacaccacattctggcggagtggagagaacgctgtgcgttgtatatatgcgagaaaaaatagctctcaccaattttagaacattaatcactggtgggtagacattgagattccgcgg

SEQ ID NO: 555838 - DNA, 2250 bp, Homo sapiens
ggagagaactagtctcgagtttttcgttttttttttttggaaaaagtcatggaggccagttggggttggtttaaaaccagcttgtgggggtggttcgacttccttcctttttgtgtctagaattttattgtttatacgcgggttctctcccgacgtgtgtggtgtcatagcggtctggggttgccatccactactagtcaccctcacaggtttcagtggcagtgttccttactacctacttaggcactattcgcgcctatcgaaagccgaacagcgccttactcaaattcagtgaacaattatcttcataactatctacttgcgcgggtaacgaagaacacgacgaactggacgccataccaagatagatcacagatcgtccccatggtggcgctgttacccgcatccgaggggaaagctccaaaaagacaaacgatccggagaccaatccaccagcaataccggccaagagacaacgccgtacgtcggacaacacaaacagtccagactcaaacacgcccggaatgacaaatattagacacagagagaacagcgaacaataggggcagaaacagggactacggaacacaacgggtagactcaacccaagctacaaactacgaggcacacaccaccgcggacacaccgaacgcacacccatatacagaggtgaacagactacaaaccacacaacattcaaaccaacagcacaccaacaacgagaaagacgcaaccaacaaaaccgaaaaagaaaagataaactatgtcactaacaccaccagccaaactacaaaacaaagaacaaaagaaataacaagaatagcaatcatcaacacaccaactaacacaacacacaataattcgcataaaatagctcaaaatataaaagacaatcaaaaacataacaaccatacataaatctacacaaccaacacacaaataaaacacaaacatagattacaattatttattagaatacctactttcttttcttctgcatcgtcacacatcataacactcatatcaaatatataacttaatcaaaataatagacaaagatatttctggttataatgaataatagtatataatgtgataatataagaagtagtaaagcatctcagtactaatatctctaatctcactaccacaatcaaatacaaaataatcctacaatatagaaataaaggaaataaacaactaattcatgtaacgtaaatcaagaatcattacaaaacataacaaagaaacgtcagaaagtaacaaataaacacgaactatgacagactaaaaaacacaagaataataaacaaaacgaggaagaccgtataacaagacagtgaagagacgaggagagaaaggtagagacgacagaggacttagcgtgacggaagcactaagagaacagtaatactgaagaaaaagctagaaagaaaggacaaaagtaaagagccgcgaaggaagaacggaagacgagagataaagagttggagcaatagtagacgacagagctagtaagaggagagaaacagaataacagagatgaatacagaggaaaagtgactggaaagagagagatagtgtggaataagacttcgagtagagagaaggtagagtgagacgacaggagaaagagaggagagcgaacagagacgaagacaggaagaatagcaaagagacgagaaagatgtagagtagttgatagtaggacagagaagagagacgaggcaatgatcgagtaagacagatagatgagatgaggagtcacgagaacatagctgaaggcagcaaagagattcgggagaagagcaagtgatgaaagagaggaagacagagcgaacgaatgagcgcagtaggaagaagtgtacggaaataggagagagaacgagagataagaagagagggtagagacaggaaggaagcaaacagagagaagcataaagcaagaaaagacgcagagaaggagacgagatcagagacaagcagatacactagagaagcgagcagcagcggagagtgaacgaggaagggagaactagtgaagaaacaggaaagaacaagaacgatcagaaaagagagggcgcaggaagggagaagataaacaagaaagaagagacaacagaaagaaagccaaagcgaaacgacgagcaaagaaggagaagaaacgcaacagaagaacaagaagtgtccaagacaagaaagtgacgaaaggagcatagagaacagagcaaagaagagaaaggagaagta

SEQ ID NO: 555839 - DNA, 788 bp, Homo sapiens
  misc_feature (22)..(22): n is a, c, g, or t
  misc_feature (62)..(62): n is a, c, g, or t
  misc_feature (92)..(92): n is a, c, g, or t
  misc_feature (156)..(156): n is a, c, g, or t
  misc_feature (165)..(165): n is a, c, g, or t
  misc_feature (172)..(172): n is a, c, g, or t
  misc_feature (272)..(272): n is a, c, g, or t
  misc_feature (276)..(276): n is a, c, g, or t
  misc_feature (287)..(287): n is a, c, g, or t
  misc_feature (296)..(296): n is a, c, g, or t
  misc_feature (326)..(326): n is a, c, g, or t
  misc_feature (365)..(365): n is a, c, g, or t
  misc_feature (369)..(369): n is a, c, g, or t
  misc_feature (471)..(471): n is a, c, g, or t
  misc_feature (489)..(489): n is a, c, g, or t
  misc_feature (538)..(538): n is a, c, g, or t
  misc_feature (584)..(584): n is a, c, g, or t
aatttaagagaataatttaaanttatttagataatgattttttagaattaaaaaaaattganaggaaaaattgaagtattaaaataaattgnggggggtgggggtggggattatgtttaatatatatgttgttttttaataaattaaaggatctgngtgcaagantttttanatgagggagtagtgcacttttatttagtaggagtaaattagataaaatatatagttttataaagatagtgttattgtgttgttatttttaattatttatnaaanttttatttganttgtaaaanagttttttttaaaattgataatttccagangatagggcttagaattgtttaaataatttattataaatnattnggtttttatttattcatagattaaaaaaactatgaagaattatgttatttaagtgggatatttaaaattttttttataggaaaataggtttacatgtttgtncctagttagctaaatttnccaccccccaactttaaaacagattacaggatgttcaaagttttaaatnagagtacctatattacagtacagtgtggatatgtttccattaattnattttatgtctcattctattatagtatcaaattagcaaaaaggcacctgggtacattcttcagaacagttttggtcatttaaaaaaaatcacacatttataagcagtgatttcaatcatgtttaaaaacaaaaatattaaacaaattcatttcctaatccagatgatacagaatccaagaaatttctgtaggcacttcactttc

SEQ ID NO: 555840 - DNA, 875 bp, Homo sapiens
atagtacttgccgcagtactcttgaaactaggcggctatggtataatacgcgctcaccactcacttcctcaatccccgcatggacagaagacacatagcctaccccattccttgtacgatccctatgaggcataattataacaagctccatctgcggtacgagcaagacagacctaaaatcggtgcattgcatactcgttcaatcagccacatagccgctgcggagtaacagccatgtctcatcgcaaagcccctgaagcgttcaccggcgcagtcattctcgataatcgcccacggacgttacatcctcattactattctgcctagcaaagtcaagagtacgaacgcactcacagtcgcatcgataatcctctctcaaggacttcaaactctactcccactaatagctttgggatgacttctagcaagcctcgctaacctcgaccttgacccgccactattaacctactgggagaactctctgtgctagtaaccacgttctcctgatcaaatatcactctcctacttacaggactcaacatagtagtcacagcctatactccctctacatatatagcacaagacaatggggctcactcaccagcacattaacaagataaaagcctcattcacacgaagaaaacaaccgtcatgttcatacagctataccccaattctcctcctaatcctcaagcccgacatcattaccgggtttgccgtccagaaaaaaaaaaacaaaaagaaaaaaaaaaaagttgcggcgacacgcgcccacagaaggctataaagacacagaagaggaggagcggccacaggaggcaaggacaacgagaagacggggaacaaagaggaccgggagcgagacaaagcggaga

SEQ ID NO: 555841 - DNA, 185 bp, Homo sapiens
aagcgttctaatcaggttgcaggtattagaggtactattttcatacctctattctctgatcattctatttaaagcatatgttcttggaaaatagtctgaaatgcagtgttttagccctacactttggaatagggcccaggaatctaaaacgaaccactgcctagaacctagcatctggggaaatc

SEQ ID NO: 555842 - DNA, 427 bp, Homo sapiens
  misc_feature (154)..(154): n is a, c, g, or t
gaaatctgatgtaaacatcactgcacagaaggatatacatgtatagactgatgaaatgtgacattaatttagagaaggggccaggtgcagtggtcatgcctgtatccagcatttgggaggctgaaggaggtggatcattttgaggtcaggagtntgagactagccgcgacaagatggtgaatacccatccctacaaaaaaatacaaaaactagccgggtgcggtggtgtgcacctgtagtcccagctactcgggaggctgaggcatgagaatcacttgaacccaggaggcagacgttgcagtgagctgagatcatgccactgcactccagcttgggcaacagtgagattctgcttaacaaaaaaaaacaaaaaggtttttagagagggaaagacagtggtttgaccccaccattgagaaccacggtt

SEQ ID NO: 555843 - DNA, 206 bp, Homo sapiens
agagcaggagtgcgagatgatgtgctcatagctcactgcagccttgaacaccttagcttgtgaacctcccacctcagcctcctgagtagccaggactataggcaggcacatgcctgactaatataaaaatacatggtagagacagcgtctcaatatgttgcccaggatggtcttgcactcctggactcaagcgatcctcctacctt

SEQ ID NO: 555844 - DNA, 1511 bp, Homo sapiens
  misc_feature (562)..(562): n is a, c, g, or t
  misc_feature (865)..(865): n is a, c, g, or t
gatgtccggtggaccggtgactaacgtcgacatgcatccggcttcccactgtggtatggagagctgagttgggcatgtgtcgctcgcagtcacagcactccgtacggcagtcctatccttcactcttcgcttcccccaagtcatgcagtgcgcttattaactggacaatcgacggcaaaacgtgagatgtgaagtcagctgaaggagtgcatgcgacagagactacaatggagaggggagggcagggcgtggcaccggatgcttgtccccggcaatccctgtctgagttccctttcatccgctgctgcaagcatttcacttatcgaccatggggtgtaatatcaatttatccatccaatgtatgagctcaaaatcagaaattcactgttcaattctatagactcctaccatgggtaattcggcacaattcacaattgggtgaccttgaccttgcataatctgtatgtttagggacaccggaagtaaaacagcggagagcaaactcctaggctctctgtgcaaattggttccctccaagtaaattatggaacaccctactttnatatggcaaaggtttaccaccacagcgctcgcaggccatagggggcattggtcctcttctttaccagctataggaaacatatggtctcggtacctatagttggtataacaaaccgattttccgtaaaggacccattctaaattcgaaattactcttatggtatgtccaattttactaagagacaagatttctattggtccatacacatgacatggttggtcccgcaatcttttatcagagcctttaatttaaggaaaaggtagggcgttcatatacttcccgagataggcgagctttattttntccaccaatttcttacataaggtcaagctggtttcattgcaaccaacaggggcgtgggtggtataacttttaacgagaaattttagggagttattgaaaattttctggcggaacttttctagaaggtcaatttaagattattatttgccaatattgttgatagggcaaaaacacttttagtatctttaccctccactggctttaagagttcgtttcctgaattatatcccagggaaatcgcggggaattgaattacccgtgaataagaattggtctccctttctgggggggtcaagactatcacaactttattttttcacactttttctcggcggaggattatcgatctttccacacgcacagtccaacagtactccttagttaagaggtgcacaataggcgtaaactggtttcttccaactttgtcatatgtcagttgggcgctaccagtagtttttaacgagacaactccggggatgtattgccaactatcattagacactgtggaatgtacagaaacacgcgtcgtcaccctaatgtaaatgatattggcgcccataagcacacgggatgaagaatagaccatctccgtacaaaactcttgcggctatatttatgcaaacaaacacacaagacaggggtaccc

SEQ ID NO: 555845 - DNA, 286 bp, Homo sapiens
acaatgtctagagagtgatctagtgggtttttttgagacagagttactctatcgcccaggctggaatgcagtggaaatctcggctcactgcaacctccgcctcccaggttcaagcgattctcctgcctcagcctcccaactagctgggattacacgcacccaccaccatgcccggctaatttttgtatttttagtagatacagggtttcgccatgttggccatgcttgtcttgaactcctgacttcacgtgatccacccgccttggactccagcgtgctgatacaa

SEQ ID NO: 555846 - DNA, 321 bp, Homo sapiens
aatctagagtatcccgccctgcacggatactcatctagcatcgaagaggccttagcccagagaaggcttcaacctttctgcccccaaatgctcaattgactgcattttatatattttattatagtgcagacagtttttggttcatctcagtttctcttactttgctgctgcttttactagagatggctggaccagttaatgagaaacacccgaattttcacagcaatgttcatatgttccacataccacagagtttctattttggccttaaatcatactgttttatccagcatgattcacctggattcgagattatttcat

SEQ ID NO: 555847 - DNA, 94 bp, Homo sapiens
tgaccacaacaagcaagcatgcagcttactgcttgaaagacagggtcttgcctcacccaaagcatagagtgcagtggcctttgaagcttactac

SEQ ID NO: 555848 - DNA, 444 bp, Homo sapiens
gtttgtatcatgtacacaagaatgaacgcaagggacaaaggtagtgccacgctccctggccactgggttcctggcaaacatcccagccactaggtgccatatctcccttcaatgtactccttcttcccctgagttgcagaagcgtttcaagacagttatgacatggacacatgcatgagctattatacataattactaaaagctgattctgtcatcaccacattttgtctcatcagtaggagcgaatggctggcgggacggtgtgcttcctccagtgctcctcaaagggcttcttctgttgcccctggatgggcttggagtaatcgtactcatcaatccgcaccttgtagtcttccctggcatgcgcgccccgtgactccttccgtgcctctgctccgtagatggtctgcagcgcacacagcatcaggttctgcagctccaggg

SEQ ID NO: 555849 - DNA, 156 bp, Homo sapiens
  misc_feature (12)..(12): n is a, c, g, or t
agaggatccccncatcatcgatacagttggtgatgataggcctacgaacaccgacagctgcttggatgatctcgaacgcgtaggctgcgcagcagctgatcgatcacgatcaccagcgaggcgatgatcgccatctgcacgataatgcgcacgctg

SEQ ID NO: 555850 - DNA, 374 bp, Homo sapiens
tgttcatgagctttaataaaacagctctgagtagtaacagtggatcaaatttaggcttcttgatgcaggcatggtgtagattactacttctgtattgtcccaggagctcagcacattccttgccagagatgataaggagctcaatcttgaatacttgttcaagcttttgaataaaaaaccacagttcctcaaagaagaagaagaattgcgaaatcaccggaaataaccgaaaacttccccctgtttgactttcaacattcttgaatgcaccaagatagcctctttctgtgagattaataaatgaataaatgcctccatatttttcaatctgtgaagttaacaacatgttagatttttttgcatattttaaaact

SEQ ID NO: 555851 - DNA, 385 bp, Homo sapiens
ggtgatgggtggtgcaggttccagctgtgaaagtgcttgagctggagaggggatctaccaggtgcggactctgtgtccatccggggtgggcctcctaggcctgcatcggggttgggcagcctcagttcttgtgtgcgaagggacctgctcgtgctgtggccaccaccttgccatcgtgcacatccatgaccttggtgcgcatttggcggctggaggaggtcacatctcgtggattcattgcgatccaaaaggagcacactgggagagagtgagaggtgggcgtcctcggccctcctaccaggccggcggtagcgtggcgatctccgtgctcctagccgcgtcttccacggtcctagcacggtatcttgtacgtccttggttctcg

SEQ ID NO: 555852 - DNA, 270 bp, Homo sapiens
atgggaaaggaggcgcggacttcgtatgtcagtagttctttgatgtgaaaggggcagcacagtcatttaaactagatccaaactcttatgcatctatacaaagttaaacagctaaaagaagtaaaataagaaggcaatgacttgctggaatgtccacgtgcatattgtggggcgcacgcctcattacgattcgccgtgctgtgcttctcctgttcaatcgtttctggaaggcagtggatttttctcttgcatctcgtctcttctcttgta

SEQ ID NO: 555853 - DNA, 1058 bp, Homo sapiens
  misc_feature (856)..(856): n is a, c, g, or t
gggcggcggcggcggcggcaggagcccgggaaggcggaggcgggatggcggtcggacggggcgcggagaacgcacgcaagcggccagcggtcagcattgtacggccggcgagagacgtcaagtaccccggacgcactcgcgaaagcacccggaccggagtgcacttaccaggacacgccgctggtgggtcgagacatggacacacggatcggaggcctccactacaccttttgctcatgtcggggaagcgcttaagcatgcggagagccagtcccgtgtacggggtaccggtggccacctgcgaaggaaattccctatggactccgggggaggcgttcttgggagttctatgggaaaatttctcggggtggcgacgcattcgcatacgcggaaaggcgctcgcactttccataagctccttcgtaagctgaagcttgtatgggcgagtggggcggtctaagtgggttctagggggtttgccacaggctgggagcgagggcggagttctgtgtggcaccatctgttatcaggctgtccccagtccagtattttacatgggagggccacgtggatgcgccaaccatgcaatggggccaatttgggggtgcggggctttcgaaaaaatttttggacttgccctgaaagcgtggcggacagaccttatccccgtgggtgaaacttttcgtgtagcccccgttacgctcccaagttattctggtaaccaaatggggtcacaggttatcgggtagtccggttcatccagttacacttctggtggtgggagggaacggcctacgatctatagtaatctacagcttagtagggcgaaaaaggggcatagtgggctagcggcgtnagaggcaagtttggcaccactgttggtggcgaccttgggcatcaatagtttgtggccaactgtgttggccagaaagctttatatcattaggccccaaggttaaaaggcccgggggggaccaactgtcgcaaaatattccccattgggaacgggttgggagttaataagctcccatatgggttaaaattaaaaagcagagata

SEQ ID NO: 555854 - DNA, 626 bp, Homo sapiens
tggctctgtccccaggctggactacaggggcacaatctccactcactgcaacctctgatctccctggttcgggcgattctcctggcctcaccctcccgagtagctgggaactacgaggcactcgcccaccacgccccagctaatatttggtaattttgtgtagaagaacggggattatcatacggtgttgtggcccaggcagtggtctagcaatactcctgaactctcggtgaatatcgtgaccgcgcctacacccacctccccacagagtgtgcgtggcgcacacggtgtgtgtgagcccagcccggcgaccgcggccacgcgtgtgggagaggaacagaatattataaagaagatgtgacacacttgtgacaatatacctgtggaaaattgtgggtctttatttatgtgagcgtgtacacaacacattttttacaaaatgtggttcaatataggtatgtgagaaattacgtgtgtataatatcttcactatttgaatgtggacagtggggagttttttattcactattagagtcttggtggggacaccattaaaatatatcaaaaaaaagtgtcgctcaatggggttggagaaaaaatttggtacgagccttccaaaaagtata

SEQ ID NO: 555855 - DNA, 157 bp, Homo sapiens
tgaggaggagctgagcacagactccagagttctcttcagtatgatcagcatatacgtggacgaaggccacaagaaatggatttaaactcctacagccctataactaatgcatgtaagttctcataatgaagtcacgaagtgatatgtcctacacctc

SEQ ID NO: 555856 - DNA, 390 bp, Homo sapiens
gtcgacctgtgctgtgctgtctgtgctttgctgtctgtgttgtgctgtgctgtctgtgctgtgctgtgctgtctgtgctgtctgtgctgtgctgtgctgtctgtgctgtgctgtctatgctgtgctgtgctgtctgtgctgtgctttgctgtgctgtgctctgctgtgctgttctgtgctgtctgtgctgtgctgtgctgtgctgtatgtgcagtgctgtgttgtccgtgctgtttgtgctgtgctgtgctgtgctgtctgtgctgtgctgtgctgtgctgtgctgtctgtgttgtctgtgctatgctgtgctgtgctgtctgtgctgtgctgtgctgtgctatctgtggcagtatctctcactaacctggaacacactaattgtcgacg

SEQ ID NO: 555857 - DNA, 121 bp, Homo sapiens
acggtacctcatcattcaaataaaacaaataaaaaagtattaggcgaagattaaaaaattttgcattacatatttacacgaaagcaatgctaaaatctgaaatctgccagtgtggagagag

SEQ ID NO: 555858 - DNA, 317 bp, Homo sapiens
cagcacatctccagcacacaagaacttccatacgcctgaaccacagcagccaggccttcctcgagaacctcgtcccccaggagcttgctacaagtgccagaaatctgaccaccaggccaaggaatgcctgcagcccaggattcctcctaagccatgttccatctgtgcgggaccccactggaaattggactgttcaactcatctggcagccactcccagagcccctggaactctggcccaaggctctctgactgactccttctcggcttagcggctgaagactgatgcttgccgatcgcctcggaagccccgtagac

SEQ ID NO: 555859 - DNA, 734 bp, Homo sapiens
ctttaagaccttaagttgggggacggcctttgttatatttaagaaactgggttctcccacaaatgctttgagacagttccaagaattccatttttgggtaaaccattgggaattcagtacgcaaaaccagattctgatataatatctaaaatgcgtggtactttcgctgacaaggaaaggaaaagggaaagaaggaagcctaaaaccatggaacaggctccagctgctgcaaacaagaagcctggtcagggaacaccaaatgcagctaatacccaaggcactgcagcgccaaatcctcaggtccctgattatcctccaaattatatcctatttcttaataacttaccagaggagacaaatgagatgatgttatccatgctgttcaaccagttccctggattcaaggaagttcgcttggtaccggggagacatgacattgcatttgtagaatttgagaatgatggtcaggctggagctgccagagatgctctgcaggggtttaagattacaccgtcccatgccatgaagatcacctatgccaagaagtaacatgtgatgccaatgtggaaggacttggttatttatagtgtttgttttgatcatattcggtcaagtcattttaaatggttggaagtgaaggtgaagttttgggagaagagttgtctaattttttttagttttgctgaactatgaaatacggagccttaattttgtacaataaacttttatttgta

SEQ ID NO: 555860 - DNA, 280 bp, Homo sapiens
cctcacgggagcaccctatgcacgcacacacgcacacacacacacacacagactcgtgtatatcaatacaatcaatatatgagaagttttatttattgctgataatagagacaaggtactctctttgctgcccagactagtcttgaactcctggcttcaagcgatcctctcgcatcgtcctccccaggtgtcgatattagagggatgagccacccttccaatctatgacacgttttatatatgacgtgacatgatctctgcatcagtcgtgtacctgatc

SEQ ID NO: 555861 - DNA, 162 bp, Homo sapiens
gtgacaggaattcattacgaagccccccaggcggaaggtacatggtcatgaactggattacggtcctcatgtatgcagcatgggcatggggtgctctgtctccatcaagctgctgcatcaccatcggccagcgcctctgtacgtgtacaacgttcacgctcc

SEQ ID NO: 555862 - DNA, 102 bp, Homo sapiens
  misc_feature (2)..(2): n is a, c, g, or t
tnaaattcatgatgaccaataaactggacacggcccttggggcttcagcgcggtcgtatctgccatgggggctcacactagcgtctgcgaccaggcaaccgc

SEQ ID NO: 555863 - DNA, 610 bp, Homo sapiens
  misc_feature (50)..(50): n is a, c, g, or t
ccagccaatcgatgttacaatttcatttatacatcagcagtttaaactcnaaggtatcatgtgccaccagcaaatgactgtcggtgattcactatgagcagcacatcaagcagcagtttcgtataatatgacatcttgtccccatgttaggtctggcaagccccacgagttgtggacctcgtactccttccgaagagctatatgacacctcagcttgtactcccagtctcctcctttctgcgtcctgtaggatgctacatgatcgtccagtatatactggttcacatcctctgatctggtgtagagcatatgccaagtagtgagcgagacatgggttcaagtccagatgcctcaccagctgtgcaaccttaggtaagttactaaaccactctgagcctcagttctcctatctgataaatgagcactatgggctcgttataaatagcatagaatgtatcaatagcatttactcagtcatggaactaatatttactaacagcatatatgctgtaatagatgccaggcattggatatacgtaactctggtcagtctcttgtggtcctctgggtgttccaatgcttccctctggataactcagctatctttctg

SEQ ID NO: 555864 - DNA, 402 bp, Homo sapiens
tgttgtctgctctgctctgagtatctggatcaggcgccacacacaccagtaattttgatttagtaagatggggtccaccatgttggcaggatgtctcgatctcctgactcgtgatctgctgcttggctcccaaagtgctgggattacaagtgtgagccacccacccgggcagaacctttaaatttaaaattgtacagtgtactttcctgccaagaagcgtaggaggaagatttaagtaatgtctttccagttttcggttaagaacttgctttgtattaaaatagtccttcaagtctacagccataccaccctgaacgcgcccaatctcgtctaaaatagtccttcaaatatgtatctcttatagccttcagttatcccaacaaaattatctaaagatttgtt

SEQ ID NO: 555865 - DNA, 353 bp, Homo sapiens
ggccaggcggaggcccccagggcgggaggccaaggggctgtggtagggccgggctgctgaccatggtggcgaatgcctgctgcctccctccaggcctcagcttggctctggaaaagtccaggtgtcccttgcagcttgtggagggtctgtgtggcttgcacctgctctcggtggaaaggagcaccctggccatccccgcacctcgagctttggcctgtgatacagcctggtgtctttggagcctgcgggcaccgtgccccgctgtgttttggtacaaatcatccgtgtggcccggctccgtgctcggtccctttccccccccagtgtgcagattaaagcaagtcagatcatca

SEQ ID NO: 555866 - DNA, 607 bp, Homo sapiens
agtctctcccatcagttgttttaagttttttctgcaacttagattaactctgcttattcctgtgaaccaaccagtgatctctggctgctgctcacaagaaacaaaaggaatgggtaatgtaaaaatctggatcaatattctaattctgggcacatactggaatcagctagtaaccccaaatcagcttggttccaacagttgcccagttcatggaaaaccttcttatttaatttactggggatagttttgcttattttgctttactgttgaggagtatattgctgttgtactctttgtgtaggaatgcaggataagcttactgaatgttttcttaaactgaacaccttttaatcttccagatatcaccttttgttggagttatgaatagctctcaccatactgatgctttctgactgagctcctctctgaaccctgaatacaagagaccctaagagtcaggcaggaatatcatcgcccctattcaccctgaaaaagttacagaagatggatctttatttctttgtaacccctaggattaagggttctctaataaaagggatgggagaaatgtcagaggtgtactgatgggagcaagatgcggggtacc

SEQ ID NO: 555867 - DNA, 180 bp, Homo sapiens
  misc_feature (179)..(180): n is a, c, g, or t
tcgtctcactggtgcccggaacaccaaatggtgtatgttacataaatggaatgtataatatgaaacctttgggaattggcttttttttcactcagcataacgcccttatccacgttgtgcatattatgggttgaattactgtcccacccaagaatatgcaaccaatgtgggaggccggnn

SEQ ID NO: 555868 - DNA, 233 bp, Homo sapiens
  misc_feature (55)..(55): n is a, c, g, or t
attagcatatggatgggatcattctcagtgttctcgagagacttcattccttggngtatggcggcaagtaagatcaatagaattaggaaatttgcctaaactaagttgtgccttccttaactaaaaaggcatgggctttgtcctcggtgatcagtttttaagccttcttccttccagctccttattaaaggcaaggtgatttagtagggaattgttcaaaggttctgcctctg

SEQ ID NO: 555869 - DNA, 392 bp, Homo sapiens
  misc_feature (4)..(4): n is a, c, g, or t
  misc_feature (70)..(70): n is a, c, g, or t
  misc_feature (110)..(110): n is a, c, g, or t
ttgncctggatgtcaatagttttcagtgcccataaagaaaacaagctaaaagaatggagtttgtgttttnaagtaagcaagaatccctcttaaagctgggcatggttacncacgcctgtaatccccaacacttttggaggctgaggtggcagaagcccctgagcttaggagttcaagaccaccctaggcaacatggttagaccccacctctacagaagattttttaaaaattagccagttgttgtggcgtgcacctatggtcccagctactgaggaggctaaggtgggaggatcgcccaagcctgggacgtcaaggctgcagtgagctgtgttcctaccattgcactccagcctgggtgacagattgagaccctatctaatctaaaaaaata

SEQ ID NO: 555870 - DNA, 327 bp, Homo sapiens
aaaggctggtactagctatctagaaccaaagaattttagagtgggcaatcttttaaagtagtaggcccttcttccaattaaaagatgaggaaactactggacatggtggctcacacctgtaatcccaacactttggaaggccgaggcgggtggatcacttgaggtgaggagttcgagaccagcctggccagcatggtgaaaccctgtctctactgaaaatacaaaaattagccaggcatggtggtgtgcgcctgtaatcccagctactcgggaggctgaggcaggagaattgctggaacctgggaggcagagctgcagtgagccgag

SEQ ID NO: 555871 - DNA, 141 bp, Homo sapiens
ctagtcaggagagttgacgaatgagtgtgaggcgtattataccatagaccgcctagattttaagagtactgcgagcaagatactattgacccagcgatgggaggctatcgacatgggccttagaggagctcctaacgtgga

SEQ ID NO: 555872 - DNA, 307 bp, Homo sapiens
  misc_feature (143)..(144): n is a, c, g, or t
  misc_feature (171)..(171): n is a, c, g, or t
  misc_feature (196)..(196): n is a, c, g, or t
tgacaaattcttgctctggggccgaggctggagtgcagtggcatgatcttaggtcactgtaggggccacctcctgggttcatgcgattgtccggcctcagcctcccgaatagctggcatttcaggtgcacaccaccctacctnnctaatttttggatttttagtagagatngactttcaccatgttggccaagctngtcgccaacccccttcctcatgtaatccccttgcctcagcctcccaaagtgctgggattatagtcacaagcaccacacctgccaaggttaggtaaattatgtattcttaat

SEQ ID NO: 555873 - DNA, 367 bp, Homo sapiens
tatcggttcatgcatatcatcagatcctgctctaaagttacttcctggtcctggtccgaaatttccaccgccaccgacgttgaatccccgaaagccgaaagtggcctccgtcttccactcctagagactctgaacttccggcatttctggtctagacaaagcctttcttacttctgcattatgaccattgatggtatggtatttctgcaatacgattttatccacaggatcatggtcatcaaaagtaacaaagccaaagcctcttttctttccagactgcctatcagtaattatctcaatggtatcgatttttccatattcctcaaagtaatctctaaggtgatgttcctcagtatcttctttaatt

SEQ ID NO: 555874 - DNA, 546 bp, Homo sapiens
taataggtgaaaagaattcaaagttaaaaaaatattttcatagacaccaaaaattattagactctaaagtctaagctcccttatctgtactccctcttgttcccgcatactctggggaggcctatattaaacacaagatctttaaatacagagatagcatagtctatattgtgcaagttattatcatctggctgagcaattcactgagagcaaagtatatggagtaagggggcagggaccagagagagtagaggcaggattgaagctttgcccactggagagcagctacatgaggacagaggagacaggagagcatctgcaaataaccagcctcgtcctgaagctgccagtgccctatgagacagttggggtggggtatactgtttagaataggtaaactaaaccacagaaattgagaggtttgctagcacaagcaaccattcagcagcagcagaaatggtctccagttgtaccatgcattctctcctccaggctgtggcacatcaccttactccatcctggtcttccctgtattcctcatgtctg

SEQ ID NO: 555875 - DNA, 102 bp, Homo sapiens
ttcataaagagtgttacaccgtgcgctccaaagtaccacaaagcctgctccacacctggatggggtgcatgtagtctttggactggttatttctggttttga

SEQ ID NO: 555876 - DNA, 226 bp, Homo sapiens
actgcccccctagcagccacggatttttattttatgagaaaaaggtgtgactatggtagaggcaattacaaggccaacacaaattgaaatatcacaaaaagctttaaaaaataatgtcgccgtcgtgaagcaaacatcaggcgcagacaaatctttttggctgttaaatctaatgctacggttgggggtaatccaacgtctaaagcagctgtcgcgggtggtgtct

SEQ ID NO: 555877 - DNA, 891 bp, Homo sapiens
tgggtttcccccaagggtgttttttaacccccggggtttccgggggccggggaaggggggggccaaaaacaaagctcctcggggggggggggcgcctctcgggagacccccatatcattcacgcctcccgggggcctccaccaggagcacccccataagagagagggagaaagaggcccaggttggtcgtgtgtcccaccctccctcacaggtgtcccaaagaaaacatggtgggagcggcagggtgtccaccacctccacagcgttgtccgaccacagacaaaacaacaaatagtgacacacacagcgtgtctgtggagacaccctcaaagggcgcggcggagtgggcgaaacaggcgcgcagggggcgcgaggagagcggcgccgagagcacctggcgctcaccatggggcacacaagggcaagtgcgtgtgctcacaggggccacacccaacaaaaaagctcgtgcgcacccccgcgtctgagagaaaaagagagatggggaaaacccgcgcaccacacgagtggtggggaaatcatcccacagtgagtaacacctccccggcagaggcgctggaggggggttgtggagagggcacaaaaagagagagagcgccctcttatgatcacgagggcactctatacatttatctgctcgctctcactgctctctctgcactcgcactctcccccacatatactcggtggcacccagactcggggaggctcacccgagggggcgacaccgcagggggggcaaacaaacagaggaggggtggctccccagagaaaaagaacgggcggagggctccccccccatatataagccgcacacaaagacacgtgtgagaaaacatcgaggagggagcctagcggagagaaaaaatccgg

SEQ ID NO: 555878 - DNA, 213 bp, Homo sapiens
gagaagcccctaggccccgtgcatgtcactaacatgcctggaacctgtgcacccaggtgtggaggtcaccactgcatggggtcctggcccctgtacaggagacctggagatgctgtcactcatggaggggtccaccgctagggacggtgtacaactgctcatgctagcatgacatggacgggaatcgcgcaaagaaagacaaggttgccctgt

SEQ ID NO: 555879 - DNA, 902 bp, Homo sapiens
ggcaacccgattgaacaacaggatcctcattctacccagctgtcacgatgaaatgaaaccaggaccctactgacatgtgacaatacggcgaccgagcatgcgtgcgcatgcacacgtgaccccagctcaacccctggaaatggtccctcgtacttgcgttccaggacaccttacacgccacaagccagttatagcgctcattacaagtagcaacccgtagtataacacggcttcagtggcagacaatgacaccccgtctttacctgtgtgtcccttggccttataccgaccgggcacactccatacacatcgccccacccgtgatcccagacagcttacttgcgactacataggggcctaagcgcagaccctcttacacaaatggtgatggtaaaacagccgtaagatccatcccaacatgtcccctcacacacttatccaaacgcgtggtggacccgcaacaacgatgcagggtgcccagttccgattcattaaagtgcccgccgcctctgctacgttaatattggacaaacgcgttaagaccaatcactaaacgtctacaacgttcagtccaaagtgccagtctggcccattacacaataaagtctaacactcgattgtgtgggcccctctcactggggcatactccccgggcataacgtagatccgctttccaaagggaaccccaaccgcacacattggcgagcaccataaaaaagcgaggtcataacaaacaatacgcgcccaatatctcgtcccaagaacaactacctttgtccccacaacagtttggctcaaagccctaaaggggcgacttccttactacaaacaaagtgagtaagcacactataaccactcgggcactctcttagccccccatatattgattccccaacctcgtg

SEQ ID NO: 555880 - DNA, 99 bp, Homo sapiens
tcccagagactacttctatgtagcagacctggcaggtgctgagattgatgtaccatcctacctggctgacctgcccggaattgcaacgacctcatgtac

SEQ ID NO: 555881 - DNA, 395 bp, Homo sapiens
gatcccctaggtccgatcgttatgtctaatcagttgcgggtgatcctttcagtcatccaacatcatcatcatgtggctgtgctgcaatcagaggcagacaggttaggcaatatagttccataataatagtcacatacaatcatcaatggtatcataaggtcagcaaccaaaagaggttgttaattcagcacatcatcctttaagaaaaatgttgcagcaaactcagtcttgatatctgagctctctgggctcccttacttgtgagtaagggatcatgctcaccactggagaagcttacaccgggactaaatttcttttatcttattttttggctatgccagagtacggctacggtacgcacaagggagttggatcagggtgtaaatcgcaggggg

SEQ ID NO: 555882 - DNA, 1122 bp, Homo sapiens
catgtggttggtttgtgtcgagtgtctgtcgtggtttcgcgggctcgtcgcggcctcggtggggggtttgtagcggttttgtgtcccctcagccgtgtcgcaggtcggcgttgtttgctgttcctccgtcgccggggccccgtgtcgtggcgcgcgcttggtggcccccctctgttgccgcggttctaggtgcccttgtgtggcttagggtcccttcccggttgtttattcttgtgtttcgtcggtgtgtcctctcgtttctgcgtttgatcggggcactcgttgtcttttgtgttgggcttgttcttttcttgttttttatgtgtgctccgttgggtcttcgtcccatgtgtttctgtccctgggtgtggggtgccctgtgcgtgtggttgtgtggttgtccgggccccttttgggctcctccttcgctcctttgtgtcatcggtggtgtgtctgctttgctcgcccagtgggcccctttgatcttcttggtctgttgtctgtctcctctctgtgagctcccctgtgaaagggtagatggtgctgtgcttccccttgttgaccactgcctcattgtctggagggtgtctgctccctgtctgtcttcacgggtgatgcgccttgttagtgttatgccccctgggcctctcctgcgtcgtgtcctgtcgcgtggtgtgcgtcccgggttctgaggatttggaaactggctagtgagccctggaaatatataattttgagatcctttcctaatctcccgactatacttccttcgccacgggaagagtgcttgggacacagggccctaagttttttcctagtacacaccctaccacggtacccccctttttttctttcttttttttttttttttgtagagtccagggtcttgctttgttgcccacggctggtcttgaactcctgggctcaagtgatccttttgccccaacctcctgagtagttgggattacacgtgtgagcccccacgcccggccagatacctcctaacacaggcatctccccgtccctctccccaggagccagcaccagtttctcaacttaactttatttcaataatttaatagatacctctcaaataataaataatataaaaaaacataaaaa

SEQ ID NO: 555883 - DNA, 675 bp, Homo sapiens
agcacagagcctcgcctttgccgatcctgcgccctgtccacaccctgccgccatgctcaccactggatgatgatatctgccgcgctcgtctgtcgacaacgtgctcctgtgcatgtgcaatggcctggcttcgcggtgcgacgatgccccccgggccgtcttcccctccatcgtggtgtgcgccccagtgcaccagtggcgtgatgtgtgtggcatggtgtcagaagtgattcctatgtgtggctgactgaggcccagagcaagagagtgcatcctcaccctgaagtaccccatcgagcactggcatctgtcaccaactgtggactgacatggagaaaatctggcaccacaccttctacaatgagctgctgtgtggctcccgaggagcacccctgtgctgctgaccgatgtgcccccctgaaccccaaggccagccgcgagaagatgacccagatcatgtttgacgaccttcaaccccagccactgtacgttgctatccaggctgtagctatccctgtacgcctctggccgatacaatggcatcgtgatggactccggtgacggggacacccacacatgtaccatctacgaggtgtatgccactcccccatgccatcctgagatctggacctggcatgccgtgactgactgactacccatgaagatctcacgacg

SEQ ID NO: 555884 - DNA, 562 bp, Homo sapiens
cgctgagtcgctaggcttacgggcgcctgctcatatggtcgctaatttatgagttttccgtcagcgccggggtccatcatgctggtcaggctggtcttgccgtcctgacctcaggtgatccgcccacctcggactcccaaagtgctgggattacaggtgtgagccaccgcaccttgccaaaggtattttcatatagatatatacacatactatagtaaatctgctaactggcatttcacaaatattacctgctcaaaatctcccatagtaatgtattaggtaaacaatcttctaatacgtatatgtgctaaatacaatttccatcaagtagcaagcagctaatgaaatataagattctacacaacaaaaatgctgggatctatcctattctatctatctatcattctatctacctacctacctaccgattgatcgatcgaacgcactaccctccactatttagttgatacacatattccacataaagatagtgccttaaaatgccacttaaataaactttctagtgctgaacaaaacaagataatttataccattagggcat

SEQ ID NO: 555885 - DNA, 439 bp, Homo sapiens
ggcaatcagttggcaaactggtacaggtacagaatatcagagtctccaaatatgcaagtcagaatgctgggttatcccaacaattaaccatcaccccagtgtcttcaagtggtggcaaactctagccagatgctcctgtgctgtcgtggtgccccaataactttgaatactgcctagcttgcatcagtgcctaaccttcagacagtgcgcgttgccaacctgggtactgcagatatacaagtgcagggagtgcccgtaacaatcacaagtgtagcaggtaagttctgacatcttataaagtacctttaaaatagtattacataacaataattgctttactctcctaatactaaggttagccgtaacactctggagtaaccacacaatcatcaggacaccagaactagcaatattatactaacaaacatagctctgtagt

SEQ ID NO: 555886 - DNA, 191 bp, Homo sapiens
gcccctgttgctttgacggcactaggtgtcctttgtggttcatgtgggttagagatgacaggcaacgctattctcacacaaacagcctgtcctcggtgtcaacatgcctttaatccacaattgccatctacatcaacagatttattttttgctaaaataaacgtatgacaactgtagaaaattaattccat

SEQ ID NO: 555887 - DNA, 840 bp, Homo sapiens
ggttgaaccaatatgtctgaggtaccttctgatgttcataaatcttagggtccagagttatggaagaagttaagactgtgacggctatgtcacctccaatgggtaggcagtgataagactgtcggctatatgaccattctgtgcctaggatttctctttctttttaccttcgcaaaatgagaaggttgggacgaatggctatttctcacgggcctgggtcccccaggtctgacattctaggggatctgcaggctcctgactaaaagctcagaacatggcttaggaactgcatagggggcttaagagacgacaaatatgccgatcgtcgtatatcagtgaactgtgagggaatgaactgacagatgccagaggttaccgaagtctgtgtcgcttacggacttcaggttgtggacaagtcccggtgtcgtgaccgatcttcgagcaggggcacaagaccagcgccgcgggcggctttatcgtgtgtcgtgcgtgcgtgctgcgcgggtccctcggcggcccctgttgacctggctctccgcggggcgtctgtacgttctccctgggtccttgaccggactccttgtccacccgctgtgtgaccctactaggggcgtgtgaccctgttcctcatgttcgtttatctacgggctgggttggagaaggaaaacggctcgggtcttcacgaaaattcaaccgctggcccgactatactgactctttggttacctaagttacgcactcaacagtggacaacgagaaaacccccgagcaaaaacacgggaccagtctctcgtcccacaagttcgaagatacccagggtgactgagttaatacatcacc

SEQ ID NO: 555888 - DNA, 316 bp, Homo sapiens
  misc_feature (25)..(26): n is a, c, g, or t
  misc_feature (129)..(129): n is a, c, g, or t
  misc_feature (153)..(153): n is a, c, g, or t
  misc_feature (187)..(187): n is a, c, g, or t
tagaggatcccgctgatccgcttannagagagaggaggactggcctgtgaagactgaggtggtgatgtgaaggtcttttctccatcaaatcttgcgccagttaccttgtatagtatttagattgttgtnatcagttggtcatatggctttatngaaggctggtttagcatatttagaacttattggnatgcattaggattcttcttcttagagtattttaattccagtatgtacttatgcttgtcttctctacctgcccccagtcttgaagtggtggaaatgtgtgtgtgtgcatgtgtgtgtactttccttaagc

SEQ ID NO: 555889 - DNA, 219 bp, Homo sapiens
gtagggtacatggtgggtgctgcagaagcactgtgttggagtaagagttttgcggatgtcaggtacacttcatgatggagttgaaggtagttatgtggatgccacagggactccatgcccaggaaggaaggctggaagagtgcctcagggcagcggaaccgctcattgccactggtgatgacctgagcgtcaggcacctcgtagctctttctccaggga

SEQ ID NO: 555890 - DNA, 262 bp, Homo sapiens
agatggcaggtgcagcctcagcttccgctcgagctgtgagaggggctctggggtcactgccagaggagtgtgcgaatcaaacctgaccaagggctcaagaataaaatatgaattgagggcctgggacggtaggtcatgtctgtaatcccagcaatttggaggctgaggtgggaggatcatttgagcccaggagttcgagaccaacctgggcaacatagtgagattctgttaaaaaaataaaataaaataaaaccaattttta

SEQ ID NO: 555891 - DNA, 170 bp, Homo sapiens
ccacattgagataaaggaaaacttcgctatgttgcgatttgttcccgtataaggatatatctggaactatggtgccatccctcagcacttgggaagacccagggcacaagtgatgaacatactggctgttgtggtgacaattacccaattgatgtgtgtgaaattggaag

SEQ ID NO: 555892 - DNA, 192 bp, Homo sapiens
aactattatggtgtcatacaagctagcttcccttggctccccttgaacttttgccatgagcggaagcagcctgaaactcttaccagaaccagaactgtgtcaaacctcttttccttataaattacccaccctctggtattcccctatagcaacacaaatggactatgacacattgctacttactgaaatgat

SEQ ID NO: 555893 - DNA, 834 bp, Homo sapiens
gccttctcgggggtcatgatgggcagcaagatgggtctgctagtagggtcgtccagtgtagtcaaacccaacactccattaataaggtttcctgacagaagagacaatcttaaacccaagtgtatcagaagcttggagatcagcagggttaccatctcatcttctgtaatttcacaaccattctaagggaagtaaatcaccagattgtgctgatgtatcaggggtccaccagacgaggagaattaataaaaaatacctcagaaatacagagggaacgtgtgtgtctcaagcacgacatgaatttatccaacggtgaggtcctgaataaaccatgtggggctggctgttggtcatcagacaataagattgtgtctttaaaataaagggattttccaaaaatgacctgatgagaaacttggtatattaaaacaccctttaataactattcttgacacacactgacttctgggacaacaaaaacaaacaaatgaaaaacaaaatttgtgtggggggggcgctggcctaggaaaaagtttcgaagaccccaatcgtggtggtggcgccggggcccaagagtagtatagatgaccccatggcacacacggctgtgtcccgaagaagcacccggggcacaagcaaagggtgtgtggtttcctaccaaaaaaaaaaagcgcgggcgcgaacaccggcgttctggaccaaactcaagaaggggttccgggggccaatcgtgctcacacaggggccaggaagctgaaaataccagccgccgcgggagagaacataaagacaaacgacaagcagagcagacagcaacaacagctctgagaacgc

SEQ ID NO: 555894 - DNA, 449 bp, Homo sapiens
  misc_feature (72)..(72): n is a, c, g, or t
  misc_feature (275)..(275): n is a, c, g, or t
  misc_feature (417)..(417): n is a, c, g, or t
acctacagaaatagccataaccttcacaatacaaaaaggatttctcaaaaaggaaaattattaatgtttagnaattatagaaaattatgtttacataaaaaatcacctaccttcccatcaaatttaacagctcaattgttatgtatgaaaagggaaaaataaaagctatctgtgcaagagccactacaatggtggtcactccacggcctccccaacactacttaactcttactagttcattagttgtttaacaatacaccgttccttcttttccnaggggagtttactgttcttcgagccaagatggagcgtccactccaggggttttcaatctgacatggaactgcttaagtgtcagttcaagctgcttctgattcccggcgaagtaggcagcaactgcgctgtggaagaggaccnagttggttgcgtagcactttgaccttattttc

SEQ ID NO: 555895 - DNA, 91 bp, Homo sapiens
agggcattatcgattcagcgaggagtaattgatggcccgacagtggccctgcaccctgaaaaagttcctcacgtcccccactatttcgggt

SEQ ID NO: 555896 - DNA, 177 bp, Homo sapiens
ccccccttttttttttcggggggggggggggttttagggtttttgggggtttttcttttaaaacccaccgggggccccccccccccccttttgggttttttaaaacccccccccttttttgggggatttttgggggcccgggcccccaagggttttttttttttttttttttgggga

SEQ ID NO: 555897 - DNA, 556 bp, Homo sapiens
  misc_feature (49)..(49): n is a, c, g, or t
tcttaggtgattctgcctgtttgtctgtcattgtatattctgtttactntgcttcaaactggccccaagatgttatttttgtggtttctggctttctagattctatttttagatactgcccattgagcaataatggtgataatatagagagaaaagaaagacctttcatgggccagttgtgttggaataggaaaatcaaacgtaagcacaatttaagtatgtagcagttattcctattttgtattctaggaataaaaagatactttaattttttatgctagaattacataattacataatcagatgttttaattttaccatataacctttaaaaatgattcatttttgaggatatttaattggataccaaagctaaaatccatatactgtaagtgggttgcctttatagattgcgggacacaataacatgaatgtattgtgaaagcacttttagttacctcactttcctcagtcttggaatgtgtattttgtgggataatgattatcagaaaagcaaaaaattacaacgaacaaataaatttatataatatatcca

SEQ ID NO: 555898 - DNA, 752 bp, Homo sapiens
ggaggccttcattcactgatttcccctattctcaggctacagcctaagaccaaacttcacaagaatcacagctcaatgctatgaagcgattacagatggtcaagaagaaagctgcccaaaagaaatcaacgaagtacatgtgtgccagtaggtattggtatcatattgagcctagaagatgagaaggcttattattatgatataatctgaaatacactgtaattctagtaaacagatcctgccataattcaactactcacaaaaccacggcgcagactgcgccattacttactacctattactcccgcccgcatgagctgcagcctcgctacgcagcagtttcttgcgcctcgcgtgagtgcgagccgagatggcaccccccaggcaacaccggagcaagcgctaaccgaccaaaatcactaacacccgtctatcgtcacccagcccacgcattcccaactaagtcccacttcatagtaataccgcgaatcactaactacgagagttactttgcccaccacgactagtttcccgctaataatccgtggtgccccccgaatagtcggcgttatcccgcgcaataaagcagcactaatcttcgtgaaactcagagctaccctctcgtcctaactacatgctcgcaattgctatagtggactgccgactgacgacacacggtttgagcagttactctccaattagcaggaactactcacaggtgaaccacgagaccaaacatttacttaaacctc

SEQ ID NO: 555899 - DNA, 128 bp, Homo sapiens
cgtcgtagtagagctttgctaagcggaatacgtaatgagagatgtaagtccgtgggctgattatgacattgactgtcgccggtgaagcttcagggaggtttggattaaaatggctgtaactacgaggg

SEQ ID NO: 555900 - DNA, 209 bp, Homo sapiens
cgtcttctgacaagtagcagcgtatttaagttcatgtgaatccccagattatccctaagtaaatattttggtttcacagaaagctggtcctttggtttttctgtgtacacgtgcgcactggcgcatgtgcgtgtatgtgtgtgtgcgtgcatgtgtcattggctaccaggtgaagtgtctcaggtctcgggcttacggctttagctctt

SEQ ID NO: 555901 - DNA, 385 bp, Homo sapiens
tgaccccccttcccccacatgatcaggcagcctctcagtcctcggagatctcagatcatcgtgcagtctgtcttgttgacacatgcccccatccgtgtagttttaatggctcaggtggtctgagaggtgtaaggtgccaactctgattgaaagatgcctgtgaggaatcaaaggtgccacacagggcaatcttctctctgttatctgcacagcggagctgcccaagccctccatctccagcaacaactccaaacccgtggaggacaaggatgctgtgtgcttcacctgtgaacctgagactcaggacgcaagctacctgtggtgggtaaacaatcagagcctcccggtcagtcccaggctgcagctgtccaatggcaacaggacc

SEQ ID NO: 555902 - DNA, 736 bp, Homo sapiens
  misc_feature (199)..(199): n is a, c, g, or t
  misc_feature (237)..(237): n is a, c, g, or t
  misc_feature (255)..(255): n is a, c, g, or t
  misc_feature (277)..(277): n is a, c, g, or t
  misc_feature (280)..(280): n is a, c, g, or t
  misc_feature (282)..(282): n is a, c, g, or t
  misc_feature (288)..(288): n is a, c, g, or t
  misc_feature (294)..(294): n is a, c, g, or t
  misc_feature (301)..(301): n is a, c, g, or t
  misc_feature (303)..(303): n is a, c, g, or t
ggggtcgggggcgtctggctgcccttcccagaggcgcgccctgctgctgagccagatgcagtagccgtaatctgcgcggaggcacagagccggggagagcgttctgggtccgagggtccaggtaggggttgagccaccatctgaccgcaagctgcgtcgtgtcgccggttctgcaggcaccatgagccaggacaccganggtggatatgaagtgaggtggagctgaatgagttagangccctgagaatgcagccngatgaactgcggctgtcttggnggngnccagtntccctngcgggancncgagataaaatattagtgacgaagtaatgaaccaccagtctgtgagttactactgacagtcgaaaacggttcattctgacgagcgaatagctctttcgggcgcttggccacaatgcgagagagactggaagtcagtctgacatgcacacgcactccgtacgagagtggccccacgcaggattagcatatagcttttgaatctggccattcgaccggcttgtgacgttgtcatagcctcggtcatgatcatctggatggatgcgtggtctttggcaccgatgatgcaattagctgagtcggagcactggtgtgccccgtcacgtacaggcttccaagaattagccggtgctcagttctgcatgttcgagcatgcgtgtgcgcctttgactgccaccaccccgcgtgcgatgtagaactagctggaagctggggt

SEQ ID NO: 555903 - DNA, 297 bp, Homo sapiens
aggcatatagtgttcttcttatactgtagtgtcttactcctattaagttattagggtaatgctggcttcatgggtggaaattaaacacacccttggtaaacagcagtcttaaccattgcgccaaagacgaaatcaccatgggcaccttagctgatgttttgacacgaatgaacacacaacataccaaaaaccttgggatgcagaaaaagcaccactgagcgggacgtttctagcagtaaatgcctccattcaacaactacgacagatctccaaaagactaattgtacacctcaacct

SEQ ID NO: 555904 - DNA, 409 bp, Homo sapiens
tcccgggtgtaacgcgatctcctgtcctcagcctcccaagtagctgggattacaggcatgcgccaccacactcggctaattttgtattttagtagagatggggtttctccagttggtcaggctggtttcgaactcccaacctcaggtgatccacttgccttcgcctcccaaagtgctgggaatacaggcgtgagccactgtgcctggccttttttttttttgggaaattatttcttcactctttcccccaggccttaagttgcagtgacattattatcagctcacgtgaaattctccaccttccggggttacaagcaatttctccgcgcctaagccccccattagttagctggttataacgaggtttgcaccaccacgcccggcatatttttgggttttattagataaa

SEQ ID NO: 555905 - DNA, 134 bp, Homo sapiens
ggactgtgacgctagggcacatcgcttaatcttagcgtctagttttctctcaaaatgagcacattaggctaaatgatttccgagatttccagactagatcctagacgtactactactttctaccatacgttgac

SEQ ID NO: 555906 - DNA, 816 bp, Homo sapiens
  misc_feature (199)..(199): n is a, c, g, or t
  misc_feature (237)..(237): n is a, c, g, or t
  misc_feature (255)..(255): n is a, c, g, or t
ggggtcgggggcgtctggctgcccttcccagaggcgcgccctgctgctgagccagatgcagtagccgtaatctgcgcggaggcacagagccggggagagcgttctgggtccgagggtccaggtaggggttgagccaccatctgaccgcaagctgcgtcgtgtcgccggttctgcaggcaccatgagccaggacaccganggtggatatgaagtgaggtggagctgaatgagttagangccctgagaatgcagccngatgaactgcggctgtcttggtgtgctgtgcacatgtcacctgtgctgtggagcctgatgaagaattgtgtcttggttgaagatacaatggtgtgctgtgaatgactgatggctggagtgctggcatgcctgctgggctaatgttcactgtgtgcccttgtccaatggaggagctgctgaagtgtgtgcaggcagcccctgtgcttgggtactgcacccgctgggcactgcttgctgctcttctggctcggctggctctggcatgcttgcttggtgcctgtggtcataatctgtgcgagctgcctggcgtttgtcgcagagactaccggacgcagaatgtggttggcacacggggcgccctctacctgcatcggctgaccttcagtgccttccagggccactggtgcgggcaacctggcggggtctgaaggggcgtctcgattacctgagctctctgaaggtgacgggccttgtgctggtgtccacttcacaagaccagaaggatgatgtcgctcagactgacttgctgagatcgaacccaatttggctcaatgagaattg

SEQ ID NO: 555907 - DNA, 197 bp, Homo sapiens
aaaaaatttttaaattaactggggggggtgggggggacccgtaggcccaactgctcaggaggcttaaacaggagggtccctttagcctgagttccaccctccagttagctatgggggcccccctgccctcccgcctggggggcaaagccaaaccccgtcttttaaataaatttttaaaaaacctttttcccttggga

SEQ ID NO: 555908 - DNA, 577 bp, Homo sapiens
atgggtcaaagtcagagtgcgtggtcatggtcctgcgacggtggcaagaatggatgacaaggacaacgaaacagaaatatgaacctcctgctaccaactacgatgtggcggaaaaagaacgaagaaaacaaagggaccaggatgctgcctagcgagaactgccacctggtgtacgaccgtcacactcagttgccggtataacacattacgtgaaggttacgagagagattaaagactatcgtgtctcgatggaggagagaattccattatcacagatcaggaacaaatggaacaccattagtaacgaaaatgctacagacggaggacacatgatcaaaagtggatgatctgagggggaccccgatgtacagtcggaaccttggaagagattattgatgacaatcatgccatcgtgtctactatctgtgggctcagaacactacgtcagcattctttcgattatgtaagacgaggatctgctggaacctggctgctcggtcctgctcaaccacaaggtgcatgccgtgataggggtgctgatggatgacacggatcccctggtcacagtgatgaaggt

SEQ ID NO: 555909 - DNA, 417 bp, Homo sapiens
aacacatacattttcttaatgactaaaatgctgagatttttaagcttagcttctgatctactctccaaaaaggaatgttagctacataaatcattatgtttgctattttgacctaaatacaacaatatctaatttattatgttactaagaaccctaacattgcacatgaagggatgactccaacggcactgaatatgagctacatgtctccggtgatttttccaaatattttttacaggacttactgagactttccttttttcattcttttagcccacatgttttttaagaacattaattggccgggcgcagtggctcacacctgtaatcccagcactttgggaggctgaggtgggcggatcatgaggtcaggagattgagaccatcctggccaacatggtgaaatccgtctctact

SEQ ID NO: 555910 - DNA, 229 bp, Homo sapiens
ttgacaacaatctgagagctactatctaggcatgtgatatatactaggggtatacacgccaagagcaaaacacagtatcagcctgctaggaacatgtagttacagagctggtaaggtggtaaaacatagggcaaaactagtgcagtgtgagatatgggaggtcgttctacatacagctccaggccaggtttaacggattagtgaagggggtacgcggtacagagtcaag

SEQ ID NO: 555911 - DNA, 1020 bp, Homo sapiens
catacaagcagcaggaaaaaacacaaaatgtaaggctgggattacaggcgtgagtcactgcgcctggcctgaatttattttcatttataggaaatacctccaacacacaaaaagatgtaataattagccgggcgtggtggctcatgactgtaatcccagcacttgggaggccgaggcaggtggaacaccagaggtccggagtttgagaccaggctggccggcatggtgacgacctcatctctgctaaaatatacgacatcaaacactatatcataaatccatcaaaacgtgttggcgtggaccccttcgtcgcccacccaataatcactgcctagatgaccaacttgcttgtcgcgcgcgcgtggccacgcagtgttagaccagaacacgtagcgaacaaggacggtcacccaaggaaggccactccgggactcgccagagagcaggggcgagaggcccacaccgaaaataaaacgcacgcgggggagaacccagaccgatcttggcacacaaacaccccaagagagggacatcgcgaagaccaaacggggggcaacacacaccagcgaggccacagcagaggcgcgataatacagaattaacgccggcagagcgaagagcaacagagcagaccagacatgcacagacagacacacgcacaccacgaacacacatggaacaggacaagtgtcagatactacaacggaaagacacaccagcccaagcacacgacagtaaaacacacgctaccaagaaacaacacacacacaacacaaacagcgcacatcaccgagcagagcacaaagctccaatccagcacatgcaagctgaaggagcaacccacacgcacatgagataacacagctgcacagaacgcacaagccagactgacgacagaacagataagacaaacacaacagacagtgaccagcgacagaaaacacagacacagtacgagagcgagaacgcacagcatcgaccggacacgggcatcgcaaccgagagcaccagcaacggaat

SEQ ID NO: 555912 - DNA, 111 bp, Homo sapiens
taggataccccatatgtgtttctcatgttagtaagcgattgatctatgaataaaggcttatctacatttatcacgacttctagtaagcctctacctgcacgacaacacata

SEQ ID NO: 555913 - DNA, 312 bp, Homo sapiens
atgacaactagggtcagttttgcaggtgtaaagccatttaccaagatagttgtaggtaaagaagggcagatttattagagaaatagtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 555914 - DNA, 350 bp, Homo sapiens
ggtgaaatcccaaacaacccaacatgaggaatgaaatagaagcccatcactgcagatacccacacatattcaaaagataataagggagctgggcgtggtggctcatgactgtaatcccagcactttgggaggccaaagtgggcggatcacttgaggccagaagttccagaccagcctggccaacatggtgaaacctcatttctactaaaaatacaaaaattggccagatgtggtggtgcacacctgtaatcccagctactggggaggctgaggcacaagaatcacttgaaccatggaggcagagattgcagtgagccaagatcctgccactgcactccagcctgagtgac

SEQ ID NO: 555915 - DNA, 472 bp, Homo sapiens
accccgcccccaccataggctaggtacgaggccgggtggcgcgacgttcctggccgaataaaaaactcttccttctttaatccggtgtccgaggagttttgtgtgcgactcgtcctgctacatttcttggttacaaaaacctcttccttctttaatccggtgtccgaggagtttgtctgcgactcgtcctgctacatttcttggttacaaaaacctcttccttctttaatccggtgtctgaggagtttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggag

SEQ ID NO: 555916 - DNA, 774 bp, Homo sapiens
  misc_feature (62)..(62): n is a, c, g, or t
  misc_feature (65)..(65): n is a, c, g, or t
ccgcttaataagatgagtttcataacccaatacacataataatgatcctgtgagcaaatatncgncactctcctatactgatgtatatatgagtttcacagtataaacagatgtagctttggtgttcgaccactctccatacacatgtacaaatagaccctaagttatagagggcggcatggactcgctcttgctgggcacaacactttagagaagctgtcagaattggcacgaggcctatgtgtgccagtgtcaaaaagtctagtacatataattatatacagtacataataattattattttagagagtattccttttccttatttaaaaaattcactgtcaaacagcctcaggcaggtctgtcaggaggtatccagcaaaaggcattgctctctaggagatgacagtgccacgtgttactgtccctgaagaccctgcagtggggcaggatgtagaggtggaagtcagtgacattgatgatcctgaccccgtgtaggcataggctgatgtgtgtgtttgcattttactttttagcgaaaaaaggttataaagtaaaaaataaaaataaaaaattttaaaaacagaaaaaagcttatagaatgaggatataaagaaaatattttatatagctgtacaatgtttgtgttttaagccaattgtctttttaagagaatcaaaaaggttttaaaaattaaaatgtttataaagtttaaaagtttgcagtaagctaacctactgaagaaaattttttaataaatgtagtgtagcctac

SEQ ID NO: 555917 - DNA, 272 bp, Homo sapiens
catgccctgcgggtgacttggccatcaggggatggttacagatgacgacaagccggagtgggcacaggaaaaaaaccagggtttctggtggaactgacctgatcctgcgggctgaaacggtatgacttagtcagatttcccatctgacatgccatgtcatgtgaaatgggtgacttagatccggcttaacttccatcagtcccaatcctctcctccctagcagtgagagtttagaggaagcccctcgaatgggacagtccttcctgccttca

SEQ ID NO: 555918 - DNA, 218 bp, Homo sapiens
tgaggatctgtctgcgctactactaccagagcgaggcgggtctcacacttggcagaggatgtatggctgcgacctggggcccgacgtgcgcctcctccgtgggtataaccagttagcctacgacggcaaggattacttcgccctgaacgaggacctgagctcctggaccgcggcggacaccgcggttcagatcacccagcgtagtagtaggcgggcag

SEQ ID NO: 555919 - DNA, 1243 bp, Homo sapiens
  misc_feature (391)..(391): n is a, c, g, or t
  misc_feature (528)..(528): n is a, c, g, or t
  misc_feature (697)..(697): n is a, c, g, or t
  misc_feature (736)..(736): n is a, c, g, or t
  misc_feature (772)..(772): n is a, c, g, or t
ccacggcgttcggctataggagaccgtccaggcattgtatccgctctagttcagtcgctgcccacataatcatcatagactcgactctcgaacgttagggcttgcatcggcttcctcagtttgcgctctctgcgggggtcgtgccctgaggtcccaacactcctcatctataagggctcccgcaaggcctctggcgaatcctagacaccgatctaacacgataaggtaagacctcagagctaatatggagttacatcacgagttagcaagcagaccaaggtcacacacgtgcatccgcacaccacctagcacttctgcctctcactaaccatgaaggtcattcctcgttttacatttcaagtctctttctcatgtgtggccctagccagantggttacaccacttccacttccagggcatgtaccctagagcatccaacccttcgaatgtgtaaccaaccactacatactcgagccaccacacatgaatgcgtaaagtcaaaagaccacgtcaaagcccaagtggctnggcgaatgcgcggcacgtatgagtggaagcaagagtgatcgcaagtgagttgaaagtgacgggcgtgtggcagggtgctttggggggtattttatataggggattgcctcatgaaggcactcaacttttcctactaggtcgagcgaagagagcaagcgatctcgtaagngcactctcccttgtgatgctccccccattccacgtaagnttaagttcactgcgaggaggaagcctcactccaggnctctgagggtgcagtttcaaactcactttggtgagagcgccatgggagccaggtcactgggcatgagaccgggcggttccacctaatgtgacagtcgccccggtgccctaatccttcacaatcggactcgctcactctgtcacattttggaaagatgcttgcctgatcgcgtaaagtgggcataatgccctcccaattttaaagcgaatccgcgtgcatgagccagcatataatccaatcccatgtggctccttataatatgcgtaacaccctcccataaacggtgcaacgtggaaacggcttaggaaaagggactgtttcgtgcggaccatttatacttaacgattggcccttggccgtttgattcggcgggacggggcattcccgttacagtggcattacttaacccttgtggaaacggaataatatcttgggttgacttttaaatcaaatgggcgtaccacaaagtgc

SEQ ID NO: 555920 - DNA, 166 bp, Homo sapiens
actttaacgagaatgctaatacaccagctgcccgtcttcacagattcaatgaacaatggtgaaaagacagtacagaaatgaggcgtctcagaatagaggtcaatgtggagctgaggacagctaagaaggatgaccagatgctgacgaggagaaatgtaagctcatt

SEQ ID NO: 555921 - DNA, 274 bp, Homo sapiens
agcgcaatgattcctgattatgatgtgtgtatggtgttatgttgggaggaagggtgtagaataagaaatagagggaaatttggaaatacaaaaggagaggaagaagaagaggcatccgtgctaggaagactgcatcagttcttagttaagatgatgtggctcctgagagtggcgatactacatgtgaagaaacctgaatcacagaaggaacagaccccagagcttgggaagaaaaaacgtggcagaggaaaagcccaagttaaagcaacaaatg

SEQ ID NO: 555922 - DNA, 143 bp, Homo sapiens
ggttcaacacagaatcaaaagattcgataccataaggaggtgctgcttcagtcaaggcagcaatggccaaagcactgatgggccgaactttctgctgctcatccacaagacctctagtcccaactactaaggaggctgagcag

SEQ ID NO: 555923 - DNA, 706 bp, Homo sapiens
gggtagaagcagagtctttagacccgacggttcaaggccagtggatgtgggtggggatgatccacaggagaaggtagttacctctgaataacgaggcatggacatacggcggttctgtgaacgatctggctagagtcatggaagtaccacactgtctgaatgagtcaccagagggtgtacaataggagtgcttgcagatggctctcacgactgtagcatggcgtggtagtctagaaagtgctctgataatagctctgaggcagcggaggttccaggttctccgctaacggatggtgcatgtctagatggaacccgttgcaggctttggtacggggaagatcatgagtcctattgataccacagacttcttatagaaaagagtgagagaaagaaaagatggttcaggagtagaggagaaggtcagggcgaaaggtggttccatagtcgaggaggagactaagctgtctgtagaagagtcggaggcagttggagatggggttgatagcaatggtaggccaggggagctagctgagaaaatcgacccttgaacgaacaaagggttcaaggaattaggcttggcgttaaattggacaggaaaggaacacaaagaagcagaagaaaggaaacgagatgagaaagaagggtgaaatgaaacctggaagtgctcaggaaggacggatgattaaagaaaacatgaataagacgc

SEQ ID NO: 555924 - DNA, 1019 bp, Homo sapiens
gtctttgaggtctttgaggttttttggaattcacttgctggagactacagctggcacaatccagcccagggcgccgccacgtccacacgacgggaaaggcaaagtacacaaaggaaaaagagaacaacggaacaggagagcggccaaactgagaaagaacacacaagcaaacggccacaggcaaaaacacaggccatcacaatgaacacaacagacacacaagcagaacacactaacaacagacaaacgaacacagacaacaaacgcacgccaaaaccacacagaacacaaggcccacaaaacaggaaccgaacaacgacaaaaaaacatgaaaaaaggaaaagataaaccacaaccaggacaaaaaacggaaaaacaagcaagacacaacacagaagcaaacacgacgaagaagaacagcaaatcaagagcgacacaaaagaaagaactgagaagtaggaaaagacgagcacaaacggacaggtgcgacaaacgagcacgcagaaaaagacaacgccgcaaggaacgaacagaacgagagcgcaaagaaaaagaggaagaagagcaagacgagaaacagaaccacaacaacagacaaaaaaaagaacacagaaaacaaagaaaagcacaacagaaagaaaaagagaaagaaacagggcgaagaacgacgaacgaacgcaacaagagcgaaacacacaccgaagaagacaaagagatgaggaagcaaagcaaagaagcgcgaacagagagaacaagaacagaaaagcgagaaagaaaccggagaacaaagagaacgaagcaacataaacactagaacacacagagaaaagaagccaacaacgagaacgagacaaacagagaaacaaaccagacgaagaagaacagtagaggagaagcgcagaaactacagcacgggaggcaagagaaagcacgacccgagcaccaaagagcagaaaggaaaaacgcaaaccacgacacccacaagcgagcagaagcgacacaaaaaagcaagaccacac

SEQ ID NO: 555925 - DNA, 808 bp, Homo sapiens
atctcgggaatggactcagaagtatgccagtgtgatgctaccttaaaagtcagaataacctgcattatacgctggaataagactttgaatgaactgttccttttttgattttcttatccggctgctcccctatcagacctcatcttgtttaatttctatattttgtttagctccctccattcattcacatgcgcatctgagaagactgttaagttcttccagcttggacaataactgctgtgtagaaactgtaaagtagttacgaagagaacagttgcccaagactcagaattttttaaataaaaaaatggagcatgtgtattatgtggccaatgtcttcactctaactggtaatgagaggtaaaaccattcctcagtgtctaacatgctgaagaaatcatctgagggggagggagatggatgctcaggtgtcacatcacaggatacatgcgttattctagcagcatccatgctgtgtacgccttccactgttagagattggaggttacatgatatggctgttatgctcataaactgatgtggctggagaatcggtaatgaatttattagcatcaggagaaccggaaaaatgtggaccgtattctagtgcctgtcactgagggactgacctgtgctggttctaccgagactggactgggaagtcaaaccccccttggtatcccaatagggtccaacatttggatctcataatgcaggggctggaggcacagaacaatttcaccccgctaacgcgcgaaatggggggggcacggggccacaaaaccgcgacgggattgccaaggggact

SEQ ID NO: 555926 - DNA, 709 bp, Homo sapiens
gctcgcgcagtgctccgccgcagtctcagctgcagctgcgagggactgagccgtgcacccggaggagaccccgtgaggaggcgacaaacttcgcagtgccgcagaacacaacgccagaccctgggtagcctgcagcatggaccagcctgttccatgccccgtgactggacagccctggatccatgagcccaggcatccatgcagcatttaggcagatgttctcggaaggagacagctcagaaggacctgcagcatatattcgcgatgcgcatcagcgggccgaccgcgcccactgcagggcgttgctcggcggcgccctcaacgatcccattgccacctccacgtaccttgctggacacacggacgagcccgcacgggctgtgcatgggactcatccgcggagtccaacgtgggcacatttccatgtcccgggtgcccagtggagggcacgagggtgctgttggcagccgggggcagtgcggcgttcaaagggttgacaccgaagggccactaagccggggaataccggcgcgtggccagctggcccgtggcggatacccccaagagcggtacggcaccaagccgaacggtccgtccccgtgggcaggctatacgccgaagcctaggagcacccacaaggacatccacgggtacatcgcatctcagatgacgaaacggtccaacgacaccggggccctcgaccgacaag

SEQ ID NO: 555927 - DNA, 203 bp, Homo sapiens
ggacagttattaaccccgaggaagctcacaccatcataccaggacttagcagacatttatctatcaacagtgagtataccacttaaatttcgtcatatttctcagaatggtatccttcagtcttttccacaatatacgtatatggaaattgctaatagcattcacattactattccataaacacccgaattctatcgtaaacc

SEQ ID NO: 555928 - DNA, 415 bp, Homo sapiens
  misc_feature (4)..(4): n is a, c, g, or t
  misc_feature (36)..(36): n is a, c, g, or t
  misc_feature (44)..(44): n is a, c, g, or t
  misc_feature (105)..(105): n is a, c, g, or t
  misc_feature (124)..(124): n is a, c, g, or t
  misc_feature (163)..(163): n is a, c, g, or t
  misc_feature (271)..(271): n is a, c, g, or t
acantgtcttccacagtggtggaactatttaccccncccatcancggtgtaaagcatccctatttttccacaacctctccaacatctgttgtccccggacttttnaatgatcgccattctaacnggcatgagatggtatcttaagactcagaggtgtccctcnccatggaaatctttagtgaaaggtgaaagatttatgtgatctgaagagaagccagagtataattttctactattttcaatacaaagatgtgttttcattacaattagnggaatataggcttctgtgagctagcctggaagcaaacataatcattattgttcattgtttctgtgagaaaatgtaatgctgtttctaaatattgacctaacaataaactctgaggaattcatgattgtaactggaaaaaaaaaa

SEQ ID NO: 555929 - DNA, 262 bp, Homo sapiens
caggagaatcgcttgaactcaggagacggaggttgcagtcagccgagatcacaccactgcactccagcctggccaacagagcaggactctgtctcacaaaaaaaaaaaaaaaaaatcttttcctccttaagtcaaccgggtgcttctagggatgactccaaataccttgactcattacgagcaatttaatttacctagtttattccaccaagaattaccggttcaagcaaggtgtccatggaagacaaggagccatgggccc

SEQ ID NO: 555930 - DNA, 589 bp, Homo sapiens
  misc_feature (40)..(40): n is a, c, g, or t
tttagtcgtctgatagtcttgggagatgccagcctatagngcgtttgtttgtttgtttgtttggggagaggagtctcactctgccgcccaagctggagtgcagtggtgccacctctgctcactgaaacctccacctcccgggttcaagcgattcttctgcctcaaattcccgagtagctgggactacaggtgcacgccaccacgcccagctaattttggtatttttagtagggacggggtttcaccatattggccaggctggtctcaaactcctgaactcgagatctgcccgcctcgacctcccaaagtgctgagattgcaggtgtgaaccaccgtgcctggccctctctttcttttctttgatttatttggctggatatttggtggagcctttttttttcttttttttggaaacactcccatcacctagcctggagtgcagtggtgggatctcggctcactggagcctcgattccctggactcaggttatccacctcagtctcccgagtagcagggactacaggtgcgtgccaccgtacccggctaatttttgggtatctttagtagagacggggtttggccatgttg

SEQ ID NO: 555931 - DNA, 254 bp, Homo sapiens
gacggggcagccgggcagagtggccagcgagaggcactcctcacaacccagatggggcggccgggcagagggctcctcacctcccagatggggcagccgggaagaggcactcctcacctcccagacattgggtggccaggcagaggcactcctcacctcccagatggggtggctgggcagaggggctccccacttcccagacaaggtggccgggcagaggcgttactcacctcccagatgatgggctcaaacaa

SEQ ID NO: 555932 - DNA, 804 bp, Homo sapiens
acccaggctggagtgcagtggtgcgatcgctcactgcaacctcagcctcctggatttaagtgattctcctgcctcagcctcccaagtagctgggattacaggtgtgcaccaccatgcccggctaatttttgtatttttagtggagacagggtttcaccatgtggccaggctggtctcgaactcctgacctcgtgatccgcctgcctcagcctcccaaagtgctgggattacaggtgtgagccaccacgcctggcccagtccaaaatatttaaagatgtttccttagtgtcttgaagttttgcacaaaattctttttttgagatggagtctcactctgtcacccaggctgagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactccctgacctcaggtgatcctcctgctcggctcccaaagtgctgggattaccggcatgagccaccgtgctcagcgcaaaattctttatggacttttcccttggccatgttatgtccgggagcctagtctgcccccaatactttgcccagattggctggtgtggtcattagcgccggtacattagccctggtcttgttgtaacctgtttctcaacaaggtggccttaccccaggggtctttttggcccccttttcgggctttcaagcgaggtccttctttta

SEQ ID NO: 555933 - DNA, 271 bp, Homo sapiens
gttatattcactgtccaggtgccagccccgcgtgggggctcacgcctgtaatcccagcattttgggaggctgaggtgggcggatcacctgaggtcagttcaggaccagcctgaaaccccgtctctactaaaaaatacaaaaattggccgggcgtggtggcgggcacttgtaatcccagccactcaggagactgagacaggcagcattgcttgcaacccaagaggcagaggttgcagtgagccaagatggcaccagtgcaatcccagctggg

SEQ ID NO: 555934 - DNA, 122 bp, Homo sapiens
cagtatccccgctcgggtagcctgtgactaacagtcaataaagtgattggcttagtgcgcgaaatattatgctttgttgtttgcatatatagagtcatgggtgcattcatatgctatcgcat

SEQ ID NO: 555935 - DNA, 225 bp, Homo sapiens
attcttaccgtctatgtgaggtcacctggaggcctgcactagcagagaataggtcggaccgaaacgccgtctgcccgggaactcccagaagtctggccttctggctagcagctatgcggcagagcggagccccgcgagagcccagaggctcccgcctgcagaccgaaacgacaaagttgccagggcaaccatctcatgctgagatcgcggaggtaacgcctcgcg

SEQ ID NO: 555936 - DNA, 537 bp, Homo sapiens
ctgacaagcagaaagctaactttgatttgataaacagctcttcatatgccacaaaaccgaaactattttacagtgctgagaggtccagataggtccaaacatgatgattcttaaatgagtgctttggttaaataggctttgacttggtttttggcattacttgtataattatatcattccaacgagtcactacaggtaatccattcaaaacatgacttgcttaaaactattacaaagcacttaaccttggccttgcctggaaatacccttaaaaagctggccaatagcaacaaaatgttcctttcctttcatttaggcaaaagaaattacatgggttcccaaaattaaaaattcatttttttacatggttaaaaaaacaaaagtttgccataaaccccttaaaaaaaaaaacaagtttctaataaatatctggccctggggaaaaaggcgcctttattaaaaacactggaccctggggaaaactctttccaatgggcttgggaaggcctatgaactttatgaatctattttttggaa

SEQ ID NO: 555937 - DNA, 235 bp, Homo sapiens
tacaggagctaagaggcacaaggaggggcatgatattgtatgcactgaacctccacctcctgggttcaagtgattctcgtgcctcagcctcccgagtagctgggacgtatgggcgtgcaccaccacacctggctaatttttgtatttagtagacgatggagtttcatcactgttgcccaggctgctctcgaactcctgagctcaagcaatctacccacctccttggtgcctctgg

SEQ ID NO: 555938 - DNA, 809 bp, Homo sapiens
agcggagtcagtgattttggggcagagaattttgcaacacgtggtagtgaactgtgagtgagtttgaggggtctgaacactgaaagagtcgaatgcgtttgtgtggcagggtgtcctggtggatatggtttctgtcaaggttccagattctcataaatcgtgtgagcgtcgccgacgacctctgcagatcagacaggggccctttcgactagcctctgctgaaaggacctagaaagaatcccttaggatgaagctgagtcttaccaaggtagttacatggctgtcgcctagggagaaacatagataacctgggcaaaacaggggaccactaccaatggatattccaggctgccttctgtataccaagactggctccgacccaaagctcaaccatcacacgctgcgataatatccacggggttccctgccatggcttcagcgttacagctgtgcatcccgtagcagatcatcatgacggtctatgacagaatatcaagaaaggcagtaggacaagtttataggcattgccagaatcagatcttgtactgcatccctggcacgaatcgcagatcaagcactctggcacgagctggttaatgtaacctacgaagacgtcctgagtcctggtgatgagacgtgggttggcaaagggacgaagattgggaacctggacctggtgttcccaaaggtatcaactggccacactaccaagaacgggaccatttcataacccagaaatggtatcccagatgcatactccggatgggcagaaagtacatcggtacgggccgacgaacgaatcacataaa

SEQ ID NO: 555939 - DNA, 845 bp, Homo sapiens
  misc_feature (23)..(23): n is a, c, g, or t
  misc_feature (114)..(114): n is a, c, g, or t
  misc_feature (132)..(132): n is a, c, g, or t
  misc_feature (139)..(140): n is a, c, g, or t
  misc_feature (142)..(143): n is a, c, g, or t
  misc_feature (146)..(146): n is a, c, g, or t
  misc_feature (152)..(152): n is a, c, g, or t
  misc_feature (180)..(180): n is a, c, g, or t
  misc_feature (193)..(193): n is a, c, g, or t
  misc_feature (195)..(195): n is a, c, g, or t
  misc_feature (205)..(205): n is a, c, g, or t
  misc_feature (220)..(220): n is a, c, g, or t
  misc_feature (232)..(232): n is a, c, g, or t
  misc_feature (245)..(245): n is a, c, g, or t
  misc_feature (247)..(247): n is a, c, g, or t
  misc_feature (276)..(276): n is a, c, g, or t
  misc_feature (285)..(285): n is a, c, g, or t
  misc_feature (289)..(289): n is a, c, g, or t
  misc_feature (293)..(293): n is a, c, g, or t
  misc_feature (300)..(300): n is a, c, g, or t
  misc_feature (304)..(305): n is a, c, g, or t
  misc_feature (318)..(318): n is a, c, g, or t
  misc_feature (349)..(349): n is a, c, g, or t
  misc_feature (353)..(353): n is a, c, g, or t
  misc_feature (362)..(362): n is a, c, g, or t
  misc_feature (368)..(368): n is a, c, g, or t
  misc_feature (374)..(374): n is a, c, g, or t
  misc_feature (388)..(388): n is a, c, g, or t
  misc_feature (393)..(393): n is a, c, g, or t
  misc_feature (415)..(415): n is a, c, g, or t
  misc_feature (418)..(418): n is a, c, g, or t
  misc_feature (427)..(427): n is a, c, g, or t
  misc_feature (429)..(429): n is a, c, g, or t
  misc_feature (432)..(432): n is a, c, g, or t
  misc_feature (435)..(435): n is a, c, g, or t
  misc_feature (438)..(441): n is a, c, g, or t
  misc_feature (453)..(453): n is a, c, g, or t
  misc_feature (456)..(456): n is a, c, g, or t
  misc_feature (467)..(467): n is a, c, g, or t
  misc_feature (473)..(473): n is a, c, g, or t
  misc_feature (478)..(478): n is a, c, g, or t
  misc_feature (561)..(561): n is a, c, g, or t
  misc_feature (576)..(576): n is a, c, g, or t
  misc_feature (610)..(611): n is a, c, g, or t
  misc_feature (702)..(702): n is a, c, g, or t
  misc_feature (725)..(725): n is a, c, g, or t
  misc_feature (730)..(730): n is a, c, g, or t
  misc_feature (742)..(743): n is a, c, g, or t
  misc_feature (749)..(749): n is a, c, g, or t
  misc_feature (754)..(754): n is a, c, g, or t
  misc_feature (763)..(763): n is a, c, g, or t
  misc_feature (768)..(768): n is a, c, g, or t
  misc_feature (772)..(772): n is a, c, g, or t
  misc_feature (774)..(774): n is a, c, g, or t
  misc_feature (777)..(777): n is a, c, g, or t
  misc_feature (781)..(781): n is a, c, g, or t
  misc_feature (832)..(832): n is a, c, g, or t
gttttgcttgggtatataatgangttgagctatcccatctttcttctctatggaatatagtcacacaaacaaaaaagatgaatctcacccggggggggtctttatcagaaatangccccaatctggttaggnaataganngnnaancatttnctcctcctaggcctaagattcttcatgnaaaaattataagncngaataaagancacttctaagtttcnataattcagggngaaatatcaattnanacatcaggagggaggcgggcggcggggcnatcctttcnggcncccngaggctnggcnnggccacatggctngcttagcgcacgtatggcacatgcctctctncggncgcccccgnggggtntttccnctctttctctctcngcgangacactcacaatgtcccaaaangcntcccttccntngcnttnggnnnnggggggcgcggncgnagagcggtgtnacggcnaatcnacggcgggcatcccccaccaggaaatacatctttgttgttgtcactacagcataaactaatgaaagctaattaaatataagantttgctaataattgnggatccgtacacaattaaacttaaaaccaaaaanntctaatagaaaactcataatttaaaatgtgacataagggggaataagttaaaaagcaacttttaaaaattacaaaaatagtatttgtagtnaaataaatggacttaaacatgtnatagnatttttcctgtnntttttnttttntttctttgnttgantatncnagnaagnttcaacattttttcaggattgttcttcatcattaagatattccaggttatntttccccattata

SEQ ID NO: 555940 - DNA, 1115 bp, Homo sapiens
ctcgcatggagactcctccatctctgtcttccctgttgtgacagtctcagagcctacgttctttcaatggctgggctacaagatggtgacaggctgcccaacctggtttgcaacgccacctcagtaagctgagacgtggtaatcgccatggcaacggggctgcattaaaagcattgtgcgcacaaagtgaaaggctgctgcctggcagagttcagtctggtctcactgcacctgttccctaattaagatgcaccttttggttttgtcttttgaaaaaaacaaaatgctccctttatcgccacgaggcaaaagacaaattaaggccaagatcctttcatgcccaatatgggcctgcccggtggttggacgcatgggggatcatggcgcagcaacgtgagaaagtgcacagtgatttgctgctgttacatcctgagaaactggaccggctgtcactcaacagtcctcgcaatacctggcagagtggcgtgtggcgactggctctacgtcccgcacacatgccgctcctgatactcacaacgaacgcaacagactgcactgctttcccagccacagagcctacctggcacactctaacgcctaaccatagaaccttctgccatcaacaggccacaaaacccactacttccctgctctatgcaggcttctgaccttggttcccctagaatcctccctccttatcagtatctgcgtctaggcctcgggggacacccacaccgccgctctgtccttcgtctgccctcaccacgaccgcgcttctcactgcccgccgcacccactacgctccatgtgcccgtcactcagccatgctcaacactgcaatccccatcggcaccaccctcagccgcgacacccacccacccgcacaccgcaacacaaacccccacaaccgcaaccacccaccacacgaccacaacccccacacacaccaccaccaccccgcatcgcacaacatcccatccacacccacacaccacccaccgcacctgcaccacaacacccacaacaccacatccagcaccaccaagacccacccccacaccgaccaccccatccgcacagacccccccgccacacacaccacccacccgccgccc

SEQ ID NO: 555941 - DNA, 226 bp, Homo sapiens
agctgagtatctgttttgtgtcaggattatcattattacaggtttctcatttattgcatagaggtgttatagtattctctgatggtagtctgtacttctgcgggataggggtgatatcccctatatcttttttttttttttttttttttttttttttttttttttttgaaaaaaaatttgtggttttgcccccagggggggggagacggggggggggacccctcaa

SEQ ID NO: 555942 - DNA, 140 bp, Homo sapiens
agataccatagtcgcaagcctcatcaaaatatatagtaatcccacagttgtcccacattctgttccaactttacaaggaaaggaagaaataactggtggttatgtatcactgtctatatactcataaaataagtgaataa

SEQ ID NO: 555943 - DNA, 231 bp, Homo sapiens
ctgagagacggtgaaatggagcgtctgtgggcactggtccatgtcactcctccagccaagtgtttttgttgttgttagtttgtgttagcgaccgactctctgtcacccaagctggagtgcagtggcacaatctcggctcactgcaacctccgcctcccaggttcaagcgattctcctgtctcagcctcccaagtagctgggattacaggcatccaccaccacgcacagcta

SEQ ID NO: 555944 - DNA, 650 bp, Homo sapiens
catcctggaactacgctccctgcaaacccacagcagcgctgcggtgaccctgaacgccaccccagccccaaacacacacgtgaagctcagcaaagcgtgccacctgccggggtcccagcaaacacgcccggagggaagaaccggcggaaagcactttgtttaaaacagaaaaaaaagtaaactctcccggggcccagcctagccctcgggttctcctccttcccgagctgaatggaggaaggcgccgcgcggggcgggtcagggcggggagccgagcgcgctgggcgctgggtgcgcctcggccggcccgggcgcgacccacgggccaactactccccggggccggcgggaacagggcgcgccctcgcctcaactcgcgcgcaggccggcgccccggtgggggtgggaagagtccgggaactcacagccgcttgtcctcgggctgcagttgccagtgcatggccagcgagaagccgaagaggctcccggggtctccatatttccggatcacgttgtcctcccgagtgtccaagttgaaggctgcgccgagccgggacaggagccccgccgacaggtagagcaagcacagctgcccggcggcggccatgggcggacgcacggggaggggagcggggacctgcagcggccgc

SEQ ID NO: 555945 - DNA, 294 bp, Homo sapiens
  misc_feature (5)..(5): n is a, c, g, or t
  misc_feature (32)..(32): n is a, c, g, or t
  misc_feature (38)..(38): n is a, c, g, or t
gtaanccctcccgttctgttggctctctgcantggaancgcttactgccgcggggcccccacgagcaacagccgcttgtcctcgggctgcagttgccagtgcatggccagcgagaagccgaagaggctcccggggtctccatatttccggatcacgttgtcctcccgagtgtccaagttgaaggctgcgccgagccgggacaggagccccgccgacaggtagagcaagcacagctgcccggcggcggccatgggcggacgcacggggaggggagcggggacctgcagcggccgc

SEQ ID NO: 555946 - DNA, 303 bp, Homo sapiens
gagatccccgactacatacttccggacgaagcctcgttttttatcaggcccaaaaccgaacagttggtccagcctatggtcggcgcagcaagaacagatatggcgtgaagagacggccaagcagcaccagcgtgcctttgggtgataaggggagagaaaattgtgaccctgtgagaccctgctcctgactcttgatgttcacccttataactctctggtcccagtagctagccagtttgtcacagctgttatgtcagcttaatttggtttgctctgtctgaaggatgaagaagcgcctggaat

SEQ ID NO: 555947 - DNA, 378 bp, Homo sapiens
catcctggaactacgctccctgcaaacccacagcagcgctgcggtgaccctgaacgccaccccagccccaaacacacacgtgaagctcagcaaagcgtgccacctgccggggtcccagcaaacacgcccggagggaagaaccggcggaaagcactttgtttaaaacagaaaaaaaattgccagtgcatggccagcgagaagccgaagaggctcccggggtctccatatttccggatcacgttgtcctcccgagtgtccaagttgaaggctgcgccgagccgggacaggagccccgccgacaggtagagcaagcacagctgcccggcggcggccatgggcggacgcacggggaggggagcggggacctgcagcggccgc

SEQ ID NO: 555948 - DNA, 1273 bp, Homo sapiens
  misc_feature (671)..(671): n is a, c, g, or t
agcggggtggctgggcgtgagcgagagctcggcgggcggctggctgctcgtgtggcggtggcgcggctggttccggcccagccatgtgcggacgaggccccgcggaagggcagcttctcggctgctcgtgtgtgcctgcaccaacggcctcatccatatgccctgctggcccttggccgctcgtgcccggcccaatgcctggtggggcgcttgtgtgcggcgtccaatgaatgctggtcatcaatgaacttcctgagacatgacctcgtgcttgccctgacaatcttaccatctgcatgggaaccacgttaggccggaaaggcttgcctactgagtgccggttgcggtgcctgttgccaagcacgccagcaatctcttccgactccatgtggttaacgagaaacgcattccagaagtgggaaggccttcattaagcaccagagaggctgttgtttgctgacaagaagttcataccgttggatcttcctatactaccaagagtaatggatcatatacgccccgcaatgatattggcctttcgttaacgcaaaatgggcagagaccttttcgcccgtgtttctataggcggccccattgtggtttcggacagactagacaccccacaagagggggtttcatccgaatggtggcccaacacatatgggcgaatnttcccccgttattttctcctctgggttatgcttcacacgcaacgcggaaacaagcggcaaacatttccgagccgtgttcaaggagacgttaacgcgtatgtagggtttatccttgtctatggtttcatctgtgtgatcagcgttccagttggtacacagcgcgaaacgttcgtagagcacaagcccaccgagtgttttagccgcgagctgggtcgaccaacagcgagggcaaacgccaccagaactccgtttggtcccctacgagagcagacccaagcaccatcgttttgggaacactttccccaacctttggacaaaggtttcccgaaagcggcaacagagggggccgcacatttttccctttttttcccccatttggtgagttcttccccgcttactcaggccgagcaaccaccacagtgggcaaagacgccgcacccgatttataaaatgtttgggttttagggccgctgttggcgcaccaggggagcacagacgacagtttaccgccaagacacctgcgccccttcttatggtcccacaccatatttccccccaaagagtttcctatttatggggtcgagagggaaaaattttttcgg

SEQ ID NO: 555949 - DNA, 246 bp, Homo sapiens
  misc_feature (46)..(46): n is a, c, g, or t
  misc_feature (224)..(224): n is a, c, g, or t
tgatccatgaaataactgataagctcaacttcgttaaaattaaaanattctgctctgtgaaagcgcttaccaagagaatgaaaagacaagccacagactgggaagaaatatctgcaaaatatctaatgaaagactggtagccaaaatatataaaaaactttaacaggaaaacaaacaacccacttaaaatgggccaaagacctttatagacacttcactaaagnagatatacagatggcaatcaag

SEQ ID NO: 555950 - DNA, 264 bp, Homo sapiens
cttcgctcgccccactagagaacactcaccaagacctcaacccctgacccccatgcctcagggtactcaggaaaaaaaaaagaagaaatagagaacaatgatcaaaaaaaagaaaaaaaaaataaaaaaaaaaaaaaaaaggggggggtttttttgggggcgcgcgggggggggctcatttggggggtggggggtttttttcccggggagaggggttaaccccgggggggggttccccgggggggtttttttgaaaaaaaaaat

SEQ ID NO: 555951 - DNA, 391 bp, Homo sapiens
gacaatggaagggcagaccagtggatggaccagcatggcgtgagctaagaagcagcagctgggccttgttcttggacggtctcaagggatgacatagggaggagactgcaaaactgatgagaaaatattaggctcgactctatattcttcaggcaaggcccgaggggatccactcaccaaacaaatttctgataaccaatactgcttcaagaactgggtcctgggagatggtatcgtcatggcgtacgataacgtcctgcagaaactcctggaggaatatgggagtgatgacacaaggaatgtgaaagaaaccacagagtacttaaaaacatcatggatcaatctcaaacaaagtattgctgacagacagaacgccttggaagcttcagtg

SEQ ID NO: 555952 - DNA, 135 bp, Homo sapiens
tctgtgtatcctccctattgcttttctacagcatgtagtcagcatgcgtctcaggtcccaagctccctcactgccaccggagactgtgtggcccccacgtctccccatctacctactacccttaacctgtattct

SEQ ID NO: 555953 - DNA, 133 bp, Homo sapiens
cgaaatgtaagaatgtcctgaccattgatttaatgaccagcacattttaatatgctgacagcaagaatctttatgacaagtctccaaataggttgactgtaacccaaatacagagtgttgccaaatctgtctc

SEQ ID NO: 555954 - DNA, 563 bp, Homo sapiens
gtatgcaagaacaccaggcaggccatgtcggatgacacagtgactggctgtctgctgcacactgcacgaagtgattaccaatgaacatggagaacgccaaggccttacgggatgccggtggcattcgagaagttggtcggaatctccaaaagcagaggagataaacactctccaaaagtggtcaaaggctgcatctcaggtcctcaacagcatgtgacagtacccgagatctgaggagtctctacaaaaaggatgcatggtcacaataccactttgtagcctcgtattcaaccatcgagagggaccggcaaaggccctactcctcctcccgaacgccctccatctcccctgtgcgcgtgtctcccaacaaccgctcagcaagtgccccagcttcacctcggcaacatgatcagcctcaaagaactggaaaacagactacgagtgcaccggcagcaaagccaacctaccatggagctaaaaggcgaacacacttccaggacagatgccatgacagctcaacaacactggaatttcaacttgtctaggaactcttatggtgcgcc

SEQ ID NO: 555955 - DNA, 447 bp, Homo sapiens
caggcggaaagcttggtggccaagcagtctgtgtgcttccccgctgatggagaacgttgcgttgttcacaatagggcctcatgggtgtaaccgcatggcaaacccatggctggggcagctgcctgttgccgtctgttttcagtaactgctgctctgttaactgttctattttgaaactacgggtgttgttttttacaacaggtatgtttttgtttcaaaaaaaaggattgcttttctcaaattttttgcaaattgtattgtcaacatgggtcatttaaagtcccggataaaaccaaaacctgctgtgggacctttgtacaagtttgattctgtattttttattccagtgtggcaaatgtgcccctctgtattttttgaaaagtgcggaaaaggttgcttttaccccctgtttttaatgtaacagtaaaagttttcacatttttttca

SEQ ID NO: 555956 - DNA, 262 bp, Homo sapiens
atcccagcactatgggaggctgaggctgagaggatcacttgagcccagcaaggttgagaccagcctgggcaacatagtgagaccccatctctacaaaaagttttaaaaccaggtatggtggtgccctcctgtggtcccagctactcgggagctctgaggtgggaggatcacctgagcccaggagactgaggctgcagtggggtgtgacttgcactattgctctctagcctggacaaacagagtgagacccttatctcaaaac

SEQ ID NO: 555957 - DNA, 200 bp, Homo sapiens
ccacagatgtgcctgaccagtgtcctgctgtgtgacctgctgtgtgtctgaccctgacaagggacgtgcagtggctggggcgagaacgacctgtggcgtctcttttacctattggagccgatgatggtggccaatgttcctccacaatgcacgaccttggacctcaatctgcctgagcacaccatggtggtacgaagagg

SEQ ID NO: 555958 - DNA, 476 bp, Homo sapiens
  misc_feature (103)..(103): n is a, c, g, or t
  misc_feature (145)..(145): n is a, c, g, or t
  misc_feature (175)..(175): n is a, c, g, or t
  misc_feature (184)..(184): n is a, c, g, or t
  misc_feature (239)..(239): n is a, c, g, or t
  misc_feature (301)..(301): n is a, c, g, or t
  misc_feature (333)..(333): n is a, c, g, or t
  misc_feature (351)..(351): n is a, c, g, or t
  misc_feature (420)..(420): n is a, c, g, or t
  misc_feature (450)..(450): n is a, c, g, or t
  misc_feature (457)..(457): n is a, c, g, or t
  misc_feature (476)..(476): n is a, c, g, or t
tgttgaaagaggaacgttctctcaaatatagtatctaaattaatcctttcacggccattgaaaggattcagccatttctaggaccattctcattttctagatnaggaagcacggattcagagaagcaaatgacctattcactatnaaaataataaaacacaggtcttttgacttnaaattctgntttaagttatctcttttttttctatatagctattataattaccacaagaattacngaaattctgtaagtcccccagtataaaagatgaggaaatgtcttatatcaatttagtactgngaaaggtttaagctttagagcccaatggatgnttttaattaatgaatgancttttccaatggtttagtctggtcttaccctgctattaaaggatatccccagactgggtacttataganggaggttaccgacttacagttccccatggntgggganggcttaccaatcatgggcn

SEQ ID NO: 555959 - DNA, 1985 bp, Homo sapiens
  misc_feature (283)..(283): n is a, c, g, or t
  misc_feature (298)..(298): n is a, c, g, or t
  misc_feature (301)..(302): n is a, c, g, or t
  misc_feature (353)..(353): n is a, c, g, or t
  misc_feature (573)..(573): n is a, c, g, or t
  misc_feature (586)..(586): n is a, c, g, or t
  misc_feature (607)..(607): n is a, c, g, or t
  misc_feature (717)..(717): n is a, c, g, or t
  misc_feature (761)..(761): n is a, c, g, or t
  misc_feature (867)..(867): n is a, c, g, or t
  misc_feature (973)..(973): n is a, c, g, or t
ggccgattctaatagtttgccaagctctgccgagtctggctggcactacagcggtcctgaaggctgtgtgctatcggtcgtgctgccaggagcatggtggtcagccgcgtataggatgagccgcattggcacaagtgagggtgagggagacccactgactggatcgttgtgcgtgatcaggcggactgtcctagcaagcgttcatgcacagctggcgaatggacgggagagagatgctgtcaaactgtctccatggataatctgaagagactgtgttcctggnagtgcaggttcaaantgnngaaggcaagtgtgaggtgacggaagtgagtaagcttgatggagaggcatcnattaacaatcgcaaagggaaacttatcttcttttatgaatggagcgtcaaactaaactggacaggtacttctaagtcaggagtacagtacaaaggacatgtggagatccccaatttgtctgatgaaaacagcgtggcatgaagtggagattagtgtgagccttgccaaagatgagcctgacacaaatctcgtggccttaatgaaggaagaaggggtgaancttctaagagaangcaatgcgtgaatgtacatcnagcaccctcatagacatgcagacggttcatcctcatgtggacatgtattctattaaccgtacacattgaagtgagacgatggtcaggtaggatcaccatgtatgtgtggncagacgcgaggtgatctgagagaagcttgacgtgaggctgcaantggcctaaaagtccctggaatccctatcagataaacctccagggtccatagagcacctgattgagaagatcacatatactgcgccacatctatggtgagtattccncttgctgtacacgtgaacagcctgtgtccctgatcggatcagccaagaaaggaggtcttctactagaagttgcttttagcacaaaccacatagtagcctgagttgnccagagggcacctgtataggcccaatgggctacgcgtggcagaacatatacggaacggcatgatcacgaatggatggggaaaaggagttacccagacaattggctatgaatggtcagaacggtctactgagggagaattgtaacttgaattcgtggggtcccctttgaggaaaacaatgatttgctcgacgtcgatagagttgcgacggagctgtttagaagatctccttttggggcccaacgaagtgcggacacccgtcttggccccgatcaactccacgcaatgtggaaccccttatcaagttccgaacaacagcaaacccggggaccacgacctgtgcattcttggttgtctactgggcaacgggtgccggaaagggcctaatcccccttgggatgcccttgaaggggaaacgaacaggcgaggagcaccggaaccaggggggcttgggcaaaggcaggtggttacctaaacctttgtgggaacgcgtgccgtttgaataagcaagcacccttcttgggccttaattggggcgccacacgccggtgcatcttataagggggcccgagcaggggccagggcgggacgtccccagaccttgtcttgggaacacctttccagctcccaaagcttcctcttccctggaagcgtggcggccctggccgcacctcaccacgggaacattgtcacattcggtgccccaaaccatgccgtaaccctgtgggtgagcccccaggagggccccccttacccttgtcgaccatatataccagcgtgggcgctctgctcgcacaggtcaccccggacgcgcgcgccgccaacaacgcggcagcaacctcctgcaacggcgcgcacatgtcgcacaaaaccccatgtcagcgacagaacaccaacacacccgccgaccccaactctgcgcgcgcaacgcgctgacacagcaccgacataaccagcccgtgacgaccctctaaagcgagatcacaccgctgccgccctattgacattaacgcg

SEQ ID NO: 555960 - DNA, 244 bp, Homo sapiens
actaagagaatcccatagcttgtagtaatgctctgaccagcgagatgccattctcttagtgatggcggcgtagggtttgagagaagggatttggtccactttcagtggagaagggtgcagtccagacagcttgactgcttttaaatgaccaaagatgacctgtggtaagcaaccctgggcatcttaggaaagcaggtcctgtgagaagtgcatgttccccagaaggggtctctggagggacaaa

SEQ ID NO: 555961 - DNA, 1966 bp, Homo sapiens
  misc_feature (264)..(264): n is a, c, g, or t
  misc_feature (279)..(279): n is a, c, g, or t
  misc_feature (282)..(283): n is a, c, g, or t
  misc_feature (334)..(334): n is a, c, g, or t
  misc_feature (554)..(554): n is a, c, g, or t
  misc_feature (567)..(567): n is a, c, g, or t
  misc_feature (588)..(588): n is a, c, g, or t
  misc_feature (698)..(698): n is a, c, g, or t
  misc_feature (742)..(742): n is a, c, g, or t
  misc_feature (848)..(848): n is a, c, g, or t
  misc_feature (954)..(954): n is a, c, g, or t
cacgagataaggcgtccgttatcatcgggctgcttatttaataccttgcgtcgctacatacacaagcgctgcgccgctgcacctaagcgtcgagaggctatggctacggtgctccggagctgtagcgcggataggagagcgatggcaagtggggtgaagggagacccacgctgatcggtggagagcggcggacgccaccaagtcagaattgtcactggcgcagaaaactcaatggtccaggataatagaaacactgttcctggnagtgcaggttcaaantgnngaaggcaagtgtgaggtgacggaagtgagtaagcttgatggagaggcatcnattaacaatcgcaaagggaaacttatcttcttttatgaatggagcgtcaaactaaactggacaggtacttctaagtcaggagtacagtacaaaggacatgtggagatccccaatttgtctgatgaaaacagcgtggcatgaagtggagattagtgtgagccttgccaaagatgagcctgacacaaatctcgtggccttaatgaaggaagaaggggtgaancttctaagagaangcaatgcgtgaatgtacatcnagcaccctcatagacatgcagacggttcatcctcatgtggacatgtattctattaaccgtacacattgaagtgagacgatggtcaggtaggatcaccatgtatgtgtggncagacgcgaggtgatctgagagaagcttgacgtgaggctgcaantggcctaaaagtccctggaatccctatcagataaacctccagggtccatagagcacctgattgagaagatcacatatactgcgccacatctatggtgagtattccncttgctgtacacgtgaacagcctgtgtccctgatcggatcagccaagaaaggaggtcttctactagaagttgcttttagcacaaaccacatagtagcctgagttgnccagagggcacctgtataggcccaatgggctacgcgtggcagaacatatacggaacggcatgatcacgaatggatggggaaaaggagttacccagacaattggctatgaatggtcagaacggtctactgagggagaattgtaacttgaattcgtggggtcccctttgaggaaaacaatgatttgctcgacgtcgatagagttgcgacggagctgtttagaagatctccttttggggcccaacgaagtgcggacacccgtcttggccccgatcaactccacgcaatgtggaaccccttatcaagttccgaacaacagcaaacccggggaccacgacctgtgcattcttggttgtctactgggcaacgggtgccggaaagggcctaatcccccttgggatgcccttgaaggggaaacgaacaggcgaggagcaccggaaccaggggggcttgggcaaaggcaggtggttacctaaacctttgtgggaacgcgtgccgtttgaataagcaagcacccttcttgggccttaattggggcgccacacgccggtgcatcttataagggggcccgagcaggggccagggcgggacgtccccagaccttgtcttgggaacacctttccagctcccaaagcttcctcttccctggaagcgtggcggccctggccgcacctcaccacgggaacattgtcacattcggtgccccaaaccatgccgtaaccctgtgggtgagcccccaggagggccccccttacccttgtcgaccatatataccagcgtgggcgctctgctcgcacaggtcaccccggacgcgcgcgccgccaacaacgcggcagcaacctcctgcaacggcgcgcacatgtcgcacaaaaccccatgtcagcgacagaacaccaacacacccgccgaccccaactctgcgcgcgcaacgcgctgacacagcaccgacataaccagcccgtgacgaccctctaaagcgagatcacaccgctgccgccctattgacattaacgcg

SEQ ID NO: 555962 - DNA, 834 bp, Homo sapiens
gcagaacaagcccgacagttggctatgatgcttagagcacgaatcacttcagccgttacacacgctttctctccatgcgttggcgtttaagttcttgatcgtgcaaggcaccgacgttaacatcaccagctattagatagaagaacgcgaagcaacgtgttgagctgaagttcaggaacgcagtgagcgctgtatgcggacaacgttgaaccgagttctcgcgagatcacatagtacctgtcgatgtctggttccgttgctgctgggactactgatgcagccgtgtcaggcttaaatcgtgtgctgacctattcatgttgatttgtgaacactatcggttgacacttttcctctaacgtaatcatgctcggaaccttgaatagcagcctagggtatgatgcaagcataggcggacgtacctccgtggaatgccataagtcagattaccacgctgcaaccggagatgcagcacttacttaggagaatcgcctttcctgaaagccaagttggcttgctgctgaaacgcgtgcggacaaggtctgcctagacgccacgtgttcgactagagtctgagctaagcaaccatgcggactcgagtaatttccagcggttcatccttgtcccgtccgagaaacttggtcagacacataagggagtaaaccttaggaagccttgtgaaagttattcaaaggtttcataaacccggctccccgtgctatttggatcgggaaatgtgacatgcctgtttgcaattcaaccctttgaatctggcgccttttgtcgacgggtgcaggaccgtccaggatagtccttgattgtcccaaacaggattcg

SEQ ID NO: 555963 - DNA, 341 bp, Homo sapiens
gtaagccccccgtgaccagcgcccttctcaagtcagggttcctgctacattgcacagttacgcggtggcccgtgaggagtaacacctggcacccaaacaggtcaccacagtccacacctagtccacctgccctccctgcttacaatcagttcttcctccagagctcaagtgatccacctgccttggcctcccagaacgctgcgatcacaggtgtgagccactgtgccgagccctacgttaattgtggaaaagtatggtcatctcagtctgactagcctcctgaagagttgtactagccagccttatttccaactgaagcattgggtttgccgtctggagca

SEQ ID NO: 555964 - DNA, 1007 bp, Homo sapiens
gcatgccgtgcgtatcccgtggatctgtgtcaagtctggattcgatgctcggcgagtggagattcgtttggtcctcgcgtacatgacagacgctgcacaattaagggatgtcagtccctactatatctgattccaaaaattctcacgcgtacaagttttgaccttttgaggccaggagtctctaggcgagacttggcatggtaggcaattaatttagcacgcatcgtcacagttattccatatagtaggctcaaagcatacagcgtaagtgttctgctatgtctgtctagatttgaacatatattcatagagatctgataccttttcttgctgtgcaatacgcggagagtataataaatccaataaacgcattgtatgtgttggctgccatcgtattggagtattgtacatggttcctttcatggaagtgacacacagtgatacttaattgcggacttgctaatactatttaagcttgaagatatgtactgactgggctctactaggaccctacggcgtctataattttctccacaaatactgctgttgaaccggtcttgatcaacttgaacctgcctgactcaagtgataggacgcaggtgtctaagatagcataaccagtcttaatgtttgggtcgaaaggcgatattgacttttttccaagccacggactttgggtaatctcaccatgcacgaagtgttcttgccttgtgacgcttcgggaaaccggctgggcaggaggagtgtttacagaataagagcaaatttgtaggtggtacccggtattgatgaattcacttgtggagtattgcaccttcataaatatcattggcgtcgcatgggtaggtacgcaatcctgaaggaaacgtggtaaggcgggaaatatagttgggggacgtgaaaggccacaagggtgcctagatatccattgaccaaacaaaaatcgtacgtagcacaagaaaaggtatcacaaatttacagacaacacttttatactgggtgaaaac

SEQ ID NO: 555965 - DNA, 135 bp, Homo sapiens
acacttcaggtcaggtaactggagaacagtcatcaaatcagtcgctacccaccagcatttccttccttccttctttccttccctccttcctttccttccttccttccttccttccttccttctttctctttcttt

SEQ ID NO: 555966 - DNA, 504 bp, Homo sapiens
ttatgtcggacccaccatctgtaaactacacacacacgcgcgtggcacacacacacacatctgttagatcctgttagttaagggctgtgagttctgtattttggctgaatttctggtctagttttttagtcagttattgagagaggggtattaaagtcttcagctataaatgtgggttggtctctttctccttttagtcctatcagatggggggtcacttattttgcagctctgttcttgggtgtatacacatttcagattgctgtatcttctcagtagattgaccctcttaccatgatggaatgtccctctttgtctccagtaattttctttgctctgaagttacttcatctcatattaatataagccattcctacttacatttgattaatgtttacatgatgcattttttcctccctttacttcaacttgtctatatcacatttgaagtgagtttcttgtggataagcatataggtgggtcaagggtgcgtcagaacataag

SEQ ID NO: 555967 - DNA, 219 bp, Homo sapiens
  misc_feature (4)..(4): n is a, c, g, or t
  misc_feature (12)..(12): n is a, c, g, or t
  misc_feature (15)..(15): n is a, c, g, or t
  misc_feature (35)..(35): n is a, c, g, or t
  misc_feature (39)..(39): n is a, c, g, or t
  misc_feature (72)..(72): n is a, c, g, or t
  misc_feature (76)..(77): n is a, c, g, or t
  misc_feature (81)..(81): n is a, c, g, or t
  misc_feature (106)..(107): n is a, c, g, or t
  misc_feature (113)..(113): n is a, c, g, or t
  misc_feature (116)..(116): n is a, c, g, or t
  misc_feature (129)..(129): n is a, c, g, or t
  misc_feature (141)..(141): n is a, c, g, or t
  misc_feature (145)..(145): n is a, c, g, or t
  misc_feature (153)..(153): n is a, c, g, or t
  misc_feature (160)..(160): n is a, c, g, or t
  misc_feature (162)..(162): n is a, c, g, or t
  misc_feature (175)..(175): n is a, c, g, or t
  misc_feature (178)..(178): n is a, c, g, or t
  misc_feature (188)..(188): n is a, c, g, or t
  misc_feature (194)..(194): n is a, c, g, or t
  misc_feature (202)..(202): n is a, c, g, or t
  misc_feature (212)..(212): n is a, c, g, or t
tganagttgacnatnaggtatattggggaaggganaaanggaggcaccttcatgagtgcctcccaagggcantagnntctnaaaattgctgggggttaaggggaannaggganttnatggggctcctcnaaaaaaaataanctcnagggctgnttggatntncccaccggtggcntgnagggccacgnaggctnaactaatngtcctggatncccattt

SEQ ID NO: 555968 - DNA, 463 bp, Homo sapiens
agaggcgaaaggtattacacgagattggtgctcacaatcgacgtccaaaagttggaaataaagatgttggcagtgtacccaaccacatgttctggggctcccatgaaacagaagttgatatgaggcccaggaagcttcccagacaagactttattaagtcttatggcccgaaagtttgggcagaagagaaacggtgcaggaggaagaattcttgggtgactccccaaggggaatgccttgtggtgtcttaaggagggttgacatacataatttatgagctacatgagttgtcattgcacgtatggggtggacttaagggttgctcaaacgcatactaacacatactttgcataatcagaaaatggcagataagcccctccctgggtgacgactttagtattatcataagaaccgggtcttctcctggacctgtgcaccagcagtgtgttgcccgcgtttgaag

SEQ ID NO: 555969 - DNA, 1075 bp, Homo sapiens
  misc_feature (325)..(325): n is a, c, g, or t
  misc_feature (344)..(344): n is a, c, g, or t
  misc_feature (359)..(361): n is a, c, g, or t
  misc_feature (368)..(368): n is a, c, g, or t
  misc_feature (380)..(381): n is a, c, g, or t
  misc_feature (383)..(383): n is a, c, g, or t
  misc_feature (388)..(388): n is a, c, g, or t
  misc_feature (425)..(425): n is a, c, g, or t
  misc_feature (430)..(430): n is a, c, g, or t
  misc_feature (439)..(439): n is a, c, g, or t
  misc_feature (441)..(441): n is a, c, g, or t
  misc_feature (467)..(467): n is a, c, g, or t
  misc_feature (519)..(519): n is a, c, g, or t
ctgtgccccagtggtgatcatctgtctgcgtgggctcccgtgtcgcccgcttgtttgcccggcattaccggcgtccaagtctttcgtgttgttttctcgtgtacctttggtgctctcccttcgcgcctgtgcacgctgcatgctttctcgaggctgtgcaacggacaccgtgtcgttctgggggtctgccaggcatttagcgtggttgtgtgtcgatccttgttgctgggtacttctaggttccggacactttgtattcactgggaatatattagcacaaaatcattctttgcaactcaaaatacagaagggactctaccatatnttagctcagagcacaaganggagtgccttatccnnncacttgnctggcctgtggnngntggcntgtgggcccttgggcccaggctggggacagagccctngtttngtgacttangnattttgatgtggtcccatgttctctnacagggccagctgagcagcacaggccaggaggccacagtgtaagcaataacngatctgccacatgcagaagcaaatatcaggcctgtcgcacacgggcggcatttaaataggaatttctatttttgaaataagggatggtctatgaggcatacagtagatttgatgtgatccttttctccctcccttcctataatggatcgtggtctgtgtgactgaacccacacagagtgtcatgggtgacagtttctggttgaagtagctccacgctgggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcgcgccactgcactccagcctgggcaacagagtgagactctgtctca

SEQ ID NO: 555970 - DNA, 349 bp, Homo sapiens
  misc_feature (49)..(49): n is a, c, g, or t
tcgagacatgacgggcggtactactacatggacgtgtggggcaacgggnacacggtcagcgtctactcagcatccctgacagccccaagtcttcccgctgagcctcgacagcacccccaagatggaacgtggtcgtcgcatgcctggtacagggcttcttaccccaggagccactcagtgtgacctggagcgaaagcggacagaaacgtgaccgacagaaactttccacctagccaggaatgctccgttgacctgtacaccacgagcagccagctgaccctgccgggcacacagtgcccagacgggaagtccgtgaaatgccacgtgaaggactacaggaattccaggc

SEQ ID NO: 555971 - DNA, 383 bp, Homo sapiens
gttcatttgagttcgctgctgatcaagacatagccaagactgcgtattttacaaagaaaaaattggtttaatggactcacagttgcatgtggctggggaggcctcacaatcatgatggaaggcgaaaggcatgtcttacatggtggcaggcaaagagcaaatgagatccaagcaaaaggggtttctccttataaaaccatcagctctcatgagacttcactaccacaagaccagtatggggaaaaccgcccccgtgattcatttagcccccaccaggtccctcccacaacacgtgggaattatgacagctacaattcaaaatgagatttgggtggggatatagccaaaccatatcagcaaataaacgtacaaactgaaatgag

SEQ ID NO: 555972 - DNA, 473 bp, Homo sapiens
  misc_feature (21)..(21): n is a, c, g, or t
taacttcttgttccccatacntgccccaccaccaaacacagggagggactgtctgtctttggaaatttcctcatctgaccaagaaagcatctttccaaaagaaatgcaattgtcttaaacaccctccctagaggtctcatcaaataaccaagaaagataaaccaccagaagagatgagactgggaatcatcaccacacccagacagacttcatctattcttctgagagcagctccaagagattgctggaaggactttatctgcttaataagacaagctttgttcctgtacagctccgcccctcaccttcctgtaatatctgcctcccacctccccagtccatacatctcctccctcctgtatgaaaaagggtatacaagcttctgtgccccattgggttattgggaaatcattctcctgtgattcccctgtgccatgcacactaaaataaaattttgtatgccttttctccta

SEQ ID NO: 555973 - DNA, 254 bp, Homo sapiens
gtcatgataacatgcagaacataatgaatgatcttgtacatatcaaaaaagaactcacgccgaactttcacaaattaataatgcggccgggcgtggtggctcatgcctgttatcccagcactctgggaggccaacgtgagctgatcacgaggtccggagatcgataccatcctgggtaacacggtgaaaccccgtctctactaataatataacatacttagccgggcgtggccagaaggagcgtggccagaagg

SEQ ID NO: 555974 - DNA, 111 bp, Homo sapiens
gcggccgcctactactactactgctcgaattcaagcttctaacgatgtacggggacatgggcttaggatgtgaatgccagggagcaataaaggtatccgtggtgaaaaaaa

SEQ ID NO: 555975 - DNA, 297 bp, Homo sapiens
attggacttcgctagggttggtgtccgtcgtcaccgtcgtggccaccgttctcattgtctccgtcgtttcgggtggggcattaatgctcgatcgggcgcatgcgcgcgcgaaggctgacagcgacggtgccgccgggttggtggctctgggctggacggcgattggcgtcgcaggcctcatcgtcttgtatgggttatacctgcttatcccgtattttcactgacgtgaagtgcggaagctgccggacggttcgccgtccggcatttttcatggccggagggggccatctgaggatg

SEQ ID NO: 555976 - DNA, 136 bp, Homo sapiens
tgtcgtcgtcgaccgtaaggccgcccggatgaactcggctatgccggtgagtagaaccagttgctgttcttcctctcgccgacctgcaccgatctgcaaatccctgttgccggcgatcaattccatcgccagggtt

SEQ ID NO: 555977 - DNA, 248 bp, Homo sapiens
gcgagcagtgcattggaaaaggaggcaagaatattaaggctctccgtacagactacaagtgccagtgtttcagtcccagacagcagtggccccgagcgcatattgagtatcagtgctagatattgcaaacaacttgggagaaattctagaaggaaaatcatcccataccttgagaagagggcctgcagtatgccatacagcgcactgtttaaccgagccgagctcccggctcgcaatctagatagcta

SEQ ID NO: 555978 - DNA, 166 bp, Homo sapiens
tgggcttactgtcaagacatgaataagaactgatctggctagcctgatgagtgtaccacgcagcccatgcatatattagtgaccaaggcgatcaaagacatcccgaaactggcaaattcatatccatctggtatgcaatatatacactcagctaggcaaatagaat

SEQ ID NO: 555979 - DNA, 234 bp, Homo sapiens
  misc_feature (118)..(118): n is a, c, g, or t
aacacacaatgactgaggggagtacaagccatttgaaagagaaaatctggttttccacattagcaagattcaagtacagccagaatcaatgtattcagacatgcaaggttaaggattnataaaaggtcacctgcagctcagaagaagatgaaagaagactgcagggcactgaagcaactagataggggagaaaaggagtctttgttcatagacatgaggtttctggtcacaaca

SEQ ID NO: 555980 - DNA, 324 bp, Homo sapiens
gcccccaggaattttgggccctggttccctgaaccctgttttccaaaaccctgccccaggttaagggtggccaaaaaaggtccccatgttcccccccccaaaaaagggggtcggcccaggggtgggcgacacaggcagcttttttggcagcctcccggcagcaaccccagcctttccaaaacaacaggggcctccagggtggggccccacctaaaaggcaggggtcaatttaacaaaaccccaacgttgacttttttccctgggggggctttttttgtaacatgacctgcgaaaatttatataaaaacgagggttcccattaga

SEQ ID NO: 555981 - DNA, 275 bp, Homo sapiens
aggatcccctgctgctgtcgctcatgtagcaagttattagttcttttaaactttggttacatccaccaatacatgccttcattgcaataatcagccaatattagaaattgaatatttgaagtaggtagcaactaacaactttgttttgtagcaacgtaggggtctcaattctacttccacatctacacccactacctacttgcagaagcagaaaacaaagttaaacacctgtaaccaagtgtgataaacactcacgtgtgctccatgtatcatta

SEQ ID NO: 555982 - DNA, 338 bp, Homo sapiens
  misc_feature (6)..(6): n is a, c, g, or t
  misc_feature (138)..(138): n is a, c, g, or t
  misc_feature (256)..(256): n is a, c, g, or t
  misc_feature (295)..(295): n is a, c, g, or t
  misc_feature (334)..(334): n is a, c, g, or t
  misc_feature (336)..(336): n is a, c, g, or t
tcccantttcctccccacatcactctcctcaccccctttactttttattcatcatccataatctctcatcacaacaaattcaacacacatctcaccacattacttatcactctctccaaactaccaccacaatcctcncctttatccattcactctcaccattcacgaatcaacaccatcactattctccatcaacaaaacgaacaactaaacctcatacaacaacgcttgtaccaaataaataacgacattacanacacacacaacactttaacacaactcaacaaattctgtntcctttctctcttcccatctaatataacaaacaactttnantc

SEQ ID NO: 555983 - DNA, 668 bp, Homo sapiens
  misc_feature (572)..(572): n is a, c, g, or t
  misc_feature (609)..(609): n is a, c, g, or t
tcaagcatcatcccacatctattgaatgagccctctggatgatttgcagaataccctttgaggaaagctgctaaaaaaagagggaatagcctgtgtggaggaaggctgtgaggtggagcatgcctgtgtgtttgaggaagagcaaggaggccagtgtgtctgcaaacagggaacaaagaggaaagccatataaatgagttcagaaaggtgatggggcaaggccaggtaggatatggtgggctacaaatggactttgacttaactctgaaacatgaagctgttgcatggatttgggcagcatagtatgggatttgacttattttaaaaagcattaacctgacacttggtgaggatggattgtatgaggccaattgtatatactaccgatatgaattcaagtatttcaatctttcaaatgacatgatgaagaattgaaccaatgtggtaaccagtgtggtatcatttaagatggtaaagtggtcacatttttacatatattctataaataaaaccataagatttatttaatttggatgaactatttgattacattaactatattaacaattgangaaaaactccaacgattttagactcatcaactattangacataacttctacaacatatacattatatgctattacttgttatacgatcattcatct

SEQ ID NO: 555984 - DNA, 248 bp, Homo sapiens
cattctctaatatctcctctgagattaaatcactacatttggtcctttcaaaggggcattttttaaaatttacacgagacatttaattctcaaactgtagaatattttgcaggtcacagtcattaccttttccttgttttaaaaactaacagatatctgcatctacacaaaccttctgaaaataagtgtgattaataataaaaggagcaagctgggatgttcataggcatgctctgggtagtcacaga

SEQ ID NO: 555985 - DNA, 1043 bp, Homo sapiens
  misc_feature (866)..(866): n is a, c, g, or t
aatttattaaataataatgctttatttatatatagagggataagagcttaatcggcgacgactctcttatctagccaccgctacacattatctgatcttctgggatctctactaagatgctggcagcccagacagctggtctggccctgtacgagccttcaggggctgggtatgcttcatgatctgtgcattgtcactgactgtagtaaatcatttgcactgggaactcggcctgaaatagaatgcccttaatacgtatctgaagatactaacttatcacactactgtagtgttgttgctttttattcgtgtatttaggaacatacttaattttgttagcttgtgcagtaaaattattaaggcttgagatactactttgtagaattatattaaattcactgctagctaactattttatataggtctattaaatacttatattgaaataacagttagtaaatgtgctttaattataataattatgtcatactattgtatcaatgtcctcagaattgtaactattatttcattcatagatagtaccatataaatcaacatgtagattatacagacttgtaacaactacagcaaggtgtacagagtttatcgaaaacaaaatgtactctgagtagaacattataataggtgacaagtgaacaagtgatcagttacagtattgctacgatatatactataatgatacgctataatcgagtccgtatactttgtatcgtacttggtattgttttcgaaccccatctcctacatcgaattacaatcctttgatatacgcaaatacctatagaccgttctcactattactcatactcgcaccgcaacacgaagcagcatgttaaaaatcattnatcagataagacttcaatcgtttatcatatgttatattaaatttaaattaaaccataaacactaaatatatagacatgtaatcttatttattcaggacattgtgaggttatatagttgatatcaacacacagtagatatgttatatgatcatgagatgtctaccctatatactttat

SEQ ID NO: 555986 - DNA, 160 bp, Homo sapiens
actatggtcctcaggtgaactggcagcgggtagcgaggacaaattcaggacactgagcttgtggagacagaccagcaggagatagaaccttccagaagtgggcagctgtggtggtgccttgtggagaagaggcagtacgagtacagcattccatgtacag

SEQ ID NO: 555987 - DNA, 363 bp, Homo sapiens
  misc_feature (14)..(14): n is a, c, g, or t
  misc_feature (19)..(19): n is a, c, g, or t
  misc_feature (38)..(38): n is a, c, g, or t
  misc_feature (42)..(42): n is a, c, g, or t
  misc_feature (112)..(112): n is a, c, g, or t
  misc_feature (167)..(167): n is a, c, g, or t
  misc_feature (196)..(196): n is a, c, g, or t
  misc_feature (269)..(269): n is a, c, g, or t
  misc_feature (316)..(316): n is a, c, g, or t
taagacttcaagtnaagtncatttaagaaataaatttntttnatccagaaaggcaggaaaactcaaagagggggagggtggttctagggtataggtcaacttaaacatttcntggttgacaattggttgagtttgtccaaagacctgggattaaagaaaggaatgtntgggttaagaggttgtggagaccaatgtnttttatcacggcagatgaagtattcggatagggtagcaggcttcagagagaagaggctgtaaaattgtttctnatccagacttaaagtctgtgtttgatgtttaatgcaggagaggggtnattgagggcatgtcccggccttccacttccccttatggcctggaccc

SEQ ID NO: 555988 - DNA, 162 bp, Homo sapiens
ctcgtataccactcataggcaactacaggggttacccactaactggcaggcactggaaggttccgcagaactgaggcctacaagggcttttttttctacttcactcttagcaaattcttttttgacgccctcttacaatttctattttcgcccactgatatt

SEQ ID NO: 555989 - DNA, 385 bp, Homo sapiens
ccagcatgatctcaggctccagagtgaggttcatatcctatgacagacccggctaaaagctgcccaccaaagggattaagagtcatcagtaggtgtcactaaggagggtgcatccacttctgagcaaactctagggtgacccactcgccagctgcctggcaccagctctgcagctgctcctcaaaagccttgaagtccacatccggtgccacacggaagtcaaagctggcgctcatggtggcaggtatcacgttataggccacgccaccctctagcttagtcaggttcacggaggtcacggacccctctttcaggtgggggttcgactgcagcctctgccattccttctcccggaatgccaggatggagtttacaaccttgtgca

SEQ ID NO: 555990 - DNA, 116 bp, Homo sapiens
tgtaacattcgtgtcctgaacattcgtgtcctgaacattcgtgtccagttctagattctatgtcttcttgcactgctaagactcgtgcccaactgacgggaggacacgaatgttca

SEQ ID NO: 555991 - DNA, 394 bp, Homo sapiens
ttggcccttaacaagttggtgtccttgaggtgcctgggccgcggcttaaaccccaagggggttttggtttttttttttcaggggtcccccccccttccccccaaaggggggttgaattggggttcccggggtgggtccccccggggccccccccctttttttgtgaccagctttttgggggtggccccccgggtttggaaaaaggggggcacctttttttgtttggtgggccccggggccttttttttgggttttccccaaaaaacctttgtccgtttgggggggtaaccccccctttttaatgggtttgttttcctggggggggggggggggttttgttttttttccgcccgccttttccccccccttttttaattccttgttccccccagca

SEQ ID NO: 555992 - DNA, 136 bp, Homo sapiens
tcgtagcagcgtcaaacatacgaccgcaatcatagtcgcatataatcctctctcaaggacttcaaactctactcccactaatagctttttgatgacttctagtcaagcctcgcaagcctcgccttttattcccccc

SEQ ID NO: 555993 - DNA, 782 bp, Homo sapiens
ggcactttgtttcgtcccaaaaaaggagaccaagcctccagagatttctctcaccatatcgttttgcggccttttgaatcccacctggtcatgctgcagctggagactcctgccagttttaatgagcgcgtgtcccagatctgccttcctcccgagcgctacatcgttcctgatgggaccatctgtgcaattgctggatgggagcaactaaaggaaagggagatgaaacggtgctgaatgtggctcagatgccggtgctcagcaataaggactgtaaccagtacttcaagggccgcgtgcgtgagaatgagatgtgcaccatggcattccaggctggagtgggagcctgtgagagggattacggaggcccgctggcctgtcagaacagtgactgctgggtcctagagggagtcattattcccatgcgccgctgtggacacgcaggacaacccaacatctttatccgcgtctcggtttatgtggactggataaagaaagtcatggagatgacctaactaacagagaaattcatctgctcatatataaagtagacagaatgtaatatacttaaaacttaatatacctttttttatgaatatacaagcattttgtatcatttaggagattaattgacttaatattcaagtttgcagttgtgaaacatatatatataggctacatgtgcacatatatgtacactaaaactaacaccacaggtctgagttttcttgaattttgtaatatttctaatgttaataaagtgttaaaatggcaaaaaaaaa

SEQ ID NO: 555994 - DNA, 175 bp, Homo sapiens
tgggtccttaaccctgctgttgggcaggctctgagatctcagcagacggaaatgaaagcctggcaaatagggaggctgagtgggagagtcacttgagcccaggagtttgaggctgcagcgagctccgactgtaccgctgcactccagccaggggaatacagcaagatcctttgac

SEQ ID NO: 555995 - DNA, 405 bp, Homo sapiens
ggttggtgaggtgtacatccctcttcccatcatatcctatatgtgggggagggcccagatgatggctcccatgagcctgcggggatgcccatcccacacaccccacccagctgttctaaccctgctatccacagccctggaggaactggggctcctggaaggaggaggaggctctccatctgtccaccctaacacataccttcccacccaccttccagacccccttggttggcaccctctcctccggttccctctcaccccatggctgtgaatgacaggacagtgtcacacgtgtgtttgccattgggtttaatttaatggacgtgcagtttcatttgtaatttgtgcattagccacctccttcagtggcaggatgtgagtggctacctggctcaactggagggg

SEQ ID NO: 555996 - DNA, 460 bp, Homo sapiens
aatactccatactgcttagaattaatccttgcaagatactcaataatttggtgcataatgtggaagcagatgaacggatacattcatagtggttagagtctttgatctcttccttgtcagttgattttcggcttatggacaaaccctctaaaccatgttgcacagcagtgtcttcagacttcccattatatttctgaaggttgcagtagcgctgatgggattgttgcttttcagcatcagggacttccttattgaatggtgtctgataacattccgtctccaggaactcagcgagatcggagtatgcattcagaggattcagtcccttctcaagagctttattcgaatagtccatagcatattgctttagtgcttcaatcatctctttatttccactagcttcagattctcctgtattctgcatttgtcttacttttgccttgtagcagcaccaccagga

SEQ ID NO: 555997 - DNA, 144 bp, Homo sapiens
accgaagccaccgccgccgccaatgctgaagaagccgcccccgccgctactggaacctgaggagccaggggtgatgacaacatcacccgtggagctgtcatgaagtgtgttttgagccatacagattctccttctctgtatggc

SEQ ID NO: 555998 - DNA, 294 bp, Homo sapiens
  misc_feature (27)..(27): n is a, c, g, or t
acagcatgatgaagtcactgccagtanttagaaggttataaagtctgtgggatggtacaacagctacctcttccacccgattgctgcttgtcagaactttcctgtagaatctgattgggacgaagaccctgacttattcttggagcgcttagtttccctgacctttggattcaccctctcgataccaactagattatattaacaaacttaccaatgtggacgattcaacatgtcattggggtccacgtctgacagaggaacatttcggacggggtctcaaagatactgacaaat

SEQ ID NO: 555999 - DNA, 1005 bp, Homo sapiens
ggacgcttgtctcaaactccacatacagaaagccaccgaccattattccggtatcctacacccattccccactctctattacactcccacccctggtccctcagcgtcggagtcaagacgcaacagggacacttccggttctaccttgatagcgactggtgaaaccgtagtgaagaatatccctaaactcccataatcgggtgcggattcctatggggaatggcctatattgttgacactcttccaggccttggttctggaccttgagaaatgacggctgtggaagctagagatagcgatgcttttgagggtaaatgtatgtagtgtacttgggggaaggggagggatcaactcgaagaagatggcaagtggtttagacgttcatatttcactttttgctatctctgatagcgtacaaacttgtgagttactatacatggctgtagaatagcttctcacagtctatagccatatcgtgaaaactaaatcttgaagttcagctcttaatacaaaatcagtacttctgagaacatgcagcatttaaccttgtttgcaaaatcgtttttgctcagatgcatcttttttccaggccactcacattgttaaaacggtggtatacttgtaagttagaactgaaagggctcaacttagcattgtgctgtgaccagtatgcgaagtctgtgtcggcttgcccagaattgactttgcgggttgtatggctaaatcacagtcctaaatgatgaattgttgcatgatgcactatgtctggcgtcaacatgcgattttcttgaaaatagttaatttcagaattacgggccaacttgcgatgtcggctatcatgaggcatcatcacaacatttgtattcaccagggtgcagggcttttcacgtagaattcgtcctgatgcacccggagactggattcggattgggaaacctgcttctacggtactacaacctggaccctgggaaggggactcagtttactcgggactgggaaccgagt

SEQ ID NO: 556000 - DNA, 207 bp, Homo sapiens
caaccagccagaacgcctgaacgcaggcacatatcttcctattctacaccctagttaggctcccttcccctactcatcgcactaattttacactcatcaacagccctcacggctgcactaatacgattcttactatctcagcgtctcacgtgtcccgagagaaagcgtatccacaacctccgtggagtctcaaacatacgttagagt

SEQ ID NO: 556001 - DNA, 221 bp, Homo sapiens
  misc_feature (28)..(28): n is a, c, g, or t
  misc_feature (112)..(112): n is a, c, g, or t
  misc_feature (130)..(130): n is a, c, g, or t
  misc_feature (143)..(143): n is a, c, g, or t
  misc_feature (189)..(189): n is a, c, g, or t
  misc_feature (218)..(218): n is a, c, g, or t
aggatgccaaatctgtcaagatcaaganaaataaggacaacgtgaatttaaagtttcgatgcagcagatacctttaaaccctggttcatcattgaccaagagaagggcaganaaactgaagcagtccctngccccccggtttngcagttgaaggaactgaaattgaaccagacacacttgattgggacntgtattattttaaaatactaaaaatcctngcc

SEQ ID NO: 556002 - DNA, 619 bp, Homo sapiens
  misc_feature (2)..(2): n is a, c, g, or t
  misc_feature (505)..(505): n is a, c, g, or t
anctcaagcagttcgactctagactactgcaagcttattcatgcaggccgaaatcttagctgactcaggccaatataacctatagtgagacgtgttacaatagcactggcctgcccttttacataacactcaaatgagaaatcactgatactaacaaactaaatgctcaggaaatagataccgctttgaaccatctctgcccaatcatcaaacaagccctatcgacctccatccatacagatgctatacctgacaggcgagtggaaacggccaggcctaaccatcagatcaattggccgccaatggttctgaaactacgtgatcacttaactacagggactaattttgcactactacatactaatcaaaagattccatcgaccaagcgacctgtgacgtcccagactggaacaagagagcagtactaaagaacgaagactccaaccgcataggactacataccaagatgatggcgatgatgaacttggtgaacattaggcttatnaacagattctagggccggggtctaaaaaaaccaatttgaaccctaaagggcggggggatactaaggtaaaagggtaagactgtgaagcaaccacaatagaatgccaaaggccag

SEQ ID NO: 556003 - DNA, 332 bp, Homo sapiens
gcagtatccacagagacaggtgagcaacagcaggagagaccgaacaggaccaggatgatgtgtagctccgacccctctggggatcaaggtcatcaggatgaggactgtactgttggcggccccagactggatgacagccatgaggtggatgtgttacagactggcgggctccaggccatggaggacaaagccacgggagtgaggcattcaggatggcggagaaggactggttctgagcgttggtccagacgctggtgtcgtgagtccgggggctcttccccagctcagggggctcaagcacccactccagctgtgcccaggtcttgcccatg

SEQ ID NO: 556004 - DNA, 669 bp, Homo sapiens
gcccatgatcgcctaccagggccctctcagcactcctagtgacctccgaggcgtacccatgtgattatgcagttccactccattaacgctcctcatactaggcctactaaatcgaacgcactgaaccatataccaatgatggatgcgactgatttagatcgagaaagcgcataccacggacaactaacgctaccgatgctgttctcacaactatggtccttcttgatatcgtgcgtagtacactcgctattgtataacctcagaagttttggtcgttcgcaggattatttctgcacgccttgtaccactccagtcctagctccctacccctccaagttaggaggggactggtcactccgaagcagtgcatcaaaccacggctaaagagtccccgtagagagtcccacatccatagaacacatccgtattactcgcatcagggagtatcaatcacctgagctcaccatagtctaggtagaaaacaaatcgaaaccaaattaacttcaaggacactgcttagttacaagtgtgttactgttgtctctatttatagccgctcctagcggagtcctcagaggtacgttcgaggtctcccttcagccaatattccgagcggcatcgtacggttcaacatgtttttgtagccacaggcttcacgggggaacttca

SEQ ID NO: 556005 - DNA, 152 bp, Homo sapiens
gccctgcttctgcatgaagcactgacttagaagctgagaagtgtatctgtaccttttgccatttcctggtcctctctctctctctctctttttacttttttggagatgtatttacactccagccggggtgataacacggagaactctgtctc

SEQ ID NO: 556006 - DNA, 160 bp, Homo sapiens
gtgggaccaggaagtgttgcagatctcagattattcatattagaaaatatttccatacagataatgacatatcttaataatggaaaccaagtataaacaggaattcatttatgtttcatacacaccttatgcatgtagcctgaaggtaatgtcagagata

SEQ ID NO: 556007 - DNA, 196 bp, Homo sapiens
aagactagcctgggcaatacagtgagaacctgcttcacccaaaaaaaacatgtaaggtcaggccgcggtggctcacgcctaaaatcccagcactttggaaggccgaggcgggcatatcacctgaggtctggagttcgagaacaaacctgaccaacatggagaaatcccgtctctactaaaaatacaaaattagccg

SEQ ID NO: 556008 - DNA, 378 bp, Homo sapiens
tttctgttgcctaggttggagtacagtggtgcaattttggctcactgcaaccgccacttcccgggttcaagtgattctctcctgcctcagcctcctgagtagctgggattataggcatgcaccatcataaccagatcattttttgtatttttagtagagatggggtttcaccatgttgcccaggctggtctcaaactctgggcctcaagcgatctgcccacctcggcctcccgaagtgctgggattacaggcatgagccaccatgccgggccccataaataaattttaaaaaaggctttctaggaaaaacactgcatacacacacaaaaaggattctaaaaatgtggaattttagggagcagttgaaaggggatattt

SEQ ID NO: 556009 - DNA, 203 bp, Homo sapiens
  misc_feature (9)..(9): n is a, c, g, or t
  misc_feature (21)..(21): n is a, c, g, or t
  misc_feature (58)..(58): n is a, c, g, or t
  misc_feature (67)..(67): n is a, c, g, or t
  misc_feature (75)..(75): n is a, c, g, or t
  misc_feature (77)..(77): n is a, c, g, or t
  misc_feature (84)..(84): n is a, c, g, or t
  misc_feature (86)..(87): n is a, c, g, or t
  misc_feature (90)..(90): n is a, c, g, or t
  misc_feature (135)..(135): n is a, c, g, or t
  misc_feature (139)..(139): n is a, c, g, or t
  misc_feature (141)..(141): n is a, c, g, or t
  misc_feature (148)..(148): n is a, c, g, or t
  misc_feature (198)..(199): n is a, c, g, or t
  misc_feature (201)..(202): n is a, c, g, or t
cacacaaanacagctacaggnagtaccctgggggctcagctgagagagagtcacaganaggccaganggtctcangnaggtctngnnggncacagctgggctcacagaagctcttgggccctggcatcctgggtnaccngngttcttnggtattggggacaggacagagagctcattctataaccacagttgtctttnnanng

SEQ ID NO: 556010 - DNA, 189 bp, Homo sapiens
cgacagagtgagacatcttgatctgctggtttgcgtcacggaaaagatgagcgccgcttccttcatcgacaggcaaaagtccggcaccatcaagctgccgctgtgcgggtctcatatcctgctggcaattctgaagtgtacgagcctactgcgcaaaggctgtaggctcgtgaaacaaagtcggatggc

SEQ ID NO: 556011 - DNA, 136 bp, Homo sapiens
ctgagggatcacaggatggagagacagaggatctttggggaggtaggtctggagggagctgacgagcctagccactcagggctcaacagcagggtgaggctcaggtggaggtagggggcggccgctggctgggggg

SEQ ID NO: 556012 - DNA, 668 bp, Homo sapiens
  misc_feature (273)..(273): n is a, c, g, or t
  misc_feature (564)..(564): n is a, c, g, or t
gcatgcggcggacgttgcagtgatctgagatcgtaccactgcactccaacctgggtgacagagtgagacactgtctcaaaaaaaaaaaaaaaggacaattgggaaaatttgaataaggtctatataaattagataatagcattattatctagtagtagtaactccctctgttaatttcctgattttgataattgcagtatggttattgaagacattaaaatagggaaatatgggtaatggggtacatgggaattctttgtattattttgtagntttttttttttacaaaaatgaaattatttcgtaatgaaagataaacattttaatatttagaggatatttggtccttaaaacacagttctcaaaccagttgtcttgaattctatatggaacattgagaggggtataaataaaggtctgaaaggtaatccaagggagagaatacggtcatggggtcttaaggttctgtttttggttggcccagtaaagcctcttcctcatccctcttttcacttaccactagagacggaactaaacccatgcttcaagcttgtaaaagcctanaccaaaccaaccaaaccaccacacttccaaataggtgattggacaacttggccaataatggcttacttagaatgcttttgctggccgaacaatggggaaagggc

SEQ ID NO: 556013 - DNA, 197 bp, Homo sapiens
gccgcccagggcgtcaaggtctacaaggacggaaaattcactttcaacaccgaccaggccgtcgagatcattcagaagtatgtcgagctttacgccaagaaggctatgccgccggaggtgttgcagaacaattacctcggtaactcgaagctgttcctccaggacaaggttgcgtggaccactggggtaccgagctc

SEQ ID NO: 556014 - DNA, 81 bp, Homo sapiens
tacctctgtgctagaagatcggcccagaagctggtatttggccaaggaaccaggctgactatcaacccaaatatccagaac

SEQ ID NO: 556015 - DNA, 97 bp, Homo sapiens
atgtagccagcatcactgtgataccaaaatctggcagcacacaccaccaccaccaccaactgcatgccaccatcgctgataaccatagatgcaaaag

SEQ ID NO: 556016 - DNA, 451 bp, Homo sapiens
atctagagattcccctctagagcatccgccagggtgactgattctatttattactgtaacattactatctactttaccatgctagcctctaaatgtttattgtcttctcgctctaatgataccaaatatattacatattaaaaaattgaaaaagaggaacagataggaattacaaaggcatacattgcctgttaacagatttctttattttctcttggtctattctctaccatcattttggagttcgggcagctgtaaattttgaaaaattgacattttcagaaatttaagaaaggagaatcagagcactaacaaccatgctaagcacaccattacgactactacaaaatttacacagaatttcttagtgagtgtgtccactgattggaaatatataactccactgaatatagaatgttcaaatgtatatactagcatatgtatatattgg

SEQ ID NO: 556017 - DNA, 1349 bp, Homo sapiens
ggaacctggcgacagttggtctcagtgtccgctccggggggcctcaagaacctggaggcagtccccggatggctgctgcgggtggatacgccagaggaggaggccgtggacttgtctctggtgtggtagcatgtcttagacagctgtatctgcgaggtacaactgacgttacacgatcaacacatcgatttccaacagattatcgcgacgcaggatatatcctgccggtcgctagccagcatgtctgcgggaggaatgccatggctgggccaggccccactcagcgctgaagtcagtagatacctgaggaattcggagggcagcatgtctgggaccagcggctacaggtgccccgtcgtccggaggccaggacagtgtctcgtgtgccgtaataggcaaacgagaataggtcctgtcagatagaccgaatacctatgtcgtggaaccggagtgatagagagctattgaagggacttgattccaattctggggcacccttgtgatggcgcccccttggtgtggacaacactgatcaagtacatggatcacgtcgacgaatgggcgtcgcttagccaaagtcttgtctattgccgctaggaattgaaaaccctgtagactctggtcataagtagagaagaatcaaggggactatcgcactgtggcgaaggacctatggtcgtggcacgaacgctgaatcgaagacacagcacatgatgggccaaatgccactgtgagcacaatgagtcaccatgtagagggaaacaaatgagttcaaccggtgacaccgggaaggcataccttaatttggcccttaattagatagttgccaatttgtaagtcacaattggttaatatgaggaccccataagagcatccggtttgtacatttgacgagtgcgaacggattccagcagaacgagtagaacatgatcgagacatattcgagcgccaaacataaacttaaaacccctagagtaagccacagataccttgtggacacatgtagccgtggtaatacaaccttcagaacgcgcaggcaacaagcaaattcattccaccctgtgattggcacgcaagaacatttgtgggttgagcccttttggcggccagaaggccccaagagagggaatgggccccatttcgcgaaggtgtggacgtaaccgtggggagacacacaagcaaaacacgggatagagatttgtatcattccccgggaacaagtatatcaggcatacgtttgagatcaatccgatcataaccaacatgggaagcaaaattccatctcgatgagattacgagcgcattctcacacttgtggagaattgctgaaaacagcattgatgaacaat

SEQ ID NO: 556018 - DNA, 119 bp, Homo sapiens
  misc_feature (2)..(2): n is a, c, g, or t
cnatgaggtggccacgcgcttacacgcgtggcacgtggacgacatgccaagcgctgtccgcctgagtgaccgcacgcgcacaagttcgggtggaccggtcaacttcaagctcctaagcc

SEQ ID NO: 556019 - DNA, 485 bp, Homo sapiens
  misc_feature (199)..(199): n is a, c, g, or t
ccgccccctcaagtggggcggccccaaactgattgaagtggggtaaatctttttggacgtgaagttggccaaccccgtggcccaagccccagcccaattgggcaaactgccctttccatgcccacccccatttaaaaaggaaagcattttgctctttccagatttacgttggcccttggcagggcccaatgcccttttnaaaatccccctgtcaggacccctaggggtttggaccggggtggcctgtgcctatccccttttatggacccctcccacccccctgtattcccccccctggattgggggcccctcccttggggaaggtttccccatgtgcctgccccaggaaacaaacaaaaaaggcaccagggggccttttttgctcaacaaggggttttgccccccccccttcctttttgtttttaaaagccccggggtggggggcaaacccccccccctcctccaataaaatagtagcctcggca

SEQ ID NO: 556020 - DNA, 124 bp, Homo sapiens
tattttccacaggggtcagaccggatacttatctatctatgattaaatgtacatttttttcttcaaatagcaccatttataaattcaatgatattcataaaaggacaaaaaaggatcatagaaa

SEQ ID NO: 556021 - DNA, 668 bp, Homo sapiens
cgccgtcgtgcgcgccgcaaaccaaggggttagcaacgagacagcgtccccgccgggaaagggaacccttgactccccactacgcgccctttttccccgatgggaacgaaccgtcggcccccactcatggagggtgaaagcggtggaccatcactcgccgccacctccgggcggcgtccaagttttcacacacacggcggcccacaagaggcgctccttatgccccttgtccacaagaccggcggcaaaaaacctcgtgagacagaatccaacccacgcggctgtgtccaacacacataacacttgtgttggtagaccccgccacggaaaagattctaaggaagacatatttccaattagaaaggagagagcactgtccctcgaagttttccggcaatgtctctccacgtactttgatgcaacaccatgtgtatctcaaagcgatttctagcgagccccgaaggaggtaaggaccgtcaagccccctgggtttatcatagatgagccccaggtcccccgattgtgcggccacaatataaagtcgccacgcagcgctcccactcacccccatatggcgaaatgggacaatccccccccccgctgtgcccgcatgcaaaaaattttgtcggcgaccaacccacaaaaaggagtttgctaccacataacaa

SEQ ID NO: 556022 - DNA, 135 bp, Homo sapiens
aagactgctgaaagatgacgactggcgggaggagtctgtctccatgtggacaaggatcaggtgtcaggtggagttctgcatcgagcgatgcgcccgaaaaggcagtcgatacttctacttaaaatgtagggtcaa

SEQ ID NO: 556023 - DNA, 535 bp, Homo sapiens
  misc_feature (242)..(242): n is a, c, g, or t
  misc_feature (509)..(509): n is a, c, g, or t
tgagatggagtcttgctgtgtcacccaagctagactgcagtggtgcaatctcagctcactgcaacctctgtctcctgggttccagcgattatcctgcctcagcctcccaagtagctaggattacaggcgcctgccaccacgcccagcctcgcaaagtgctgggattgcagtcctgagccaccgcgcctggactttttttttttttttttgaaaggggttggggagacatattctctgctagngattctcctgcctggtctcgaactcctgctgggatcacaggcgtgacagccacgcccagccacctttagagttttcttaccacctggttttcctctctcaatatctttctctcatttcctgctttaaaactctagcttggggtctgggcacagtggctcatgcctataatcccagcactttgggagactgaggcgggtggatcacttgaggtcaggagtttgagaccagcctggccaacatggtgaaaccttgttctctactaattnttaccaaaagtttagtccagaccgta

SEQ ID NO: 556024 - DNA, 178 bp, Homo sapiens
cgtgcgggggagctgggccggatcctctctgtgcctgagagtcagaagggagcctgcaggctaccgggatgctgtctgcagtgggcaggctgctgcgcgtgcaggcgcttctctgggctgtctgctgagctccggaaccagctggacgtggccaaggtctcccagccgggccgggccg

SEQ ID NO: 556025 - DNA, 389 bp, Homo sapiens
  misc_feature (5)..(5): n is a, c, g, or t
  misc_feature (17)..(17): n is a, c, g, or t
  misc_feature (60)..(60): n is a, c, g, or t
  misc_feature (94)..(94): n is a, c, g, or t
  misc_feature (216)..(216): n is a, c, g, or t
  misc_feature (222)..(222): n is a, c, g, or t
  misc_feature (306)..(306): n is a, c, g, or t
  misc_feature (330)..(330): n is a, c, g, or t
  misc_feature (363)..(363): n is a, c, g, or t
ttttnactttgaacagnggatcattaccatccacttcggcaatcttcacgcggcagacgncatcttcatcaatattgccaacatagcgcaaaanttttccttcatcacgggccttcgccacgcgcgcggcaaagagatcgtcgagttgtgacagattcgccataaaagcggcaacatcaccctcggcgttaaactctgcgggcagcacaggttcantttcantatccgccagctccagttcacgtcccgtttcacgagcgagattcaatagtttacgcgccacatccataccagaaagttcatctngcgggtccggttcggtataacccnattttcccgcggccatttgggttcggtctcggnggaaactcatgccttcggtctaactt

SEQ ID NO: 556026 - DNA, 234 bp, Homo sapiens
gtactgtaactatgggctgctctactgcatcagtgacaggacatggacaaggtcgagacattcctgcgacattgtgaagatgccgatctgtagcgggacagctgtggctaccaggtgccgatagaatagcgaggtagccgctcaatagcgaggtgccgctaaatagcgaggtggacgatgaatagcgaggtgccgatcaatagcgaggtgtcgataactagcgaggtgccgata

SEQ ID NO: 556027 - DNA, 137 bp, Homo sapiens
catggatgcatgggtgcaggtggatgtgtattcaccaactggcggtgcatgcctccctgtacctgttccgtacgacacgtgagcaccgtgctagacctccaaatatcgtatcagctaggcagcctgggatcgactac

SEQ ID NO: 556028 - DNA, 126 bp, Homo sapiens
agcatatctgatgattgtatagctgatatttcaacacagtcttaagtttgcatttccctggtagctaataacactgagcatcttttattttttaaattaagtcttgctatggaaacttctaaaact

SEQ ID NO: 556029 - DNA, 241 bp, Homo sapiens
cggaaagatgtgtgaccgtggatatgtacaccgggtcttgtgacttccagggatgaaggtgtaactcagaggagagcttctacagaggtgaatgtggtcaacgaaatggaataggaaattccacaaatctgtccttccacaaaagcagcaaataaggtggcaaaaactcaaatctatgggaactctggaaacgaattgaaagtttacagcaatcaggtgaatacctaagaataaaagctgg

SEQ ID NO: 556030 - DNA, 217 bp, Homo sapiens
tcaactgcttatattccacctcgtgtgtgaagtggaggtgcaggtggcataggaatgaggatgtgacactgtacagttaggagatgatttcttcccccccccccctttttttttttggaaaccagggtcttgtctctgtcccccaggtggaagtgctggggcccggtcaaagttaaaggcagcctcagacttatggggcgtcacattgagccttccc

SEQ ID NO: 556031 - DNA, 225 bp, Homo sapiens
gccgccaggtttctcagatcagccgacgcggtttacattcgacgttgattaccgggtcccgggtacctcctcagaatttccaggcccggctcggactcttggttacctccctggcctccccacccggttccgcgtccttagacagctctcccggaacggagctcccagtggcctccttgggctcctcagcacccctggcacccaccaagcctcacccccggaccc

SEQ ID NO: 556032 - DNA, 317 bp, Homo sapiens
ccgagaacacgcctgaactggcgatagcgcatagcaggcgcaggatctggctgcgccggttcatgcctttgaccagcggaggattgccataggcggtgggcgggttgctcaagcggaactcctttcagacgacggccggtagcgccgggccatgcccggcgaaacgggatcacgctccagtctggccgggccggggtcgtcacgtggtgaacccgatctcttccgcagtcaacgccgaatcggtcagaatccgcccattccctttcttggacgccccatggccggtgccagcctgttcgccctgctcgacgatatcg

SEQ ID NO: 556033 - DNA, 1032 bp, Homo sapiens
  misc_feature (36)..(36): n is a, c, g, or t
  misc_feature (144)..(144): n is a, c, g, or t
  misc_feature (168)..(168): n is a, c, g, or t
  misc_feature (173)..(173): n is a, c, g, or t
  misc_feature (209)..(209): n is a, c, g, or t
  misc_feature (229)..(229): n is a, c, g, or t
  misc_feature (231)..(231): n is a, c, g, or t
  misc_feature (246)..(246): n is a, c, g, or t
  misc_feature (250)..(250): n is a, c, g, or t
  misc_feature (273)..(273): n is a, c, g, or t
  misc_feature (277)..(278): n is a, c, g, or t
  misc_feature (304)..(304): n is a, c, g, or t
  misc_feature (387)..(387): n is a, c, g, or t
  misc_feature (412)..(412): n is a, c, g, or t
  misc_feature (633)..(633): n is a, c, g, or t
agacttggggactccaaggctgaaaaccgagcaganataaccgtgctggtgtcggacgtcaatgacaacgcccccgccttcacccaaacctcctacaccctgttcgtccgcgagaacaacagccccgccctgcacatcggcagngtcagcgccacagacagagactcnggcancaacgcccaggtcacctactcgctgctgccgccccnggacccgcacctgcccctcncntccctggtctccatnaacncggacaacggccacctgttcgcnctcnngtcgctggactacgaggccctgcagnctttcgagttccgcgtgggcgccacagaccgcggctccccggcgttgagcagcgaggcgctggtgcgcttgctggtgctggangccaacgacaactcgcccttcgtgntgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgcngccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcgtcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaag

SEQ ID NO: 556034 - DNA, 166 bp, Homo sapiens
ccgttggacgctttcatccctcggttgctatggatggttctaacaaaaactacacatatgtattcctgatcgccaacctattcccccaccagactaaggacatttcccagagcttcatagggcctggtccctggagaggacaactttgacatgggtccattcttgc

SEQ ID NO: 556035 - DNA, 186 bp, Homo sapiens
tctcaatctccgaccctctggattggactacgtacatgacctaagcctgctccagtgctgagaggaattcgttccagctagttatgttacgtatcactgacatgacttgccacaaaacacataatttgaatcaacacaaccacccacagcctaattattagcatcatccctctactattttttaac

SEQ ID NO: 556036 - DNA, 163 bp, Homo sapiens
ctagtagctggctagagtgtgcgtgccaccacagcccggctaattatacttatatttaagtagagacggggatttcaccatgttggctagtgttggtctcgaactcctgaccttgtgatccgcccaccttggcctcccaatagtgctggtgattacaggcgtg

SEQ ID NO: 556037 - DNA, 165 bp, Homo sapiens
ccatcttgctctcatcacgcgtctttgcctaggggaagtgcaccagagagcaagaggcattctttacttattaaaatgttggggcgagaacaactttttacgtggttatgctgtcctcctacgctggggctgctaagggcagttcaacttctaccctgtgttaca

SEQ ID NO: 556038 - DNA, 111 bp, Homo sapiens
aagaagggatatgtgggtgattgaagagtatgcaatgagacgataattaggtctgttgtgtcgtaggcagatggagccgtgttataagttatgccgtcatagggactagta

SEQ ID NO: 556039 - DNA, 1635 bp, Homo sapiens
ggggccatcctgtcccaccatgcagatgcccctagcttagagcctccctcaattccccctggccaccaccccaccatcacagtgctgggacgtcgacgatcatagatcttgagactcgatcccataggagacttcggatgatatcaagatcagaccactggctgcacttacagtcaaaccagaagataccccctacctctcaggttgacttggagtggtgacacgtggttgtatacgcacgcccagcgcaccacagcaatgccatgcacttagacaatgtcatgaacatgaatggtacacacgtgaggtactgacgccgtatgtaggcccaaatggagcacatagactaagaaatcccagtacatgccaatgcacttcacaagagcaaatgattgaactgaggcaccatgaatgaagtcagagatgaaccaccaaggagcaacaccatgtacccttgcatgctaccaacagagcatgagcaccatgtacagataacattgatccaccagagaccgaagagcaagaggcatgatgaacccaccctacaccatacagcgccagcaacatgccacagaagaacaatcacagcacacggaagaaggaacaaccgaatgacctaccaacatgacacccactggacaccactcggaaaaagacacaacaccagagcacgaatgcactggaccagaagcgagattacaaccgtggagatcgggaacagacacccaacacaacacgaggaaacagaataacaacatggagaccaacaagaataaacgtaaccctcgacatcaacagacaaccagaaggagaaatgacggaagacattcaacaaggaaaaggatcaaacaggggacgacaacttgcaggaccatccaaccaataggcaacaatgcaccaatgggcaccgcacaacaaagaaccagacacagacaacaccagcaacgacaaccgcgacctcaccctatccacaaccgaacggcgcacgcaccaactcaaacagagtcgaacgaaacacgcaaaccacagcgagccgctcatcacgacgcacaacctcatcacagggaccccaacgagcaccaccacccacaagaacgaactaagagtagcacctaccagaccacaaataaagcaagcggacgaacagcaaacatagcggacaagaacaagagaacatacaagacaggacacaacatgacgcccaataacgagccaacaaatagggaaccaagaaaagaaacactatcaccgacacagtcaccccagcagaggacaaagcggagaaagcaagtaaagcggacagtacatatcaaagacaagatagggaacgcgtgacccacaacacccacacgacacaccagagatatcaacattaatacaaaccgaaacgctcacagcagtccaaccacagaacccacacaataatcaaaataaacacaaacaaaaaaccaaaccacaaacttacaaccaacaccaccacagtaaacaacacacctaaagcacaatagtcaacacaaaaaaagaaaaaaaaacaagcaaaaacacaaacacacaaacaaacaaaacaaataaaaaacaaaaaaatcaacaaacgacacaacaatatatcgactaacaacacactacctacataat

SEQ ID NO: 556040 - DNA, 404 bp, Homo sapiens
actacgtcgcgaagctctaggtcaggcctccctcaacttttcaagttacttatgatggtcaacgttataatatttaggatcagatggacttttgttagagtcctggctttgccacctactggctgggtgacctggaccacgttacttgtgtctgtgaccattgtcccctcctagtggagctggcactccatggctcttctggttgttatactacatgcaaggcacttaatacagtacctggcattagttagagcttggtaaatccctagttcctcctgtaaggtactgttatctttgatgctgctgccattgtcaccttatacccatgtcaactcatttgtcacctttctaaaacatgttgaaattattttcctatccctagtttcttagcccagctcggacgg

SEQ ID NO: 556041 - DNA, 381 bp, Homo sapiens
tctcctctcactttttcctacctagcggaagacgatgggggactcgaggtcgtgctctcgttccgttcccagaggatcctagtgcttaagatcggggtttatttcctctattagtatcaaacgtatcaataaggatcttagattcgtagttttagatttgttgcagcacaagttcaataagtaatatgcagtattccagctcccgacttaggagagtcgagtaagtcggcgaaattatctcttccttcccaaatattgccctaattaattctctttcggagttaattcgcagcgggccgaccgtcgatagtacggctcctttctttcgtaccctagatacattagccatcgaaagtctagccccgcgaccctctagcgtcg

SEQ ID NO: 556042 - DNA, 1405 bp, Homo sapiens
ggaagctggattcagcgctgtccgcgacctcacctttagcgtcctgtgagggacggcccaggtggcaggatagtcctggtctaggccttctccatggcctcaacacgtccctaaactatgtaggaccagctctggttccccgtgctctggagctacctagctccatgagctacccatgaaccacgatgcaccgacctgggtgcccccacaagcggcacgcactcaggaagctaggagaccccacaggaaggccgagccgcagactgacaaggtagtggtacctagtagcacgtatcaccaccgacaacggccgaccgcaagcccacactcacgccacatcgccaagttgcatgtcgacagtgcaggctccagcaactgagacagagcaggaccgatcatgctatccatcaccttgggcgacagggccaacaccccttgccaggcagcaaccagaattggaccccttgatcggaaccgcacagggcccgacacacccacaggaaccatgaccaagagacgatcacaagccaatcaccacgaaagcacgccacatgaccacagctcaccacacctggctaggccaaccacatgccacgacacgacaatgattgaaccggcgcaatggccgagcacaccaagcacgaccgcattacgccacagccccccatggcgccacacaccaatgccaaaccccgtccaacacgaaaatacaataccacgatggcaccagcagaagcgcacacaccccatccaaacacataaacccaggacccaataacggcacaacccccccccataagacaacgcaccccacgaacaccaccacaccacagaggcaccttactcacaacagccatcaccctctgccgaccatcaacccaagccacactacccacctatctccccacactaccaaaaagtacaacaccccaacaccctttacactcacaccacgcccccacccttacacacgaccaccgatcacccatccacaccacccccaatcaccccacaaacctatgggacgattagaccaccacccgcactccaacatgcacaacccagaacgaaaccgcccccagtaatgaggaacgaaactatccccgttcggacgggaccatcaacaacagaaacccgcgcgcacctctaggagccaccaacagccagcgggcggcaccccccacatcaccacacaggaaccatgggcctcacaacacatcagtaccacacacattagggtgaactatggcgaccacgcataaacactgacacatcgccgcacgacaacgggcgcgtgctaacgaaccacacgacaacagccagaagagaacaccgcaagtaggccacgacacccaacaccaccgccacacacaaaaccaacaccaacgcaccacaccaaccaacc

SEQ ID NO: 556043 - DNA, 366 bp, Homo sapiens
  misc_feature (11)..(11): n is a, c, g, or t
  misc_feature (44)..(44): n is a, c, g, or t
caagggtagcnatccgtattggtaccataacaacagctgcggcnacagatagcaatggctgaagatcagcccatttcctgggagactttggttgtccccccactgcctagtaagcaatgagtatttaaaaaaaaaaaaaagccaactgattcatcaaatgtaattcatcatatagattctaatttaaattctaatacaatcaataagaacctgttagtctgaaagactgtatctttctagaccctgttaacttccttataaactaggaaggcctaggactagacttacaatataccttggagactagagttatcttgtcctttgagacacctggaaaacagcaatgagaagcctaagtgtcctgtg

SEQ ID NO: 556044 - DNA, 356 bp, Homo sapiens
caggcggttctctggaactctggcactttgaattccgaatcactggattaaagtcgtctgctgtgctagcggtgtctgtagctcgcagtaatgttacattatcattgccagggttctcctcctgctctagctgttgctggtatatcttctgcagctcctcaagttgagtctgcaggtcccttactttcggcagtcatttcttcttcagcgagcagtcagggatttcttcatatctgttggctgtgcggtttaagatgcatcatctttctcagcaattttttttaggtaactgattggtctcttcttgatggctttctaaaagtgcaggctccacctcctgggcacacattatggag

SEQ ID NO: 556045 - DNA, 447 bp, Homo sapiens
  misc_feature (36)..(36): n is a, c, g, or t
  misc_feature (39)..(40): n is a, c, g, or t
  misc_feature (46)..(46): n is a, c, g, or t
  misc_feature (55)..(55): n is a, c, g, or t
  misc_feature (60)..(60): n is a, c, g, or t
  misc_feature (99)..(99): n is a, c, g, or t
  misc_feature (119)..(120): n is a, c, g, or t
  misc_feature (130)..(130): n is a, c, g, or t
  misc_feature (142)..(142): n is a, c, g, or t
  misc_feature (166)..(166): n is a, c, g, or t
  misc_feature (172)..(172): n is a, c, g, or t
  misc_feature (196)..(196): n is a, c, g, or t
  misc_feature (216)..(216): n is a, c, g, or t
  misc_feature (280)..(280): n is a, c, g, or t
  misc_feature (283)..(283): n is a, c, g, or t
  misc_feature (326)..(326): n is a, c, g, or t
  misc_feature (344)..(344): n is a, c, g, or t
  misc_feature (355)..(355): n is a, c, g, or t
  misc_feature (412)..(412): n is a, c, g, or t
ctggggggctttggtggcccgactccatgtgagtgncannagttgnagcagcctnccgcnaccctgttggccaacccagcctgggtgagttggacccancaacaactgcctgggggacnngggcatcctncagctggtgganagcgtccggcaaccgggctgcctnctggancagctggtcctgtacgacatttantggtttgaggaaatggaggnccggctgcaggccctggaaaaggacaagccatccctgagggtcatttcctgaggcttttcctgntgntgctttccctggacgaccggccttaaggcaaccctggggcccnccagcccctgccatgctntccccctgcanatcctaggtttgaaaaaaaacgctcagatccgcttatttttgccagtatattttggnccctttataatcattaaagcccttttttggcagga

SEQ ID NO: 556046 - DNA, 545 bp, Homo sapiens
  misc_feature (13)..(14): n is a, c, g, or t
  misc_feature (151)..(151): n is a, c, g, or t
  misc_feature (154)..(154): n is a, c, g, or t
  misc_feature (228)..(228): n is a, c, g, or t
cacccactggtgnntgccaacacgtgtagggactcgtgcctggccgcaccctcatgcttggacctagcgctgctgaccgagctgtgccagcgcgtgagcttttgcactgacatggaccccgagccgcagaccttccaccccgtgctgtccntgntcagcttcctcttcaaggcgccactagtgccgcccggcagcccggtggtcaatgcgcttttccgccagcgcagntgcatcgagaacatcctcagggcctgggtggggctccccccacaaaaccacatgttcttggaacacaaaatggagcgcccagggcccagcctcaagcgagttggacccgtggctgccccctaccctttgttgaacaagaaaggaccggtaccccctgccccaaatggctgccccggtgatgccaatgggcatttgcaaaaggagcccccaatgccccccccctgaggccccggtcacccagtttttgggtttttcctccccgctgccccccccgaccctcccttgaaggcccccccaaataaaggggctgcccctca

SEQ ID NO: 556047 - DNA, 1317 bp, Homo sapiens
ttgtgtcgtaattggacgccgacattgattctattcttctcatgatgatgtgtttgttctctcgtgcttcctccctcccgccttcgttgttttactatgtgattatatctactaattatcatgtaacttcattaaatataggggcgcgcccctccccgtgcgtgttagagatgtgcttcgtaaccaatccgccctctgttccacaagaaaccaaccgcccctcttccgtacggctcgcgcccacaaaaggggggccccccacagagaaaaactgggggtggcgagcccaactggttctaaaagaaaaagatttgggttaagagaatggtggaagaccacccccgctgatgcttcgactatattaaaagaatatttgggaaaaacccctctgtccacccacgggccccacggggaccccgagtgggcatcctgaagggttctcccagggtctcttgttgttttgaaggtgagttcctttctggaatttgcgcgaattgattgagagttgccattttagaagaatttcccaagctggatgttctgagaggatgtctccagggtttaaaactgcccctgactatacttgtcccatgcgccatggagtctcttacccccggtgaccacgaaatgtgggtctcccatggcgtccacaaaaattgcgccagcaccacactgaatttgtacagactttcaccgcttgaaatggtctcacacaaaactatcccgcaatggtttacactctggctttttcgcttctcgtttttctcgtgtttgtggtttttatactataaatatactcgcctcaccacacttcacgagatactcgcgagaagacacctctctctatgggctccacgccacccacaccacggtgtcccgccccacatttccgcgagaagagaagagtgattgtgagaattccactgagacccgcgagagaggtgccacgagcccacaatgagcctctgagaaagagaagtggtcccactataaattgagttccccgagcacgccacttgggaaagagccactatgagaaagggcttgcccacttctattttatcctcctcccctcgagagttcttcgcttatgagaaagttagaaatggctgagaagagagccccacgtttgaattgggaaagctcactggagcttcactggtgaaggccgctagtttctggaaaagcccacctcggggaacgagacacacggtgctataagttgaaacgaggctgatggaatatgaaccccccgtcccagaaatctgttttaagttccgacttccaatagtggccaattaaaagtgctatttgtga

SEQ ID NO: 556048 - DNA, 992 bp, Homo sapiens
  misc_feature (19)..(19): n is a, c, g, or t
  misc_feature (67)..(67): n is a, c, g, or t
  misc_feature (78)..(78): n is a, c, g, or t
  misc_feature (235)..(235): n is a, c, g, or t
  misc_feature (246)..(246): n is a, c, g, or t
  misc_feature (259)..(259): n is a, c, g, or t
  misc_feature (281)..(281): n is a, c, g, or t
  misc_feature (288)..(288): n is a, c, g, or t
  misc_feature (314)..(314): n is a, c, g, or t
  misc_feature (338)..(338): n is a, c, g, or t
  misc_feature (343)..(343): n is a, c, g, or t
  misc_feature (345)..(347): n is a, c, g, or t
  misc_feature (371)..(371): n is a, c, g, or t
  misc_feature (373)..(373): n is a, c, g, or t
  misc_feature (387)..(387): n is a, c, g, or t
  misc_feature (391)..(391): n is a, c, g, or t
  misc_feature (409)..(409): n is a, c, g, or t
  misc_feature (417)..(417): n is a, c, g, or t
  misc_feature (423)..(423): n is a, c, g, or t
  misc_feature (445)..(445): n is a, c, g, or t
  misc_feature (453)..(453): n is a, c, g, or t
  misc_feature (468)..(468): n is a, c, g, or t
  misc_feature (499)..(499): n is a, c, g, or t
  misc_feature (547)..(548): n is a, c, g, or t
  misc_feature (561)..(561): n is a, c, g, or t
  misc_feature (563)..(563): n is a, c, g, or t
  misc_feature (566)..(566): n is a, c, g, or t
  misc_feature (669)..(669): n is a, c, g, or t
  misc_feature (779)..(779): n is a, c, g, or t
  misc_feature (816)..(816): n is a, c, g, or t
  misc_feature (908)..(908): n is a, c, g, or t
  misc_feature (932)..(932): n is a, c, g, or t
  misc_feature (978)..(978): n is a, c, g, or t
gcaagacacctcatgagcnccagggcggcgatgtcctttcacgagagcaacaccaaagacttcaaanacattccagtnacaaacagaacaattcacttaggacattcacctgcctctcccagagcccccaatctaatgccgggggccacagagaagggaagggggcagggggcctttcgtggaccagggggcctgcccccagttttctcatgcacacaacagtgcaataccaagncggggactttngaccaagtataanaccacagagagggccaagatgngcaaggntgggggggggatgggaacacaaaggngcacgcagccacagatacacaatnggccntnnngggggggggcatctggcgggggtngnctccaatccaattngtcntcccggggggctctgggngggggggncggggnggcgggggcgaaggccatgggngggggggnatgggatccccgacntgggccaggggagcggagcagggcttcgagngggaaggcactctgtgtcaagggagtagatgcacagggctcagcgggnngggttctcactgngntcnaggctgcgcctttccaggttggcacaagacaaagggcagaggaatgctccccgccttgccgggcacagtgttagaaaggaaattcaagatccctactgcccanccagccacacaagaacagcacgaggatgaggtagcccctactgggcatctgcagagaggacaagacagggggcacagacacaatcaaaagcccaggggaaaaggcttganggtatgaagtcgacctctccaagtggtattgccacangcacagcggctccctttccatcttgagtcttcttccttctgctcctggccacccccttccccacctataccttcttctccctgatgtggggnaactgatctctccccagtgcctanttccattttgaaagtctgtcttcttttcttccccacctcctactgnctcattgtgtcttt

SEQ ID NO: 556049 - DNA, 737 bp, Homo sapiens
  misc_feature (9)..(9): n is a, c, g, or t
ctatgagcngcggggcagaagaacgatgtaactcgctggtgctgcgtgagcacggtggccgtcggactaatcctagcactccgcactcaggcacctgagacaagaactctctgagcgagtgtgtggagccaggcctcttgtgtagacaagcactgcatcgtgtacgcaggtgacactaggtccttgcccaccgatatacacctgcttttcgagcagataatatccgagaactacagcctgggaagtgggcaggcaccctgaatacgtttgcgccattcttgcccaagctaggcgaccggctcccctaaatcaaaaggatcttgacagccaagagtgccagcttattcaccatctacttaacaggtgacatgtaaaaaggcgggaacagccctagccttatctgatggtatatactaggtccgatattcctccgggggggtcctggactcaaaggaaaattctcaagccgtggggcctctgtcgccatgcatggcttgaaaagggaaaattaactcccccaggcgccaaagcaaacacgatggtgaatggaaactgttggaggtgggatattcaaataccggagctatgaaaagaacctcccctttgtggcaaacctatatcctcaagaaataataaaccgttttaaaggggcgcgccccaagtgggtgtttcaaaaaaaatccgaattttcacaattcaaaaaattgggcgcccattgggcaataatctaccaactg

SEQ ID NO: 556050 - DNA, 1804 bp, Homo sapiens
  misc_feature (593)..(593): n is a, c, g, or t
atccaagataaggaaggtactccgtccgtgtagctagcagagtgttgatcttttgaccgggataagacgagactgtgaagatggctcgtagccatgtctgactagcaacatccagaatgagtccaccgttgcacctgggtgctctgatttaaaagtgggatgcaggatcattcgtgaatgacctctgactggtaaagacggagtcgactctcagtcatgctggcatgcgcgcgacgtgcatgcgctagttgcagcacctcggtcgcaaaggcaagaggaatcgcaataggcacaaaggaatagggcaatcccatcgccatagactcgaggcgatgaggcgtgtgagtccttcttggcttgggtggaaagagccagccatcgagtacagggcaattgcgacacggccacaccccatggtttgctagggagctataccaaagctagtccgctgaggccacagatgcaagttcgcctacgcaccgtgattgacccgtaggggctcgcttgcactgatcactacctaagcacggcgcatcgggcacgaatacgctcaccagatgcataatacacgctcggagacaacggcaagccancatttagagacctaaggcgtatcacagagcacggcgtaatagtcacgttaaccttctgtcacatgctatgcgcaaagccccaagatgtttggaatcagacgcacgatttgtgcgagccacatcggacacaacagaggcgggatacgaagcatatccccaaaagcatcacaaagggggacaagcggtgccggattttctaccacagattgcaccgtatgggaggctccgacggtagaatagaaaacggagggtaatggacatacagtaatagatagctggataggtagtggaacatggagcacattcgctcggtgaggggattaaacgaacttgggcagaagccagaccatgtcttcgccaagttggttcctttgggggaaaacgtgaaaaggcaaaataagggagagttcacgcaagatgtgaaatacgacggtcatagtttcaaaataaaaccccaccttataggcccgagatctgcactaggttagttttgcgcccgcaatcgcacgttactcacctaaatcataaaagcgaacgcctctgtggggacacttacgcgcatacggcaaccgtgtgccgtattacactgacgcatggacaacttgggaattaccgaccccatgggagcaatcctaacggagtcctcaacaaatcgcaacaccgctacacttttagaggcatttgagctttaccaagtataacagtgtttgaaagacacgagtcacacgcacttttgtgcgaacatctaccaccggcgaataatcttgccacgccaccaaaccatggcgtgtgccacaacggcggtgcagcacgacgagcgacaggaatacaccaagagtaaaacgatactcaggggacaaacggcagaacaaaatcaccagcccgaccacacatggggacagcgcacaagacaccaccggacacagcagtagcgcttgaggcaacctgcgcgacaccaagtgcaccacttagctaaaacagcacccactaacagcagccctggccacaacacacgagactgcaacgagacgacacacaccactagcccagcagagacgcggtaacgcacacagcaatcagcacaggaaacacacgcacaacggacccacaactccacctgtcactcacccaatgcacgtacgcacagcgcacaacagcaacaacgatggggaacaacgcagccgcgagacctgcacagccatgagacacaa

SEQ ID NO: 556051 - DNA, 420 bp, Homo sapiens
  misc_feature (402)..(402): n is a, c, g, or t
  misc_feature (407)..(407): n is a, c, g, or t
tgcaggatgctgagagcagtgacccttcaatattgggccccaggaacctcagcttgctcctgtccctgctgataagctcatgcctgtaggccaagatctacttctgctcctgagtggctactgaccccgactggaagcactgcacataaattctgccctctcagtccacatctggcgacgatcgagcaagacgtcatcacccaacaggctctggctgaaagcagctggcaactgcaaaccctaagagcagctgcggacatagatttgaactgaagcatagtcaagttattgtcagccctgatatcctcattgccaactatcctcatgaccaggactgttccctgctagtagccacactgctttggaggcattcccaagcaatgtccagaacatcccttctgngactngcaggtgctcagc

SEQ ID NO: 556052 - DNA, 103 bp, Homo sapiens
ttctcgaggatttctgagcttacatcagctagcctacccataggaggatgcccaaagcatcacccgtaaatccctaaagtccactctaaaaacatcgtattat

SEQ ID NO: 556053 - DNA, 1103 bp, Homo sapiens
ttcgggaagtgaaagtaactgtgaaacagtgcttcataaggcgtggcatacaaggccttggtattccaacagccaggcgaggatgaggcccagatcccacactccactcgcaggcacccattgaataagatgtcctcactgggtgaccaaaactggtggtaacatagccaaggttacttttacttgggtaggatgactgccagaaggcactggctacacagagctatccagaccttacacatgacgtcgtgctctccagaggatgcgccaggtgtatcagataagcatgcacacaagacaggtgtgcgcccacacccaccctgggctgggcagcaagaggtcatagctcaccatacatgccacccagacttcctcagcctccttcccacacatccgaatcttcaagccggatgaacaagagaccacagccccctcgcacgcacgacctacggacgccgcaccacgaacgcatgctcctgctacacaccaagcccacccccctccgacccggcgggccagcatccccccgacgggcgacagcccgcgccccaccctactgccccaaacacctgcccgactcacaacaaagatgtacagacaccacccccaccatcacaaatgaacaccccctcacggctcccccacctccaagcacgcacgccgccaacagcacaacaggccacccccactcacctcctaccacgtcgacaagcaactggcacacatcacacccgcacacccaccaccaggccgcaacacccaccaccacccccacagcacacacaccgccctacccccacacagagaacatcccaccagcgcaaaagaccagaacacaacccccacccaaaccacacacaccaccacacaaccagaagcacacgatcgacccaaccggcacaccacccactcacagtgccgccaagacacgcccgaacccccccccgcacgaccaaaagcagaacgaagaagaaaaaccagacaccgcccacgaacgacaaaacacccgccagaaacaacaaaaaccaacagcgggacagcacacaacagacgaccgagagacacacaacaacgcacagacaccagaccacacgccgcagcca

SEQ ID NO: 556054 - DNA, 211 bp, Homo sapiens
cacacacacacacacacacacacacacacactgggtattttagaatcctgtgctaataaaattactctgaaagtatttctcctctgtacaaagttaacttgctcatagtgatgataaactcctgccagtgcctagccctagcagtgctgaggagtgcaggtgatcccacaaaagagtactgtttcagtctccagccaatggaaacaacaga

SEQ ID NO: 556055 - DNA, 212 bp, Homo sapiens
agccggcgcctggtggtcttgcacactggctggtgggacacggcaggagcatcactcacattcaaaagaagccacttgagggcagtcaaggaaatgccggacgtgcgctcaggcagggcacacgtggagctatgctagatgggcaccagggaccactactctaagcaagctgacgcaggctgggaggcggtttccaaaggcatccactgcat

SEQ ID NO: 556056 - DNA, 401 bp, Homo sapiens
gtagtctacgaggatcccggtgttcccttgtctggctatgagtacgaatgaatatacacacgcatatgtctctatagagaatgatttatatgcctgtggggtagtatatccaggtaataggacggctgggtcaaatgatatttctggttctagatccttgaggaatcgccactctggtctatccacaagtggttgaactaacttacgttcccagcaacagtgtaaaagcattccgtatgtctccacaggcttgccagcttctatagtttcttgactttttaataattgtcatttctgactcgcatgagatggtatctcatggtggtttggattggcatttctctaatgatcagtgattagctgttgaggtctggttttattttaggagagaaagggaaaca

SEQ ID NO: 556057 - DNA, 330 bp, Homo sapiens
agatactgtgctcgaagtagaggttttactctactcatcactgcgatttgcacattgctccgtggacactcggaggcctgcgttctgatccctataaatggaagcgtgctctgagcctgtctgcctccctcggctgctgctggtcctcagtaccagcgcccgggggtgtccacaaccacttgggacagatgattgtggattttcagacttatgcttgactgggtctttcaatgacaggcttggcttatctgtggcccagacatttgttatgcccagaattgctatttatgttgctttgtaggctctataggatcctcattgtctttgctt

SEQ ID NO: 556058 - DNA, 999 bp, Homo sapiens
gagtaagatcgagcgaggagcccaagagcgagcgcgcagaagaagctcgagcgcctccgcgcgcgacccaacctcggccgcgcgctggccggaaatccgcccgggctccccgagaaggagccccgccgccgggacaaccagcggggataaccgcgaccaaccgacaacggaaggcgcctggagcgaagagcagaggaggcgggagccatgagttgaggcggggcgaagggcatccaacaacaaacaacaaacaaacccttccccgccaggactcccgaagggaggcacaccaagacgcggtcgcctccaaagtgaccccggcgcccaaaagacccggagtggagcacgcggtatgcacccccagagggggggcgcacccccgggacacccgccgggcccacatcgaacggcgaagaaaaaacccccggagtggacagtacacgccacgacccctatcggagacgacacacagagggacagaccggtgcgagcacgcccacacattgtatataagcacgcccagcaacgaccgggacggaagacacgcgcgcgacaaacgaaagaatgtctcgcgcgacagcacagcaaacgtcctcgtgtgcaagtgcgtacacaaagacgtgccacaggcgtcacagaagagccaactcgcctctacataccaccagacccgcacccaaaaaggaaggagctagctaggccgcaaccacagaagcgggcgccacacagaagaaagccctagcgccacgagcaactattgtcgcgaccaggacgcacgaagacagtacacaacctagacaacaatggtaagtagtgagcagcacgaagcgagagcgggagccaccagctgcaatgggcaccggcacggagtggaactcgtgtggcaaaggtacagggccacgacagagcggtcgccggccaatagcaccgtggagaaacagtgaccgggcggcgctgccacccccaggaggcgggcaacatcgcgccagaggtcggacc

SEQ ID NO: 556059 - DNA, 1439 bp, Homo sapiens
  misc_feature (360)..(360): n is a, c, g, or t
  misc_feature (642)..(642): n is a, c, g, or t
  misc_feature (1179)..(1179): n is a, c, g, or t
  misc_feature (1437)..(1437): n is a, c, g, or t
gcaagccgaacatctctggccccagatcctcatcctcgaggtggccaactctcagattgtcatagaataatgcaactatcttaatcctcggcactcggtgctcggcggtcccagatgctcatattcacacgcatgcttggtacgttcgcacatgcattctgggtcctatgtggccatggcagccactcaaaggtcagaaaagtgatagatgcatgagtggccccaagaaccgttgtaggattgcccaatacccaatgcttgtagacccaggcgttgaggtaccaagatcgcttcgtggagatggagatcatttgcaggacccaggaggcatccctttaggattgcgagtaagtatgcacncacgaactactatgcacgcgcaagctcttggtacactgcattcggtcacccaattcaagaggtagatggccaaggttggcgtccaacttaccgctttcaccaacgggttgcattacgggtgtttcaccttaggcaacagtaacgccactgcaagggaaggttaacccagagcttcccttgcctaggattcctttccccaaggtttacaagcacaaggagcctattagaggcacgttggcaccacggcttaccccctgtttggtttcgggttatcgatacgcnggaggttcactagcaaattagtgcgggcagcaaaaacgcaacctctttggaattgggaccgccacgccacacggggggggacctttctcaacatcaatggcggtcacgaaaaggaaacccttttcccccaatttttttccccaacggaggttatttccccccccccagggggcgcggcaaccagaggcggcgcggcaaacggccccccctattatgtgtgccgccgcccccgaaaggacccccaaaagcgtcaggcggccaaagcgcaaccccgacgggccattgcccatttcccccgtttgaattgtcccccttgaccacacacttacaggtgagttgcggcgcgcaggcagaagacttatactacggagtgtacatatcacccccccaaacgagggagaaaaactctcgctgcgctgtacgaggcattcaggtatacgcacgagcagattacgcggggcaccttacccttttttgcacattatctcatccaggggcgcgacaaacccacaagtgctccccctcctttgaggttanaaccaccaagataggcgcgacccaacttttaacattaccagtttcccaccaaagagaggattgagagacaattaccggccaaactttcccctgtggggcactttgcgccccttctgggccaacacgcgggtcaaatttatacactggaaacgccactatttggcagcacactgcgacacattttaaacagacgggacaccccgtatatttaacccctttatagatagggagggagcgccccccccccccccgcagggnaa

SEQ ID NO: 556060 - DNA, 934 bp, Homo sapiens
gatattagcagcggttattcggtgagcgggtggtggtttattcttccgtgaagattatgtggctccgaggacatctctagtgtcttcagagttcttcctaagtctggaaatatttaatgttcataaaacatgttctcgaatatatgactcccaggaaccaactatattttctcccaggaagagatccgacgttataccaaagttggagatgatgccgatgggaagcgtcattggcactactgcgaagcaccgtgctattgggcaattttagcaaactgtatggtgttcttgcttgtcagagagcagagaactgcaatggtccgactatgcttctctgtatgagagtctttaagcgctggaagaatgatttaggaaactccaatgcaggacatggcttgctagtgtggcgtggcattccttctgctgctaatgttctgactaattgacactatacggctctcttgctctaaatgcgtgatttattccagctactcgggatgccatgtacctctggtgatgctggttggattactgcgcgtgtgtgttatctagcacatcgttgtacgacatattttggatcgacccccgtgccctttgttgtgttcattgcgtgttcgattgggtgtgataggcgctatggctgccatgcttctctcgggtaggtggccctaggtggtgccttactgcgggggttggcccgtcctgttgcattggggatttaatagcgccgcgggtgtgtctactgttggaccagactatcatccgcggcacagcttgtagcccgagtgcttgcacggcgagtgtaaatacccgttgttgttacccccgctgggattggcagggcccaacaggggagggggaggcggggctccaccaaaggggggccgcacaacgacacacctgctggagaaacaccagaagggcatctggcccg

SEQ ID NO: 556061 - DNA, 116 bp, Homo sapiens
  misc_feature (3)..(3): n is a, c, g, or t
ccntagaggtatgtaacatgatagtaaatagcagtctatcaaaggagttactaggtttccctaggtctctagattcctatgcttatgtagagtattaagagcaaattgagtgggat

SEQ ID NO: 556062 - DNA, 591 bp, Homo sapiens
ttgcgagaattgcttgaacccgggagcggaggttgtggtgagccgagatcgccattgcactccagcttgggtgacaagagcgaaattccatctcaaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagaccagcctgggcaatgtagtgaaaccctgtctacaaaaaatacaaaaattagctgggcgtgctggcgtgtgcctgtagttccagctactcgggaaactgaggtggaaggatcacctgagccctggaggttgaggctgcagtgagccatgatcatgctactggactctggcctgggtaatagagtgagatcatgtctca

SEQ ID NO: 556063 - DNA, 937 bp, Homo sapiens
ctccgtacttcctcagttgtaccctagttctaatcgcatatggcattccataattgctttacacgaacgagaaaattcataggctatatacaactacacgaaggcccacaatcattgtaggcccgtacgggctactaaaaccgcttcggtgaggcctataagaacatctgcaccaaggaagccccataaagacgcaacctgcacaattcgtaccaatcactccgtctaacagttacaccggacacccagagacatgtatgacttcatcaaccaatccgcgtcttgccgtactagtgaaacccaagcttcaccattacctgagacctgcgcttgtgtctagatcgtgcccacgatatcgtgcttccgtattggcattatcataggacaaaccctgaggtgctgagctcgggtggacgtgtaggatcatcctggatcaacggctaaaacagttaaaatgtcaagaagtattgaccatgattcgggcgcaaatgggaggagcagccacaaaaataattctctatgatggagagtcaaccttaagccgatgctattctaactatctaagcgataaaaaatgaagtggagtcggatccgttgaaaaccgtcatctcaacacgcgttatcggacaaggacaaggaactatctcagattacgtcgcatgggagtacaatgatgccatggtccagtaaattatgggttgaaatcgttcccactatcatatgtcatgagagtcgaagacgtataactgggtatcagaactagctagaagaggagaagttacagaactaaatcgtcaaagtctttaaaactctcgaaaatacgtctgtaaggcgccaaaacggacctagttatttatatggcggaataaacaaaatgtgattataagggaagatatgaccttagcaaatataattttttcctaggaaggttatttaa

SEQ ID NO: 556064 - DNA, 282 bp, Homo sapiens
ttgtctttaggcatagttggctggcaatggtggtgaaatgcgagcaattaatctttagatgaggaatggccttcctttaaccagttgaagggtaccatctggcacgattcaaaaacttgtagtgtattagtgtgggaatcctccaagttcaagtaaagtttcaggtattttatcatagcaccgactgagtgataggtgtcggaggtagttgacctggaaaaattcctgaaagcagtcattctttagcatgacattatcacttaagtctagatggacaagatt

SEQ ID NO: 556065 - DNA, 126 bp, Homo sapiens
cgaatcgcagctcggtccctccttccttccttcctttctttctttcttcctcccgtccttccttccttccatctctttaggaacgggactcctctacgacgtcgaccctgaggcatgaacgctggg

SEQ ID NO: 556066 - DNA, 218 bp, Homo sapiens
tagaatcgagctcgtgtaccttgaacattcgtgtcataagtaaaaaccctcacactacaatcttcctaggaacaacatatgacgcacgtctcccctgtaactctacacaacaatatttgtgtcaccaagaccctagcttctaacctccctggttcttatgatattcgaacagaatacccccggatttccgtctactaccagagacacgaattgttcag

SEQ ID NO: 556067 - DNA, 329 bp, Homo sapiens
tccagatttctggtggacacatccactctgaccatcatcgcgaccgacactcgtatgggagcttactatttctgtcaggcgtcgcacgacaccactgttggtgtacggcgtgtgtacccagctgaccgtcctgggatcacgcccaaggctgccccctcggtcagctctgttcccgccctcctctgaggagcttcagccaacaaggccacactggtgtgtctcataagtcacttctacccgggatccgtgactgtgagactccttggcggatagcagccccgtcaaggcgggagtggagaccaccacaccctccaaaccaagcaacccct

SEQ ID NO: 556068 - DNA, 213 bp, Homo sapiens
cgcccccgtcctatgatgcaaacatggttggtccgccgcggatcccgggaggtcgccatattgattgcgaagtttgtgcggacacccgagtcggacataagcgcgactacatgtcgcaaaactcctggggtcaagcgatcctcccagcttggcctcccaaagtggtgggattacaggtgtgagccaacgcccgcggcctatcgagtgagactg

SEQ ID NO: 556069 - DNA, 374 bp, Homo sapiens
tacgaggctgagaatcaccacaacatacatgaatgggaagcctccctttgattcatccatttgtggtgacagtgctgctgatgtgtctcagtcaatacaaattggacaaaaatcacaaactacggcgataacgaacacgaagatgaacataaaatattactccctgctggtgcacggccttgtcgtcacacctcttgtgtccaagatctcaagtccttcagataaaaagattctagctatgaacaagtcttgtccaaacactggaagatacacagaccaactgttgaaacacaacgttggtgatttggtgtgggccatagtgtccggttacccttggagggcttgcatggattctgcagatatactccttcaca

SEQ ID NO: 556070 - DNA, 423 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (406)..(406): n is a, c, g, or t
cccaattngncntgcaacagcaaaactaacattaattttttcttcttcttcacaatttcatgggtagatttgttcttaccgtagatcttagcaacctcagcatatgagttttttcttttgagaactttcaccttttctcttaaagaaagcactttacagcttctctttggcatatctcaactgccagcatcactgctcttgaactttggggccattattaagtcagaaaagggttacttcaaaacaagcactgagataccaccagagtccatctgataactaagatggtaactacatgactaacaggccggtgacgtatagagcatggatatgctggacaaaggggtgagtcatatcccaggtaggatgaagcagggtgacttgagatttcactattcagtacggngcacaatttaaaactta

SEQ ID NO: 556071 - DNA, 987 bp, Homo sapiens
gaaagattaaataatgctactctacataagataatactgtgtctatgaacctcaacggagtgactgtacccaagaccgtatagatctattgatcggaataccatgaaaagcaatgcaaaaacctagaaaagactaatacctttctggggctgcccaaaactgtatcagcactgcttcaggatgatccaacacttacccaggtcgttgcaagagcagcgatgatagtttactttaaagaaatatatcttgccttgtctccgttccttcaaaggcatgcacctttgctttgaacaaattagtcctcaacttcagcctctgattgttctcctggtttcccaaccgcgtagaaagtagcattaacatcctacaaatattaaggagagttagtagacacgcaaatcgtgagcactaattctataaaatatcacttttgggacaatttggtaatccaaaatctctcctttcattctgtcagggtacctgtcccttgttcagatgatgataccctaactcgtaaacctgtgcggttcacaagggactgacgtgtccttgaccaagacaccagtaggtattcaaaaggttgaggtaattagtagtgtaccctacctatgctcttcaggggacgctaatcaactgtaagcagtaaaagcagaattattgagatcagagcaatgaagtaatcgctgcacacgtgaaactgatgaccaaagagatgcacctgtccacaaaatgcgttcaatgtacgcactgaggcagggattcgccagaaggggcagattcccacgtggacgatgcagaggacaacggggtgccaccaagaccagagggacaaaccccacggggggacacttacggaggacgatgaacaaccgggggcaaaggaaggaagaaaggaaggacgcatccaaggaggaaagcccagagaaaagcggaagaaacagcgaaagaaacaaaaaggagaaaacacaaaagaaggacaaaacacaa

SEQ ID NO: 556072 - DNA, 1004 bp, Homo sapiens
cacgcgtcggacggcgatgggacggtcgccgcaaatccagctgctgctgccggtgggtgtggtggcggagcggcggtgactgaggattgaagagccacagcacgaggagctgcaggcctggacagccagtggcgccagatagaaaactgggagagtgggcgagaacgtccactgcgggccggcgaaagcgtggttccttgtggagaagcactggtataacgcagtgggaggcatacgtgcagtgaggggaccaggactccagcaccttccctggctgcatcaacaatgccacactctttcaagatgagataaactggcgcctcaaggaaggacctggtggaaggcgcaagactatgtgtcgcgcgctcccacagagtgtgcgtgctatcacctgcatcatgctgagttgatggttctaagagcatggccagccaaccattgaacgcacggtcatagaagcctgcccaacatccagaaggtcgaagtgtacccagtagaactggctgcttgtccggcacaatgattggggcacatctcacacctgttcagttcagccataccgattctatggcctagttattgcgcacagctcgggagcggtactgcttggagcccaggacgacactcggctttggggcacagaactccggaaggctctaggataggtggtatgacacaacactccacgggtcctcgatggcgggccctgagactggcagtgatcaccatgagacccgcagacgagtgcgatgtcccggcgaaagctggatgtgttatgaacacacattcgaacagggaagcccacaggcacgacggactgggcacccaatatcggtgcacagcactgcacccgccggaccgccacatggacggccgcggcaccacaaaccgcgggaaaccagaacaaggcacgtgccacgcaacactgaagagccccgctcacagaaggggctaacacaacacgcaagaacacacagaagcaacgcacctaccgttcctaattg

SEQ ID NO: 556073 - DNA, 327 bp, Homo sapiens
  misc_feature (247)..(247): n is a, c, g, or t
tctctgcacagtgggatcctctcatgaatacagctgtcttgtatacggactgagatgcgggcttccgttcaatcctctccttagtgacgtatcaacaggctcgtggcatctctttctgcaaaggcacctgaatgtgtctgcgtccctgttagcataatgtgaggaggtggagagaccagcccaaccccgtgtccaccgtgacccctgttcccatgctgacttgtgtttcctccccagtcatctttcntgttccagagaggtggggctggatgtctccatctctgtctcaactttatgtgcactgagccacaacttctaataaaaggt

SEQ ID NO: 556074 - DNA, 516 bp, Homo sapiens
aacatggtgtagtcggttgttgcacccggtggtgccgctcgtctgtttttggcggtcactcgcagtcccctgtggcgcgcgtggggtggggcgcctgctttggggtgctgccctctcttgtaggggcaattgcctaactgcttgatacatcttatcacgctgcctttatgcactgaatcctgcgtatggtgttgtgcgccgcgtctcttggcatggagctcggcacattttgcattaatgtaggacacttaatattcattccctcacttttattgcgaaacaccatttgtctgcttttcactcctctcccagtaaaaacctcgtcaacatcactggtctcccccactctccctattcgatatccaccgccgttgatatcaaaggaatgatattcacaggggctattcatttttctcagcatcttattattttgttcatctgatagtgcaagacttcttttgccattcattagacataaacacgcgatctcagaaagaccctgaacgcgacaaaaca

SEQ ID NO: 556075 - DNA, 830 bp, Homo sapiens
  misc_feature (342)..(342): n is a, c, g, or t
ctttggtctcctttacatttgcttcttctgcttcaattttttgaagcatattacctccggaggagttctctgctctgcaagacccagagggaggaagagtttgccagcccgggatggaggcttcaccctggaagacatctagcatgctgagacgaaaggaccgtggcagcaccagctcagccttggcatgcgaccttctccctggtcatggagtagttccccaggagccacatgggcagcttccacctcatgaggcctgtgtggagctcggtcccagcgagtgtagcgcctaactccaggctacgcttggcaggcaatgcagcctaagtctatcctcttccnactagagctgtcctcctgtggataccggccgacgagacctctctagcaggacccgcttgccttcccgagcaggggctggcggaagccaaggtcttccagctccctacttcctaccaaacctagttctagattaacttttgtcatggattggggtacgcagtccccatgcgaggtccccaatagccagggcattgttaagccctcctgaagttgaatcagaggagacatcggcttgcaaggaggtgctgcgtcacgcactctcttggcttgcgttacatgcaacacgacgtggggcttcgggcgagaagccccgcagtccttccggggccattcgggggcgctgctggagcaatgttgcccgtggtgttgggactccggagcatcatgcagtaaatgcctggtgaatgaagccagtcgccatgacagttttcctgctccctctctcaggctgaagcccttagcagagaatcaatagccatgcccatggc

SEQ ID NO: 556076 - DNA, 236 bp, Homo sapiens
tatggaaattaaggaaagcacaaaaatataagaataatgcccttataaagaagtcattatatgaaaaagatacttgcacacgcatggtgtatagcggcacaattcgcaatggcaaaaatgtggaaccaacccaaatacccatcaatcaacgagttaataaagaaactgtggcatatgtatacgatggaatattactcagccataaaaaggaatgaattaatggcattcgcagtgac

SEQ ID NO: 556077 - DNA, 254 bp, Homo sapiens
ccgcctcagccccgggtagctgggactacaggtgtgcacgagcacacccggataaatctttgtatttttggtagacagaaggtctcaccatgttgcccaggatggtctcgaactcctgggctcaagcgacctacctacctcggcctcacaaagtgtgcacattgtaataacgtgatttcatatctggagaatcagcaaccaaccagccaagcatgttgcttatataagagagagctgagaaagcaaaggttggt

SEQ ID NO: 556078 - DNA, 301 bp, Homo sapiens
aacggtgtggctgtgcaccttactcgagaggaatggggatacctggacctgttcgagggaccgctacaggagaagtgagtgtaccagaattatggtcaatcgtggtctcactgggtaaggacttccttattattcgggtttatctattttgaatttctttactctcttgtatcgtcctaactataaggtctctgagaaggtctgtccagtgtggcttacattccaggacttaaaacctctgaatcctttatctttcacatccgtactggcccgggggatgctctagagtctcacctgaaag

SEQ ID NO: 556079 - DNA, 1119 bp, Homo sapiens
  misc_feature (470)..(470): n is a, c, g, or t
tggggggacttctggtttttattcctaggatatcttgatacttctcattattttcacaatctgcttgggaaggaaaaggtatggtagaaaactgtggacattcctgtgttctcccactgtgcaagggcgtggaacatgtggttagggatacccagcttgttgacaggacgtggcaaggcaacaagatgcctttgtgccgtggcgtaggattacagccaacagccctttgggcctgaattcacctcctcaagggggaggtcctccatgtggaattgaccagtgatttcccaacatgtggccaagaaaacccattttattcccactcagtggggcaagattgatcagagagagctgcactttttccctcccgagttaacctcaaaactgaagtagggccgagacagaggcccactaatagaggtacctatgcagagaaaccgtctgcagaggtgttgaccacctcttcgtgntccacgttcgctacaaaggagacacctccaccgagcaatcatagtccgagagaaaaatatccccaacccgtcgtggaagccgggggtctccgcagggggttagggcacgccatcgggggcagcgtacaagacgcccaattatcctttcgcccattaccacccaaagatcacctgccacagaaaatccaattctgcggcgcgcgcttcgagagtctactccacccttttttctggcacacttgactctctcacacaagaccccctactgggcccacctaggggccttatactcctccccacccttttataccctccccacatcaatggtcctcccccgcgcgaactacacgctgtgggaagacgccccaaaaaacggcgcgaccccgcaacacgagcaacgtcgctggtttgccccccagaaaggtcttcctccccgggccttcacacccccgacaccgaaccagtccccgaacggcacagccgtcaaaacgccacacgacccacggggccccacaacaagcgcgccgcccagaaaccacgccccaatagagccagctcgcattcgggcacgggttgaaacgccccatacctatcaggcaccccctactggacgacgagacacctgtctccagacgcgcgcacacacgtg

SEQ ID NO: 556080 - DNA, 391 bp, Homo sapiens
cagagggagaggtgggcacatcttgcgtgtgggctacttagctgtcctaccttgggcttcagagtgtccgaagcgacggggccaaagtggatgcccagcacagcacagctcctctaccaaaaggtggtgagatggcttttttaagtgaatccctaatcccattcctccctacgggatgggacctcccaaccagggtctccagccacctacaggtgccttcaggctggcaactggcccctgtctccctgggacaggctgccatcttggccgtttggcagccgtcacttgtgacacctccaggtactggaaaatccaaagtgactagggacgggaacaggccccaggcataccacagcagctcgcccctgagttagcagctcgcccctgagtg

SEQ ID NO: 556081 - DNA, 240 bp, Homo sapiens
attcccagagtcacagagttgacaggagatcctggtcactcatgggtcaggcctcagtcactggtttcccagtggaggctggacgtgaccccggctggaacccaaaggggcagacaggaatgggcaggagaatggagctgctttcccccaggccactgagaccccacagcttgtagctgggtcgcagtgtagacaggagacggttgtctgcagcaccacaggcctggggtgaggagtcct

SEQ ID NO: 556082 - DNA, 1133 bp, Homo sapiens
gacaaccgacactcaatgccgatgggtacttctcacccgtagcccacaggaactcagcacattgcctgtcctctacctgtgcgagttctgcctcaagtacggccgtagtctcaagtgctcttcagcgtcattgaccaagtgtgacctacgacatccatccaggcaatgagatttaccagccaagggcaaccaatcatccattcatttgagatcgatggacgtaagaacaagagtcattcccagaacctgtgtctttaggcacaagtgtctcctataaccataagacactgtactatgacacagcacccttatactcttactacgtcatgacagagtatgactgtacacgggcttccacatcgtgggctactacctccaaggagacagaatcaacggacagactacacacagtggcctgcatcctaaccctgaactccctaccagacgccggggctacggcacgctgactgatcgacgtaacacatcatgaaactctccacaagaggacagggcacacaccagggcacccatgaagaagcccctctaccagcacacattgggacacactatcctatcgaacagctcacggtcaccaagaccaccccggagaatcctgaatggaggcatgaagtacgcacagacggacaacaggaccacagacccacccaacaacagcgatcaggcacaacaacagcatagacaaacgaggcatcagacatccaacacgacaaacacacaccaaacgaaccacaacaacaagagcagacaagccacaccaggcaaagagaaacacagggaagagccaaagccgcggccacccgacacacccagacacaccacagccccacacgcagtgtacacaccaacagccggagcaacaacaaggcgaacagacgacacaaccacaggccccgaacaggcaaaccagcccaccgcacggcagaagaaaaacccgacgcacgaacacacacaaccaccacggcacggaggagcagacagacgacaaacgaaacaacccagccgacacacgcagaccgcagcaccgccaaccaccaacaacgccaccaacgacaagagaacaaaaaacagaagaagcgccgcacgactaccacaacccagcagctcgcacaacg

SEQ ID NO: 556083 - DNA, 232 bp, Homo sapiens
gctcgtggtgaccaagcgcgatcagccagggtggatgatgttgtgaagtcgatgtaccctccgttggaccccaagagccacccgaagagccccgcaaagagctccaccacgagccacgccaagagccgcacaacgagccacacaacgggccacccgaagagccacacaaagagccacccaacgagccccacgacgcgccacccgaagcgcaccccaggcgcctcacgatgag

SEQ ID NO: 556084 - DNA, 99 bp, Homo sapiens
catagtaggtactcaacaaataatagctgacaagtttgatagccagaaaacggaaagctgggatggaacccaagagtctgatccaagcttttacaatct

SEQ ID NO: 556085 - DNA, 269 bp, Homo sapiens
ccttctacgtctcatcactgaagcccgcatcctgtcactcccttgcttgcaactctccaatggcttcccactgctgttaaaacacaaaaaaatctagatctctttgctctgccctataagttaagtagggtggccctgtcatttactgaacaagcaggggaggtacctcgagagtcaaagggaatgctagaaacaattccgccagaacagggggtgtaaaccagggctgcccctgttcaaggccaccagcagtgatgagacgtagaagg

SEQ ID NO: 556086 - DNA, 204 bp, Homo sapiens
ctagcaggatcccatactatgcacagaacccggctggagtcctgtgacatggcctggggagctgggaaaggctgggaattctgtcaatattccctaggacttgcaggcttgagtgactggtgctgtctggagtaggcttcatgctcttgcgagcgaatctcaaccctgggtatcagggtttcgatgacacaagtactgcgccca

SEQ ID NO: 556087 - DNA, 877 bp, Homo sapiens
gggctgactctcttttcggactcagcccgcctgcacccaggtgaaataaagcagccttgtgctcacacaaagcctgttggtggtctcttcacacaaacgcgcatgaaatttggtgccatgactcggatcggggtacctcccttggggagatcaatccccagtcctcctgctctttgttccgtgagaaagatctacctaggacctcaggtcctcagtactgaccagcccaaggaacgtctcacccaatttcagaatctggaccccagctgaaagatcggactgttcaagctcatctgggaggcaactcccagagcccctgtgaactctggcccaagcctctctgacgtgactccttgcccagatctgtctcggctatacgcagctgaagacttgagcatctgtcccaagtcgccttggaaagccccctagaccatcacggatgccgagcttcgagtaacctctcacagtggagggaaggcgcatgacaaaagaccaaatcaaaacaagaaaaattcctttggtagcacgaataatctagccaaataaaaagggactttgtcttctgggactgaacttatatttaggttctcaaaaggctggcatctcaccagggctttcctgcaggcaaggtcctgggcggctacctaagctgatattttcggttcatcacattatttgaaggggggcctccgatttccctttactctttccctctgtaataatccttattagggttctaggcttaaataagggcaccgcctgagcctggcgcgcggtccacggccccgggattgtccccgttgcacagttgccgtacgggcaacccacacggtggagcccccggggcgccctggccggccccgccccggggccccgg

SEQ ID NO: 556088 - DNA, 121 bp, Homo sapiens
gaaagaggttaattggctcatagttctgcaggctgtacaaggaggcatggaataatctgcttctggggaggtcttaagagagctttatcaatacaagagggcaaaccgggataaggctctt

SEQ ID NO: 556089 - DNA, 152 bp, Homo sapiens
cgaggaaagtaaaaaacgcagcgtaaaccatatctggcctggcattggtggtttcatggtgctgacaggggacaatcccacacactgcacgaaaaaggggcctgctgcacaggcggaggtgttgaggtggggatgggcagccctgacgaggt

SEQ ID NO: 556090 - DNA, 1370 bp, Homo sapiens
  misc_feature (890)..(890): n is a, c, g, or t
gttccagggctcccactgcattctcaccattcatggtgcagttgtcatcaattcatttcacattcatcatcattcacacactctcttcaatcaatcagcacacatcacacagtgcaccaatcaacatgttccatgttccttgcaatccatcccgcacaacccatctcccgcagcccccaggtcccattgcacacaccacattagtctttccaccaaaactcagctctcatggtgcccaaacacaggttgtgggcactcactgcatcaacacacagttcacaatcagcagtcaattcacatttcacagggcctagagtcccttcatttccaacattcctctccacaggcatcagtttcccccactattccattacttattctttctatccagcagcccagcacttctttcaacacagcaatcagtctcatcatttagtcagtccgactcactaggcacagtctcaggttatctcgtaaccctcccactcattctcatcaaccttactccaggtcccgaaggtttacccattagcatctcaacttggtccagcatactagcatgcaagccactatatccagagcaactctaccatacgtatcagataaatacacgtatatcccaaaccctatcaccaaatcccatatctcctatgttcacaagccagcaccagcagcacagcttttctcacacatggtcaaaacagggtatatctgaaacagctcaattaaagttcgccaacctttaagctgcgatacaacttcgtgcgcattccacccttgacaaccacatggacggttacccatcaccatcctgggctaggcgcactaccaccgggacctcccaatcttcacatttaggaggttgtcccgggttgatggcgtaggtcgcntcagcatcttaatggtgggctaaactaaaacataccaaccgcggggtaacacacccacagtgcacaagacccaacgtcattgaaaacagcaaagagacgagccagaagggtacacagaactagcgacacacgccacaccaaacacggtaccacgccagcgacccccatgggctgccccaaacgggggcaacccactaccatcaccgtcaggccgtagacgaccagcagaccactgtcccccaagtgacctccacagagcaaagttacatgggaccagggggtacacactgagatcccaggcaactcaagcaacccgcaccaaccacgcgagcaacacagcagcccactgacaggcggcacaaggcaacacacggggcgcagacaacgaacacacgcaaccacaagcacaaacgacagcaacaccagacacacaacagacaaaccagcaccaaaagcacactacacacacagacacctcaa

SEQ ID NO: 556091 - DNA, 1252 bp, Homo sapiens
  misc_feature (239)..(239): n is a, c, g, or t
gcgtgcacagaataataggaaggggtaagactatctccctcaacagactgtctggcttgagtgatgggggtcacatggtggatcgagagcatcttatgtttaccaaactcccagtctagttgggcatgactcacatctgggtgacgcagggaagagtagacactgttgatgatcaatatgtgcaccatgtgactcactagacagcatgttgtactagtggcgcactacagatttgatgngatatcctatttctttcgcccaagtagtgtcaccaacgtgggcgtgtgacttccgtgggataccctcaacattgatcctgcaccgcatgggaatgctacgttcgttgcacgcatatagttcggccgcgaggcgcttaatcgagtctagcttgttttgccttgatgggaaaatcacctcgctccatattgcatagtttaccaagccgagcaaagtctgattttgacccgtgcacattttcctctgtgcgtaccgcgtactttcagaacagttaattcagggctagcctaacgtgggcccgtgtgttataactagccgattgcacctaagctcagggggcagagtccaccactcaagaacgggtcacgaacgtagaggggtcccttcagggggataatggccgtcgggagaaattggggcaaagtgcccacacttcggccagtctcttggagtcgacttcagagtctagcgccctgcgaaaggtcttcacacgacgaagagggagggtgctttcagtaaagtcttaagggccagcgagaacgcaatcattccggagctcaggttgttgacccaggcaaaggtgaaagctattacccaacgggtcaaagacgggcgagtaacggcgggtaaccccctgggggagaaattgcacttacaggctcccattttgcagggcgcccggctgcaaactcttggacaaccctgtgcacggaatctcccttagggcccgtccgcttagacccaatttggtagtatacgcgtcgataacgaggcaatggcacgcgcgcgtcggcatacagttggaggtcgagtgagggagctcgatcactatacctccgaagcgattgaaaaccaggcaccgtaattggttggccatagggcctgaggtgcaagggtacttgcggacaatgcgagggaagtctatgggatattggggtccacacatgaagggtgaaggcgtaatcgaggtgcaagaaaatcggcgtccccaggttaagtttaaggccccttggcg

SEQ ID NO: 556092 - DNA, 776 bp, Homo sapiens
gacatgtgtatgctcaaatcatacagttgatcttgtggcattttctatccccatcctgagtcatattcttagcattaactcaggagtgatctaaggggctcacgagtaatacagactttcctattgctcaattccaagaactttagaggaaccagcaacaaagcccagtcaaattctttattatacaacacctgtgaactccagaatacaagtgcgtaaaataaatcagcagcagcatcaagactagcatggtatcagcaagggagggctcagagaatccagatatcagactgccagcatcctgatcatctctaaaggttctcattcaattggtgaaacaatttaaagtaatcatttggaaagcgagtctaaaatcgtgagaggcaatcttatatgaagacttcgagaagaggtgtggatcagtgcgtgggggtgatcatagcccgtggtgaactcttcaaactaacgtgatactccttttgcagaacaaaagttcttgactgaagagaactagcagctacagtgataacaggagatcataaaatatatattctatagttataagtctgacaatgtaaactaaagcacatttctctgaaaatgcaagaagggagataatgcaagtaaaatagaatatatttactgatttgtcctatagggtattttcaggaaataaaagttattacttcatattagatgtctgggagaggacaataagagagatattcaaaattatttatagtagggagacaataggaatagtatccccaaaataa

SEQ ID NO: 556093 - DNA, 325 bp, Homo sapiens
ggtccatcacatcctcgtctcacgtttcacacagagtagagaccttccgaatcctgtgagcgctggtccctacaactggtgtctgtaaggactcgttgtatctcctctgagagtgagctggagggctctttctctagaatgaggggcaaggaagggcctgataccattgactggggtgaccagacagttcgggactttgggatgtctcaaatcattaagtgtctcactgctgttgagggcagcggaaggctgtccagtgcggcctgcatggatactgggggtgaatttaactaagctctggggctcaggatgaaggtgcacatac

SEQ ID NO: 556094 - DNA, 420 bp, Homo sapiens
ggctggtccaccgtctctgagtctaaagcactcctgtgatctgctcctgagactaaagcaccccaacattataacaaaagactacaccaagggctgtggtagttaataagtcaggaaccatggacgaaaacctacacacacacacacacacacacacacacacacacacacacgataaaatcacgtcatacgccaaagggctgtgatagtttataagtcaggaaccatggacgaaaacctacacacacacacacacacacacgaaaaaatcgtgtcatagcgccacgccgtggcttacaaacatggatcctatacatcatcaaaagaatatacaactcacatatagtgctatataactagactcacattcagccactcgtaatcacgccagctcattatcatgttgtgtgaatatgtctc

SEQ ID NO: 556095 - DNA, 909 bp, Homo sapiens
cggtgctggcacagcacctgaggcccctcagcccggcgagccggaaccacaacgccggcccgtgtcgatctacagcagcaaattatgaccattatagatgaactgggcaaggcttctgccaaggcccagaatctttccgctcctatcactagctgcatcacaggcatgccatgagttacaccgtccatgctggtgttatattcctcgacagacacgttcagccccgaccggctggtaaaaggagccattattggctttcattcatatacgttgcgatacaacgcaagctctttgtactggtattatcgtgaatcgctcataatgacggtagaaccactcttggatcctggagctttggtacatccaatgacgtctgctgcaaacgccatgggccatgggcgagaactcttccaggtactagtgttgcaggacacggagcgagtggaagccgtaccaactggtcaattgacctgaccctcacagaagctgctgaaattcctgaataagtcactacaatctgtgagaccacgagtcccacaggtgaagcaagcatttgtgatctgttgcaaggcttcttctgcccatcaacatcgggcccctgtctccctctctgagggcaactcgacactctcgtgctgctgcagtcgatcccacgcccgctgctccgagcaaggtaagctgtccacccaagagacgccgagggcagcacatcaagccatactcctctagtgaccgagaatggggactcccccaggtcctggtagcccaaagctgctggtacagccgccatggggtgggtgtaattcctcatcccccaatacaggcaaccaagactccaagcagggagaaacaggaatagccagaataggtgaggtctagaaccctgcccttaacagtctgcctacagca

SEQ ID NO: 556096 - DNA, 362 bp, Homo sapiens
gtccgcagctctgtcttctttctcaagtgctcactctgtcattccattataaagcatcctacatattttcttctcctctctctcctatcggaccctgtgggtcctcacatttggttaaggaatttggagctacactccggattcttgtctgtatacctcccctctctaggctcccatgtgtgtctttttattctcatgggtgatgccctcacccccaactccatataaattccctctcattcttctcactttgccttctacttcagtttgacaaatacccactcacagatttcacaattcccttagtctatattaacaatctttctccattaggcttgcgagatcactcttttaataatggt

SEQ ID NO: 556097 - DNA, 683 bp, Homo sapiens
  misc_feature (23)..(23): n is a, c, g, or t
  misc_feature (49)..(49): n is a, c, g, or t
  misc_feature (62)..(62): n is a, c, g, or t
  misc_feature (103)..(103): n is a, c, g, or t
  misc_feature (116)..(116): n is a, c, g, or t
  misc_feature (119)..(119): n is a, c, g, or t
  misc_feature (125)..(125): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (143)..(143): n is a, c, g, or t
  misc_feature (147)..(147): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (178)..(178): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (207)..(207): n is a, c, g, or t
  misc_feature (216)..(217): n is a, c, g, or t
  misc_feature (220)..(220): n is a, c, g, or t
  misc_feature (231)..(231): n is a, c, g, or t
  misc_feature (661)..(661): n is a, c, g, or t
  misc_feature (668)..(668): n is a, c, g, or t
ggtgaaacaatcagaagcacctncccagaagctttccatcatgttcatngcattcaaggttnttcatgagcatccaagtttttagtcccatccccagtgcttncaaaaacccccanganaaacantaantttgntnttaagancagnagggaccctacttntncagncantaanagangttttttatgggttnttaancngatgacnattagttanntcngcatagcaggnttagttttgttacccaaatgtatactgcagtagcttaaatacaatttgaagtcttgtggttttatatagctagcactttattactcttttgaactgaaagcacactcccttataggttcatgtaactgtcctgtaataaggtgcttataaatggaacaactacacagcctagttttgccacaacctttagcatctaaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggataggccggatatatngggatcntctagaggcgaccgc

SEQ ID NO: 556098 - DNA, 2058 bp, Homo sapiens
  misc_feature (237)..(237): n is a, c, g, or t
gtgcgttggcgtcggtgggaggcagattgtatggtgtcgttgatgatagttcgataggtctgtaggcttggttgtttgtcgtgagtatgtatgctgctgctggtgagttgtagatgtgttgctgtgctggtctggtaggttggatggttgtacgcgccgggcatgttgtataatagaaccccgctgtggggtggttggaacaaattaccaactccggtggtgtggggaggtccaaancctagttatgtgtatgtctcgcgtgagagggggtccgacccacaccagggggggttgccggacaaaaaaatacataaccggtctttggtggttgtattcatccctccggcccgccccctgctggtttgtgtggtttgtagcccgcgttcttctctgttattgtgtggtttgattaaaggctcacgacgtctggagggggggggcatattgttgtgtgtgctatcaactgcaaggtgggcgctggccgttggtgtttgtgtgtatctctacttcgttgtgggcacgcgtacacagatgtgtttgttttgtgttggtggggtagaacaccacccccctcggttgttgtgtatgttggttcgcggtgtgttggcgcgacgggtgtttgttttgtctgttcctgacctgggtggggagggtgttactctcgtggctacgtcgtcagtgtgggtctcgcgacacatggtgtgtgtttgtgtccgggggaggtagagcttctcgtgtgggggttggttgtttttcaccgactgagttgtcctgcgctttgtttgcagagaaggatgatcgttctgtgtgggtggggtccccccaccccccgtctggggggtgtacatcaccactagccgttgttgtgttgcgcggggagggacgtctcgtcgcttcacgcgcggtgtggttgtgtgtggtcctcctctctgcttctgcgcccccaccccccacacctagttgttgtgtggtgctgtgtagggtggggtggggtttgttcttcgcggcgggagagacacacccacacacccacaccgctctgtggtgcacacagcgtgcggagtagtgtaacgcccctgcgcagagtatagtttcgtcccctccccccactactgccggagggacttttctttggcgcaggcggcgcgctgctgcagatgaatagaatgctgcttctccacacactacgcagtaggtttagttgagacattaactgcgtgctgcgcagcacaacacaatgctgtgcgccccacacctcatcgttgtgtgtgtgagaggcgcgctgtgtgtgtgtgtgccctacacagcgcgtgttgtgtgtgtgtgtgctgcctcacacgcacgcgtgtgctctccgcagcgttgtgtgctgcccgctgcgccaccgcgcgcgtgtgatgatattaggagagcagcgcgcgcgcgctatattgtgtctctctgctgctctctctctgggctcgtgtcacactctctaccctcgcctcatacacactgtgctgctggggggccaacacacactgctgagagaagagagtagagagtgagagagagacgccacacacctctcagctgtgtgtcgtccacacactgatgattatataagtagtgtgtgtgatgatgtgtttgtgtgtggtgcgctgagattatctgctgctgtgggtggcatcacaacgcaaagagaaaaactaccacacaccagcaggggagcgcgtgcgtgtggagaataacacacgcgcccccggcgcggcgggcaacgtcacgtcgtgtgtgtgtggggcgaccctgcgtgcgcgcacacaaaaaaaaacatcgcggcgcacgcagaatggtgtgcgcgcgcgacccagcagtgaatataattacaaacaaaagtacacaccacacgcggggcccactcctcccccgccccgcttggagtgctgtgagagagacacacacacactgtgtggagaggaagtgtgtgtgtgtgtcccccacacgcgtgtgtgtataaatataaataaaatatattaatataatatatataatataatatatagaatatatatatataat

SEQ ID NO: 556099 - DNA, 1308 bp, Homo sapiens
  misc_feature (23)..(23): n is a, c, g, or t
  misc_feature (49)..(49): n is a, c, g, or t
  misc_feature (62)..(62): n is a, c, g, or t
  misc_feature (103)..(103): n is a, c, g, or t
  misc_feature (116)..(116): n is a, c, g, or t
  misc_feature (119)..(119): n is a, c, g, or t
  misc_feature (125)..(125): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (143)..(143): n is a, c, g, or t
  misc_feature (147)..(147): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (178)..(178): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (207)..(207): n is a, c, g, or t
  misc_feature (216)..(217): n is a, c, g, or t
  misc_feature (220)..(220): n is a, c, g, or t
  misc_feature (231)..(231): n is a, c, g, or t
ggtgaaacaatcagaagcacctncccagaagctttccatcatgttcatngcattcaaggttnttcatgagcatccaagtttttagtcccatccccagtgcttncaaaaacccccanganaaacantaantttgntnttaagancagnagggaccctacttntncagncantaanagangttttttatgggttnttaancngatgacnattagttanntcngcatagcaggnttagttttgttacccaaatgtatactgcagtagcttaaatacaatttgaagtcttgtggttttatatagctagcactttattactcttttgaactgaaagcacactcccttataggttcatgtaactgtcctgtaataaggtgcttataaatggaacaactacacagcctagttttgccacaacctttagcatctaaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcaggggaagggttggtattatgtttagcggttgtatttgcacgcatgaactatttgtagatatatcagaagggggtttactgatgccagaacagatagattctagggaaaaatacgtgctagaaaatgggatggcctcgatgcaggagacatggctgtgttgatgtccagatggtggccataaaggacatgttctgaagcactgttcaagaatacgcgactatttcagatgaagcgagaaacataacagggcgaacattcatagcttgcgagagttgatccgtataagttgtggggcaaaaatggccttatatgtactgacggagttaaactgtgaattttttacaaattgcattttacggggggtgacctaaggtaacgagccattcaaggacgctaggaaggttgggcgaatcctgggacatttggacagtgggggatttgtcactggaacttaaaggtggattacagcgctcttgtgtgaggtcgtttcgcccatatgtgtttcaataattagaactattttaaattaagggctataattgaaattagggagtccataagaacttcatatcgagctaaatataacacataaaaagtagagggtaaaagagagtaggaagagagggttcaaattaagggggggcaaagggggttttttatgggagt

SEQ ID NO: 556100 - DNA, 343 bp, Homo sapiens
catgagctatgcagcaatgcagctcaaaacgctttagccatagccacacccccacgggaaacagcagtgattaaccgtttatctaataaacgaaagtttaactgagctatattaagcccaggcttggtcaatttcgtgccagccaccgtcggtcactcgatatatcccaagtcaatatacgccggcgtatagagtgttttagatcatctcccctcccctttaaagtctatatctcacctaatttgtaaaaaactccacttaacacaacttaaaccacgaaagtagctttaacatatctaaacactcaatagcttagatccaaactggtattacataccccact

SEQ ID NO: 556101 - DNA, 686 bp, Homo sapiens
ggcagaagtcctggtaatctggtccttgttcccgtctgataccagcttccttcagcagcgcaggcggtggtccctgaggcccgtggaaggagtcaaacttgcgggaattttgcagtttatctgcagggctgtgtgtttccagcaagacccaaagctagaaaaggaggaggaagaaactgacccgatcagtgccagaagtcatgtgtattcaaagaagaataagcaagaaagaaacagaaggaaggacgagaggtagacagatacaagatgaaatcctgtcaaaaacctggaaggaaaaccagaaaatgagagtgaaccaaagcatgaggaagagccaaagcctgaggaaaaagccagaagaggaggagaagctagaggaggaggccaaagcaaaaaggaactttttagagaaaggctgattcaatctctccaggagtttaaagaagatatacacaaacaggcatttaagcaatgaaagatatgtcagagaagtggatgaaatagatgagataaggagagtcagaaaacaaacttatagtgatgcgttggaagggttaatcgaaaaccatccttaccccttatttaatgtagtttaccttggatttctatctgatattaacaattaccatatagctgcttttattagcatttcctgatattcctttgtccatatttctacttataac

SEQ ID NO: 556102 - DNA, 715 bp, Homo sapiens
ggagcgtacgatgaggcaggcaggggcggcaaggatggtgtagcagacgccaggtctatcatctcgctctgtcgctctggatctctggtggcctagcggggacaccgtggagtgagcccaggtactgcgcagatgtgcacctgtgagtgtgtctgcagggccgagagggtcacactcattcagagctggcttgaaatctcagacgcggagattctttgtatacacacttctcaaacgagtgagagtaaactgaatgtagacttgggtaccaggcagatactctagggacagggctcactaagacgggtcatttactggggatgttccggggaatgcggggtccctggaccgagtttcagatggacagggggtctgatatacagatttcactgcgtcaacctattgagacagtgctgtgaaggctgacagatgtgtgcagcttgattgagctgtgaacatatattatggtaagtggcgtaaaggtttggtcgggggaccaaaggctggagattatcagaggtgtggattgtacctatctggtgttcgagtcttactcgcggctatctgatgatgcagtagaaatctggaagtggctctgtagttgtgatctgggtgaataggttctatcctcagaagaagggcaaagttagagggaaggtggataagccctgcaagttgggtaaatccccaggagagtgtcgatggagcaaggaca

SEQ ID NO: 556103 - DNA, 606 bp, Homo sapiens
ggcagaagtcctggtaatctggtccttgttcccgtctgataccagcttccttcagcagcgcaggcggtggtccctgaggcccgtggaaggagtcaaacttgcgggaattttgcagaagtcatgtgtattcaaagaagaataagcaagaaagaaacagaaggaaggacgagaggtagacagatacaagatgaaatcctgtcaaaaacctggaaggaaaaccagaaaatgagagtgaaccaaagcatgaggaagagccaaagcctgaggaaaaagccagaagaggaggagaagctagaggaggaggccaaagcaaaaaggaactttttagagaaaggctgattcaatctctccaggagtttaaagaagatatacacaaacaggcatttaagcaatgaaagatatgtcagagaagtggatgaaatagatgagataaggagagtcagaaaacaaacttatagtgatgcgttggaagggttaatcgaaaaccatccttaccccttatttaatgtagtttaccttggatttctatctgatattaacaattaccatatagctgcttttattagcatttcctgatattcctttgtccatatttctacttataac

SEQ ID NO: 556104 - DNA, 929 bp, Homo sapiens
  misc_feature (124)..(124): n is a, c, g, or t
  misc_feature (139)..(139): n is a, c, g, or t
  misc_feature (176)..(176): n is a, c, g, or t
  misc_feature (189)..(189): n is a, c, g, or t
  misc_feature (193)..(193): n is a, c, g, or t
  misc_feature (241)..(241): n is a, c, g, or t
  misc_feature (277)..(277): n is a, c, g, or t
  misc_feature (326)..(326): n is a, c, g, or t
  misc_feature (333)..(333): n is a, c, g, or t
  misc_feature (338)..(339): n is a, c, g, or t
  misc_feature (346)..(346): n is a, c, g, or t
  misc_feature (348)..(349): n is a, c, g, or t
  misc_feature (351)..(353): n is a, c, g, or t
  misc_feature (358)..(358): n is a, c, g, or t
  misc_feature (362)..(363): n is a, c, g, or t
  misc_feature (365)..(365): n is a, c, g, or t
  misc_feature (484)..(484): n is a, c, g, or t
  misc_feature (530)..(530): n is a, c, g, or t
  misc_feature (538)..(538): n is a, c, g, or t
  misc_feature (545)..(546): n is a, c, g, or t
  misc_feature (563)..(563): n is a, c, g, or t
  misc_feature (570)..(570): n is a, c, g, or t
  misc_feature (582)..(583): n is a, c, g, or t
  misc_feature (783)..(783): n is a, c, g, or t
  misc_feature (797)..(797): n is a, c, g, or t
  misc_feature (921)..(921): n is a, c, g, or t
ggcagaagtcctggtaatctggtccttgttcccgtctgataccagcttccttcagcagcgcaggcggtggtccctgaggcccgtggaaggagtcaaacttgcgggaattttgcaggttggtgtnaatgtaggtgttgantggggatttctagtgtgggggggtttaaggcagaganttgtgggagtgcnggtnaggtccgtccctccaccctccacctccaggtctacgggaactgatganccttgggaaagggactaggggtcctaggagaagaanagggagacctgtggtagtttaaaaataatcatcctctgctatctaagantgctttncgganncccaaantnntnnngaaanccgnntnagtattaaagatagtttggaaataatatgatttataaatatttgtatgatgggaaaaaagaactgaattgaatgcactgtggagagggggtgaactaggggaaacaaaaggtgggaaantttccatatccgaaaccctaaaggaggaaagctacgtgtgttagtntctggcgntggtcgnncaaaaaaagagataganaaaaacncaacgtaacatnnagtttacagtttatctgcagggctgtgtgtttccagcaagacccaaagctagaaaaggaggaggaagaaactgacccgatcagtgccaggtaggtgagaggaatattataaagtctcctggggtggagacaaaggttgtaagcgccaccgttcctgccggctcccttccaccccacccctttcccctcttcttttctctnccccttctcctttnccctcttcctctgcctgccagccaactttctcttttctggcctggtccctgtgttaggcctatgggggaaaaggtctggggagggctggacggcggaaaggagggcttggaaaagttagagggnaggcaaga

SEQ ID NO: 556105 - DNA, 1211 bp, Homo sapiens
gccggcgcaggcagccctctgtccttcacactctcctccaaaaaaacctccatctgtaacgaaccaaggtctccgggaaggtgagctgtgtcttccccatgttgttgttcctccgtggtgcttgttaggaactgtgtccgtaagagagaaagcagaagcctcggtggtaacgagtcttcgtaggcatgtggacgttcctgacgacgacagtctcgacacgaaggaacaagaagatccgtatgtcacaagatctcgtataacatctgtgctgctatcactgccctattattcccatagggcgcaatgagtggctagataaacgctggccgtagggactactgcttgagtgctgcggtgttcactgctggcgtgagagcaagagagacatgggaacacacgacgatcatctgactggactgcatgttgtctgtcgtgtaagtgcttctggagtctagccgccctggacctccccaattcgccttgactacactaagtcgtgtctcagacacttacaatccctgaagaccagggggtccttctggaaattgtccaaggggcgcttttgtctaaatctctgggcgcctttgtccaaattctatctagactctctttggcgtaaacaacgcgaaatatatgagcggacacaactcggtgggacacctagggggcacaagcacaggagcccaccaaaacgagatgaaaatcacaatacaggaaaccataacagatacaggcgaggagcgagccgcatctgaggcgacaaaaacaaaaaggtgaaatgatcaccttctcacagaaaagaagaagcagcccaccaaaaaaagaccctaggcaagaggagcgatgacaaccaccacatggccacaactaagatcagtaagaggacagcaaaagagagaagcgaacccccaaaacgaaataggacgcgtaacgcacctcgaaagagaaaacaaataaggcccaaggagcgcaaccgacgagagcgcccagcaaaacgacattgaacaaagcacgacacgaagactggaaggatcagatgcggagccacgacagaaccgcccgcaagacaccaccgtaagagaacagcctaacatacagagatacaagagcaaaccaacagcaccaaggaaaccaaccagggagagggcggcagtcaactcccagaataagggtggcggccacagtaaaacaaacacgcacacggcccacaa

SEQ ID NO: 556106 - DNA, 862 bp, Homo sapiens
  misc_feature (688)..(688): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcgggacaagaaaacgggggatcaggtctcgcttcccgctcaagaantaacaaacagcgctggagcacacacggggttgcacacaggggggctgcgcacaaagagagatgtgtagcgaccagatattaaaaatagcggggcgacagccccctaggggagaccacacaggtgggggcgctcacgggggcgggacacacaccgacggcagagtggaccacacg

SEQ ID NO: 556107 - DNA, 297 bp, Homo sapiens
ctagaccgctatgacttctgctctgggaggctggtatacgagactgggcctgctcccactccatgaggtatttctgacaccgccgtgttcccggcccggccggcgtagagccccgtttcatctcagtgggctacgtggacgacacgcatgttcgtgcaggttcgacatgcgacgccgcgaagtccgaagagggggaagccgcggggcccccgttagggtaggaggccaggaggggcccgggagtaattatgggaacccggggagaacacaagaaaggttaacaaggctgccaagggc

SEQ ID NO: 556108 - DNA, 875 bp, Homo sapiens
  misc_feature (859)..(859): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagaggtaattaacactttgtagtgaataggtactttaaaatacttataaagtgtctggtagaaagatttgtatgaatataagacgttgtcaaggtaagtacaaaacttgaaatttaaaaggtttattgggttataaaataagcatgattttgattcatcatttttgaagaagatgtttatgtgaaaagtaccttcaaaactttaattttattatattgtgaaaatattcacaataaaaatttcatatgaagaatatgattggtttttttaggcctgtcacacagagcttccattaatctgaggtcccgagtctcctggtgcctgacagttgctcaggatttttaaacagcaatcatctttacatagcaataccctagatatctgtgcgctgctttttccttatgaacgataacaggagttctcttttcttttgcaaactagttcagtttccctaatagtagtattgaattttgaataaaaggtttgagtgagggacagctgaaaaggtggcggtgacacnaaaacttgaggaaaaa

SEQ ID NO: 556109 - DNA, 484 bp, Homo sapiens
  misc_feature (5)..(6): n is a, c, g, or t
  misc_feature (9)..(9): n is a, c, g, or t
  misc_feature (43)..(43): n is a, c, g, or t
  misc_feature (48)..(48): n is a, c, g, or t
tgttnnatnatcagctttcgtgacccctccgaccctacgtatngactncgactcttgaggataacccaacggatgtgccgctccgcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcgaaaaacaggagttcattttcatccaaaacaaacactggacttcctgcggagcggcacatccgttg

SEQ ID NO: 556110 - DNA, 584 bp, Homo sapiens
tcaacatatctactgcataactgcccttcgctacactcattagattctcgtctgttggtttaacgctatcgtatgaagcttactagtcacaactattcttctgaccccagtaactgatagattagtctgcaaagatctcttcaccatctttcctgggcactggagctgcttgccacccatcttgttccttgagcgccagttgtcatcacccagtctagttgctcgagatctttgatcgtaagctcatctttccttcagagtagcttcattatgaatctcgttcatttctggccataagccttgcccggttgaacacaagaatgatatacgttacatttgggttactagctacctgtgggaaagttagaaagatgacaaggtgttgaagataggtaaacaggaagcttccactcattggttctgggtttggtttgtttgtacttgtgttgtttgttctttttttaaggttggaatttgttagattttactttcgttatattatttttatttgtcttcaaaataattcccaattttaaaaatttaaggaaagtacaatagaactggatgtataggcaatcaagctt

SEQ ID NO: 556111 - DNA, 192 bp, Homo sapiens
  misc_feature (62)..(62): n is a, c, g, or t
  misc_feature (77)..(77): n is a, c, g, or t
  misc_feature (113)..(113): n is a, c, g, or t
  misc_feature (168)..(168): n is a, c, g, or t
cagagcctgagggaagtgggcaatgccatcctcttctgcctcctcatagagcaagctctgtntcaggaggaggtctncgatttgctccatgccgcacccttccaaaacatctngcctagagtctacatcaaaaagggggagcgcctggaggtccggatgaaacgtctngaagccaagtatgcccctgttcca

SEQ ID NO: 556112 - DNA, 759 bp, Homo sapiens
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcgggacaagaaaacgggggatcaggtctcgcttcccgctcaagatcaagacacacggcataggactcagacggcagcgagctaggcacaagggacggtacggagccgacgatccgaa

SEQ ID NO: 556113 - DNA, 738 bp, Homo sapiens
cgtaagtctgcctggaacagacagagacagggaaggcggtgctgatgggggcacaccccacggagagatacaacagcatacaacctggcccggaccaggagtgctgcaggcacaatagcagaagcggagaaaaaaaagaaagagaagaaagaaaagaaagaaaaacgagaagaagaaaaaaagaaagaatgaagaacacaaagaagcaataccaaaaagaacaagagagacacaagaaaaaacaagagaaaaagaaaaaaacaagcgaagagaaaaaagagaaagagaaaaaagaaaaaacaagagaagacaacaaaaaacgaaagacaacgaaacaagagaaaaaaagaacaaaagaaaaaagacaaaaaaagagaaaaaaaaaaagaagaaaaagaaaaaaaaaaacaaagaaaaaagacaaacaaaaaacaacaaaaaaaaaaaacgaaaaaaaaaaaaaaaaaaaacaaaaaacaaaaaaaaaacagacaaaaaaacaaaaaaagaagaaaaaaaaaaaaaaacacaaagaaaaaaaaagaaaaaaaaaacaaaaaagcaaaaaaacaaagaaagaaaacgaaaagcaaacacgcaaacaccaagaaagaaacgaaaaaagcacaacaagaaaaaaaaacacgaccagaaacacccaggaaaagacacaacaaaacaaaacagcgacacagcaacagcaaacggaaacaaggaaaaaaacaaaagagcagaccc

SEQ ID NO: 556114 - DNA, 671 bp, Homo sapiens
cgacgcgcttcacacagccctccaatgatgaggcgcctgggtgatctgcacggtccgtggcgtagctccgtagcggctcaatgtgtgtggccagcgggcaccctcggcccgacatcactgtggattgaatggacgacctaggccttgactgctgcccagagtgccgctgagcccatgtgaatgaagaatgtggacacttgtgccttgaagaaccgtgcggccgggagggacagtcggcaaattacgacctgccggcgtgtcggaacctgctgcgggtgcgccgatcaactgccaccgtacaatggttgggatgttgatccgagcgggaccctgttccaagccgctgtgctcaccatggtcacggcacccctgtgaagcacgacggttgtgactttcgtggggtgtgaaccacggtccctttcccatgttgcagaagggtggctagcaggcgagagcgggtagaagcgcgctggttgactcccaggttggcgcttgaacaggcggcggttgagagagtaccggagacgcgcggaggggtgcctgtccaccaaacttccaacccaatcgaaatggttggggcgaggacccagaaagagttttggtgaggatgacctgcgcccacgggggtgaacagttgtttgggtcggcggtgcccccgaaggggaattcct

SEQ ID NO: 556115 - DNA, 717 bp, Homo sapiens
  misc_feature (613)..(613): n is a, c, g, or t
  misc_feature (688)..(688): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccacaacnacacacaccaacaaatccacatccacaaccacccaaacaaaaccccccatcacctctccttccccctccaactcnaacacacacccataccatgacaaccacca

SEQ ID NO: 556116 - DNA, 258 bp, Homo sapiens
cccaccagagtgtacagtgacagcctagagtcacatcactttgacagcagatgaaggaccacattctagttttctggtgccaaatcctatgccctttcttccttagtggaagaggagctggctggaagccttttggtcctcctttcaaaccatacctttcacacgtggggaacaaaaagtgaactttagaccaacacaggcaaaacactagccacttcttttttcctacaccccaatactttcagtggcaagcgctaa

SEQ ID NO: 556117 - DNA, 1176 bp, Homo sapiens
  misc_feature (283)..(283): n is a, c, g, or t
  misc_feature (302)..(302): n is a, c, g, or t
  misc_feature (307)..(307): n is a, c, g, or t
  misc_feature (663)..(663): n is a, c, g, or t
  misc_feature (825)..(825): n is a, c, g, or t
  misc_feature (867)..(867): n is a, c, g, or t
  misc_feature (985)..(985): n is a, c, g, or t
acttataaactcttccatcactatcccacttttcctatagggcatgcgcgcactataatataacatatacgtaaactttattgatcaatccatctcgcaaatatactagtaggagcgctagtacttgatagagtggccgtatctacaatcgtgcccgataaagattgcttcgtagatctcgtgtggcgctattgaatgccacctacatgcttgtggcttcttattacccagctatcttgatgtcgatattgatagtctccttccatatgtctcaaaatataanatctacctatcacatgccnattcnctatctcgacctattgttgccaatatgtaccgtcccaaaagttcctaatcgtttacacaagaccgttgccacaagagaccccgtgagtacaatcgccttacccaaaacttggcgatataactgcccaattataggtgtagagtcactaagcccgaggggtacgcgcatatgaaaagttaatcgtcacgcaagaaacgattatcgagaggactattccattgtctttatactttcctcttcttcccctttgacctagtcgtgcctacatatctacatggagtctttctcccatcctatttcctccaattctacctatattcttatgtgcaaaacatctttgcgctgagcgtctacgntatcctttacatacacgtatggtacgtgtcacatcatgtgcagcggtaattccttgtgcctatgttgcgtgccttgttgtacatatctaaacatggtggtcttcccgccgtcaccaatggacaggggcgttaaatcttgactctaggccaatcccctgggcnttactggcctttataaaaggcaccaactcatgggcgtccccnatgtatttcccaagttgtttctttttacttccccataatccaactttgtccctcctagcttccatcctaaataggattccgtcctacggattttatcactatattatctagcttcccngtggaccttctacggaaattgcgcggggcacattttggactcgctaatccaaaatggaacacaaatggccttttttcctttgtaggcactcggtttgggtctccccccagaaggtctggctaataaatggttggttacccacgcaattaattacctagaaatcgctacaaaaccttcccgtcgaccatttg

SEQ ID NO: 556118 - DNA, 940 bp, Homo sapiens
  misc_feature (766)..(766): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcgggacaagaaaacgggggatcaggtctcgcttcccgctcaagaantaacaaacagcgctggagcacacacggggttgcacacaggggggctgcgcacaaagagagatgtgtagcgaccagatattaaaaatagcggggcgacagccccctaggggagaccacacaggtgggggcgctcacgggggcgggacacacaccgacggcagagtggaccacacg

SEQ ID NO: 556119 - DNA, 971 bp, Homo sapiens
  misc_feature (971)..(971): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataaggtaactattagtcattcaactcctatttcccttaaatatatcttaaatcagttaagggttttaatgttttttttaaattaatagtaatgttatgtttgaaaaactggtttgaaataaactttaaaacctttagaagtttaaccacttaagacttttccagtctgcctcgttatagcaaaaccaaggaaaatttcttttctaagctcctatagagaactggcaatgaaactaaaatttaattgtgtctccaggtctcttatttttctgcaaataataaattatgtactatgatcattttcagataaatcatcatgcatgttccaaaatgattggccaagttttatttttaagaaacattaatcgtgagtggaaagaaacatgctatggccttttgggagacagtagtgtcttattacagtggaaaagtggtagcgtgggcatcagaaaaacatggggaaggttcagctcacccatgtagctttgtaactctagatcttagttatacatataaggggattaagttagaggatcttagttttctttcgttttn

SEQ ID NO: 556120 - DNA, 1201 bp, Homo sapiens
  misc_feature (1201)..(1201): n is a, c, g, or t
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggaaggtatgctgaaagggagtgaaaattcaacttaaaaggttgtggaataccaattctgactgatgcgcggtttccgaagtggcccgtgatgtaatcaatttgaagtccgagaagcgttacacccagagcacatgtgaggagaggcagaccatattttgcagcagcactgtgccaaggggctgttttcattaaagagggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataaggtaactattagtcattcaactcctatttcccttaaatatatcttaaatcagttaagggttttaatgttttttttaaattaatagtaatgttatgtttgaaaaactggtttgaaataaactttaaaacctttagaagtttaaccacttaagacttttccagtctgcctcgttatagcaaaaccaaggaaaatttcttttctaagctcctatagagaactggcaatgaaactaaaatttaattgtgtctccaggtctcttatttttctgcaaataataaattatgtactatgatcattttcagataaatcatcatgcatgttccaaaatgattggccaagttttatttttaagaaacattaatcgtgagtggaaagaaacatgctatggccttttgggagacagtagtgtcttattacagtggaaaagtggtagcgtgggcatcagaaaaacatggggaaggttcagctcacccatgtagctttgtaactctagatcttagttatacatataaggggattaagttagaggatcttagttttctttcgttttn

SEQ ID NO: 556121 - DNA, 717 bp, Homo sapiens
agcgggagagatggggaaagacaactcgagagaggccggtaggcttgaggcgggcctgaagcggaagccgggcggccttcgtccggtcgagagctaggccgaggacccgtgccgacgcttccccggtgcctcaccgcgatcctttcaccgatctcccgtcggcgcgtcggccgtggtcggggtaagggcgggcgggggtctcatccatggctgcgctgctcggagccgcctgctgggcttgggcggtggcgcggggcccgcggccgccctacccggctcagtcctctcccctgtgggaccgggtcgacggctggcgtgaggagatgacgggggagctggcgccccggtgcccggggcctggtgggcgggtgggcgagggggagacgggcggctggcccgggcttggggctcgggatccgcatcggggatcgggccgccgatggacgacaaggcgttgcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggcagatgtgcatggtcaatttcatgatcttatggaactctttagaattggtggaaaatccccggatacaaactacttatgcaatgggtgactatgtacgaccgagggactt

SEQ ID NO: 556122 - DNA, 704 bp, Homo sapiens
ggcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagataaatcatcatgcatgttccaaaatgattggccaagttttatttttaagaaacattaatcgtacatgaagtgtaatactcctctaagcctattgggatactgcaagatgaaaagtgattgcttcacagtttagacattgggaggaaaatcaagagctgtcttttagaggatgtagcaggcagtataactgtaaaagggaccctgcatctctgtgtaaaataatttgaaattatagaaaatattagtccttagtaataattatatttagctaaaaaaatgaaa

SEQ ID NO: 556123 - DNA, 379 bp, Homo sapiens
  misc_feature (28)..(28): n is a, c, g, or t
  misc_feature (130)..(130): n is a, c, g, or t
  misc_feature (173)..(173): n is a, c, g, or t
  misc_feature (228)..(228): n is a, c, g, or t
  misc_feature (236)..(236): n is a, c, g, or t
  misc_feature (278)..(278): n is a, c, g, or t
  misc_feature (283)..(283): n is a, c, g, or t
  misc_feature (379)..(379): n is a, c, g, or t
gtttgggctgactgtttacacacaatanaccttcacagttgtggggtactttttttttctaaaacaatttacatagttattccatcctcatattcatctacactggggtaaacagttagacaagtacaanatctgattaacatttgctgtttttaaagacaaagatgcccttnttggctcttcaaagggcgggtgaggatttacattgatccaattcttatggtcttntctactcntcctttggagccagtgataatctgtatataggatctggtttngccanctgtctccattcctccatccatccatccacccacccaatagttctttgtgtggggcgctgtgctgggtcatgaagccatcaaggtgggtgaaattn

SEQ ID NO: 556124 - DNA, 942 bp, Homo sapiens
  misc_feature (768)..(768): n is a, c, g, or t
cagcacatttagttacttggaaagcaggcattctgatttattgattgtggggggctatcttccctccctttgtccctcttttaagaaattgaaaacatttaaaatgtaattaagaactttaatcatttgtttttaaacttttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcgggacaagaaaacgggggatcaggtctcgcttcccgctcaagaantaacaaacagcgctggagcacacacggggttgcacacaggggggctgcgcacaaagagagatgtgtagcgaccagatattaaaaatagcggggcgacagccccctaggggagaccacacaggtgggggcgctcacgggggcgggacacacaccgacggcagagtggaccacacg

SEQ ID NO: 556125 - DNA, 851 bp, Homo sapiens
cgtggacagaggaagggcgccgtggtctgtgattccgcgcgcacgtgtaagcaccgtacaggcgctgcggcgcatgcagcgctcgagggatttctgctgagcggctcggctacatcaatgggcatctgtcaaggacttcatccactgacccgggtgacctgcggagccgcccctctgccaaggtggtcttccgggatccgtatcggtataaggaagcgagacggagcggttcatagccgttccgagggcattcacgacggggccacgttctgttgtattgctggcaacgaatggcccagctcaacgagttggcaatgtgctcccgtgtggagcaaccattgccatgtagggtacaatcagtagttgcttgcccttgagaggcagaagcctggatcacctgtggtcaagctggctccggggcatcagggaactatgcacaacgcagtaatcgtcacctacatatccctgtagactcgagagaaatgaccgcggtgtggaatgcgtgcgccatcgcgggcttcgcaatgagagggttgatctcccatcgaggccatagcagagcttgtaggtgagggatgatggtggcgtggagggctggcctgcaattggaacaagagccccagtctttggacggcttgagccaggggcagttaccacaaaactattaagggctaaagaagggacagctgggatgtgacacagcagagtacagggggatgttgggcccagtgaactttccctgatggcatgccacttgcgttactagatgagagtgagcacaacgcaccagggtattattcgggtcaaagccccgctcccggccaatccaggcagcgaagcatgtcccccgt

SEQ ID NO: 556126 - DNA, 122 bp, Homo sapiens
cctaagtggaactgctcggataagcaggtccgaggttactgacctgcggcgcacccttcaggttcttgagattgagctgcagtcacagctgagcatgaaagctgccttggaagacacactgg

SEQ ID NO: 556127 - DNA, 455 bp, Homo sapiens
accgagacactaccgttctgggttattgtgaccggaacgtacagctgctttcgcacgactttctggagatctggccaggcgggccttggtgtccatcgtcgtccacgtcagcccctcgctccaactagtcccggctgactcgtcccaaccgatggtcttgtagcgtggccgagcgatcagcgcgctgaagcgccatcgcgagctcggtcaggaacaccgcatcatgggtgaacaccagaacttggcgggtctcagcccagcgctaaccaaacgccgagctatggcccgacgatatccgtgatccagcgacgtccaccggatcgtcgaaaaatacacggtcgacacgtatgttgggcaggaattcgaagctcggagagggaaccatagccatccccaaagcgcgctggtcgccctctgacagcaaccatgaaggctttcgcccgtgatccctgcag

SEQ ID NO: 556128 - DNA, 350 bp, Homo sapiens
atcgagctcggtaccatgaacattcgtgtccgtctgagaagaacaatctcaggatatttatttcgtgggccagtaacgaggcatgatcgtctccaagtgactgctttccccgtgtgtagatatgtgcccctccgaaacaggtagttgctttctggtgggaaaccaccgtactcaaaaagtcgcagcaaatcatagtattgtccatggatgtcaccacatattttgagtggtgcttcaagttctagtaggataggctgactgagaaagatttcacgagactttaagcacagtcctctgatttcattctcctgaagctggacattcttaccaggcttggacacgaatgttca

SEQ ID NO: 556129 - DNA, 348 bp, Homo sapiens
tgggaccagagtttcgctcttgctgctcaggctggagtgtagtggcgtggtctcagctgattgcggcctccgcctcctgggtccaggcggttctcctgcttcagcctcccgggtagctgggattataggcatacaccaccgcgcccagctaattttttatttttagtggagacagggtttcaccatggtggccaggctggccttgaactcctggcctcgggtgatccacccgccttggcctcccaaagtgctgggattacaggcgtgagccactgcgccaggcctctctttacttttaaactcatttctagtttccaaatagctctccctaagtcctatctgcctaaa

SEQ ID NO: 556130 - DNA, 244 bp, Homo sapiens
tgacctgtgtcgctagcctggaacacagatcaagactctgtctgaaggaaaaaaaaaaaaaagccccccaccctgtctgggggccaggggtttctttttaataaaagttccaaaataggcaggcattgggtgttcacccccatataactcccagcactttgtggaacgcgcttgaagcgcaaggcaaatccattttgagggcccacaggagttgtgaaaacccagcccgtggcccaacacatgt

SEQ ID NO: 556131 - DNA, 295 bp, Homo sapiens
tgagtatcgccggagattgtatgggtatgatacatatcatatagctatgctagggtgagtgtgtaggaagttttttcatagagcacgtttatcagttggtcgtagacggaatcaggggtatgctgttcgaattcataagaacaggcaggttagaagtatggtcttgagtgaccaaatattttgtgtagagttcagggcgagagtgcgtcatatgttgttcctaggacgattgtactggtgagggtgttttttattataatgtttgtgttttcggcctgctccggcgtatcctcca

SEQ ID NO: 556132 - DNA, 569 bp, Homo sapiens
ccacaatccaatccaaggttcccaaatcggcccgcacatccacagctgcgagcttgtatgataagagggtaatatcctctgattaagggggtgatgaactccactgttcgagtacgagacgctacgacgtccgacctttcgggactagctcttctcggtcgtctataaatcgtttagcttagttttttggaactgccctaggtttccgaggtacgaattctgggagggtctgagtagagagggatgtttaggggtagtttttgggtattttttgggggagcgcgtctagcgtttttggcggcttgatggggattagggtagccgttctatatgatcgtggggagggcgcggtaggatatgtaacctctaagattgatcttgatggggcttgttactctatatcggtattggcctatctcgagtcggatggttctttcgctgaattaaatttaaaagaaaaaaggggagaaaacttttcctgaagaggcagtggagggtaagggagctccttaggatattacggaaaggcctcctgacgctatagggatcgaggtcacctcgacgtttcc

SEQ ID NO: 556133 - DNA, 125 bp, Homo sapiens
  misc_feature (44)..(44): n is a, c, g, or t
  misc_feature (73)..(73): n is a, c, g, or t
attgtttatgcccgtatagagggggatatgatagtgtgtgcagnggatgcacactatttgtcaaatatggggngaaggttggggggacaaattattggtgtaggatatagatatgggactgtgat

SEQ ID NO: 556134 - DNA, 447 bp, Homo sapiens
  misc_feature (105)..(105): n is a, c, g, or t
  misc_feature (107)..(109): n is a, c, g, or t
  misc_feature (126)..(126): n is a, c, g, or t
  misc_feature (129)..(130): n is a, c, g, or t
caggtccttgagcgaagctctctggatcggtgattgcttgataaaagaccggccacatcgaggaactctgagaagtctccactggcatgaactcctcctggaagntnnncagggcttgtcggcagnttnntagatgggcatgtcttctgccgatctactctatcagagagcagaccagctttcctctgtgatactggtaggcaccttcttaaaacgttgttgtaaatgagatcgacgaggtgccaaaagagaagggaagaacggtaagcggaatagtccttcactgccttatcttgtcaggctggtggctcccacctggatgccaattgccgagccttgcgaggttcaccaacagactcgcaagatttccacactgtgtgctcttccacttgctcagggggcaggattttaagggcagacttgtaatattagggccctgtcacttaa

SEQ ID NO: 556135 - DNA, 718 bp, Homo sapiens
ggactctggtattgtgaactgtaatctgaagcgagattatttaaagtgtagaaaatagaaacaagttctttttggcaaaggtctgtgataccatatttcagctttgtgtaagtaatttgaatataccaaagggttgtgagtgagtcagttcgtgaatatgcaactgtcacacttaataaggacaagtagttccaggtatctctatatagagtgtagtacataaatgatgtggaatgtacagtttgtgagatagtggtatccctttactatgattaattgatgttgattccaggaaatacttgtgaagccagccacattagatatcagcactcttagcagtcgtgtgtcaaggtagtttgaaaaccaacttttccccgttcaggataagaactgccagggttacctaagaaatgcaataaagatctttataggtcgtaacgctctcttggcatataatttttcatcagggttctctgtttattacattgagcgcaagactggcttcgattcaatttgtttccctcaaatcaccagctccttacatagtttagaattatagtagctatctgagagaggtggctaagacatttgctgcacacagttggactaatgtgggtcagtagccttcggtgactggccctgaatcccagtgtagttcaggtggaaaggtttggtatctcagcaggcatgtgtaggctatgtatttacaattgggacc

SEQ ID NO: 556136 - DNA, 182 bp, Homo sapiens
tctattccaattacatcacatcacaaaatgccatgaatggactcggaaggcgctccaccacctccaacaccctggcagcagcagctgctctctacagcaagagcattttccagaacggcatgagacggagagacgcacgtcccaggggaccggagacgcgcgctgagacctcccagcaagag

SEQ ID NO: 556137 - DNA, 836 bp, Homo sapiens
ggagtgggtgggctgagcctggatggtcaggagtgcggcaactggcagatgccaccacccagcttaacacatcatctgctggcagtctgttgcagtgatgcgccgtgtctgcccaccttctaccatgggatgctggagcaagcttcgtgcacaagcaagaacatgacaccgcatggaccctggtgtgagtgaagagtgaagtgatgaaggtggcaaggtgagctggcatggaccatgccagtgaatgtgagtgtagagccctgcatcatcagactgtgacaggagaccatgagcacataccaacacatacatacacagaatagacatatagagattgcatcaatagacagatagagatagacatgccatgccacagccaaagtagctatgatagataacacaaatgacaaagcatagaggatgagagatagcaagagagataagagagtgacattgtagaaatcccaattagcacccaaatcgacagagacaaacaaacagggaaaagagcacataacaaatatgacaaagaggaaaaaccaaacacataatgaacagaaggaaaaattgacaatagagcaggcagagaaaccacgaccaatcggatgggtttgaccccaaaaggacaacagatagaccaggaccaacagaagacatatagaacacccccacagggggattcaacaccagacatcatgcgacaaaaaagacgccaccagagcgccaaaggcataatcaaaagaaccagcaccacatgaaaccacggccagaattggagcataacagcaggatcaaatcaacaacacgccacaaaaccaatagcacccaattgggcc

SEQ ID NO: 556138 - DNA, 131 bp, Homo sapiens
tgttgatggaggtggtctggttccaccttctttctgagatgggggtggtgggcagtatctcatctttgggttccataatgctcactgtggtcaggcaggggcttcttagtggccaatcttaccagttgggt

SEQ ID NO: 556139 - DNA, 171 bp, Homo sapiens
ggaaggttgagcttgacgtcagagataaagggagcatcatcacgacgcttctaccgagatgttgctcttatggttcatcagagtcagtgacgcgaagtaggagtccaatagtcgcgtgctcatctgcaggctcctctgtgagtcccctttctctgctcgtgcctcctcccc

SEQ ID NO: 556140 - DNA, 428 bp, Homo sapiens
tatgcctcggaagaggacgatcctaaacaaccctgtgatgctgggggccctggccctgaccaccgagattaccccttgcggaggggaggacattttggctgaccatgttgcctcttacggagtcaactactgccaggctaatggctcctctgggccttacacccatgaattcgatggagacgaggagttctatgtggacctgcacaggaaggagactgtctggcagttgcctctgttcctcagatttacaaaatttgacccgcaatttgcactgacaaacatccctgtgctaaaacataacttgaacatcgtgattaaaagctccaactctaccggtgctaccaatgaggatcctgaggtcccaatgttttccaagtttcccgtgacactgggtcaacccaacacccttatttggtttgggacaacat

SEQ ID NO: 556141 - DNA, 179 bp, Homo sapiens
gtggctggtttctagggtataagaacaaaacaagaatactaggaagcatcggaagatgtttttacttgctgtatgccccgatgcttagctcttatccttcaaaccccttctctaagaataagattgctcgaaaactaggaaaaggtgaaggcgtcactgttaccgaccacctcagggtt

SEQ ID NO: 556142 - DNA, 111 bp, Homo sapiens
tccccatttgcctttgggtgtccccacccccattcccggtttgccctttgaggaatttgtttggccagtttttttccccttttttttttaaattaattttaaaatttccca

SEQ ID NO: 556143 - DNA, 623 bp, Homo sapiens
  misc_feature (623)..(623): n is a, c, g, or t
atccctgagaatccaaaattccccgtaccacctatcacaccccatccaaaaaaaaaaaaaaaaaaaaaaaaaaaaaaaatgggaaaaaaaaaaaaaaaaaaaacaaaaaaaaagcgagtgtggcggcgcgcgcgccggggcccccggaaaaaattttaacaaacacacacgcgcgggggggcgcgcgcggcgcgccccaaggagaaaaaaaaagggggcaaaacggggtttcctccagagagaaaccgcgcgggagcaagaaaaccagcgggggggagattctccccaaaaataaacaaagacgcccgcgggggcagacacacggagcggtctatctcgagaaacaaccaccacaaagagaggctctatctaagcggaggcgctacaagagaggggagagaaataacaacaccacgagagagcgaccacacaacacaagaagacaagacacgtgagcaaatacaacctcaacaaaatatattaaaccccccccaggtgccctggctgggttggggatagaactaaactcgaaacaagtattaacccacgaaacacaacaaacacgcaacaacacctcaacacaacaaggcgagaacacaccacaccacgaaaacaacaaaccn

SEQ ID NO: 556144 - DNA, 450 bp, Homo sapiens
  misc_feature (18)..(18): n is a, c, g, or t
  misc_feature (57)..(57): n is a, c, g, or t
  misc_feature (67)..(67): n is a, c, g, or t
ccctaaattctttccaanctgcctgtcctttcctcctttggaaaagaatccaaacgnatatcccccngggaatgtgcccccatgtcccccgggtaacccaactacagacagatgccccccattctactcaagcaacttttagagtgcccttgagatacacatcagataattatgcagggcccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttgaaaaaaaa

SEQ ID NO: 556145 - DNA, 159 bp, Homo sapiens
tgaagctcactgtaactttgaactaatggacttggaatcctcctgctgtggccttcaaagggatgcaattacaagtgtgagccactgcatcccacctcacattttattctatggagatattttttgagttggattaaaaaactttatattgacacttca

SEQ ID NO: 556146 - DNA, 438 bp, Homo sapiens
gttcatgtctgtaatgccagcgacttgggaggcgaggcaggcagatcacctgagatcaggaattcaagaccggtctggccaacatggcaaaactccatctgtaatttaaaaaaaaaaaaaaaaattataggaataattccaaacatcagtgatggcggtaaaaataaacttataaaatgacaggttcagatggggtcccaaaatttagctaaaactagctaaatcaaagaatccaagataaaaggtaatcagtaggacagaacaattcattaagacataatcaatcatgaattgtccttaaggaggcaaaaccggatagacttacagggagatctgagatggtgtgtaatactcaattttctgagcacgctggagggtcaagacaaccaaaaaaattaaggctataaaaggtattacggatggagaacatagggggat

SEQ ID NO: 556147 - DNA, 341 bp, Homo sapiens
gcctttcccccccccgggcccccaaattttgtggggttgggggggccatcagggccccccttgggaaaatttttggcccccccctcccccccttttgggaaccccgttgggtggcccccccaaaaaccccggggggggggtttttttgggctttgggggccccatcccttttcaagggtttcctgagggggcccccccaagtccaaaaaaatttttttttttcccccaaaacctttttttttccccggcccctttaaagggttttttttttttccccccccctccccgggggtttttgggggaactttttaggaaaaaaaaaacgggggtttgggccccca

SEQ ID NO: 556148 - DNA, 701 bp, Homo sapiens
  misc_feature (27)..(27): n is a, c, g, or t
  misc_feature (128)..(128): n is a, c, g, or t
  misc_feature (165)..(165): n is a, c, g, or t
  misc_feature (219)..(221): n is a, c, g, or t
  misc_feature (525)..(525): n is a, c, g, or t
ttcttgggggtttttggggccttaaanaagtggtgtcaaaaaagggggggggggggggttttcgggtatttttccccaggtgcgccccgggtgcgggaaagagggaggattatgggggggggggagantgttcccttttttaggggtttttctctttggtgttanccgcgccgccccgcctttgagcccgggggggggggtttttttccccgggagggnnngcccagggttttgcctttccccccccaaggggggggggtgtttttcctaaaccgaggggcttttgggggcccttttttttccacccaaaaagggaccccggttttttgggggggccccttttttccttttttaaaattgggggcgggccaaggggaaacccggggtttttttttttccggctgggggggggggggttggggggtaacggcccccccccggggcccccctttttttttttttagaaaaatggggggccacctggggggttttttccccccaaatgggggtggggggggccccccnaggggtttttcttcccccctaagggggagagggggggtttccctttcccccaaaatggggggttttttccccccccccttttccccccccgggggggggggggggggttttttttggggggggggggggccctttttttttgggggggaaataaaaaccaatggggggccccttta

SEQ ID NO: 556149 - DNA, 1132 bp, Homo sapiens
tagttctagatcgcgagcggccgcctttattttttttttggttttttctaaaatcatttaagggggaatagaaacaggaatgtcatcaaaaatttttaagtacaggcccaaaagccggttgtctaaaaaaaaaattggtcggccaggttgtggattattcagaataatgatgatcttcggcaggctttggctacgcccttgtctgggtgggtgtcttgaagattaccatcacaagagtactgcagtccaggtcaccaagccagcggaacccgtcggaaaccctgttgttgttctgatggtgccgttaatggtgaaccttgaaagggggtgggcgattctactagagggtcgtgcatgttccaagagcttatgacgaaaaccggcaagaaagcaaacatggcagaaaaagttactaagaatgtaggggctctgaggggaatatctggccgttatatgttgatattcagggaacgattacggaaaaacatccggtagaaacatcgtttagaggaagacgttgaactagttcgcaagggccgaaagctaattatattgccactttagaaaaagtagagcgaaagggtgttggaagaatcggggatgacattgctcattagggctacacgggtgtcacatcggcttgaatcaaaccctggaaggcggctatctattattgtacctctggccccttaaacgtggacaaacaataattcgctgggcaaattactctacgaggactgactataaacggggggtaagggcagggttaaaccttcctccagagtggaaagatggtggccacgcccggtggcattcaaaacgggaggatcaacaaacccccccatctatctaggtaatgtgggggaaacttatatggggtaggcaagaaagagacttaagagagaaaatttaaagaccgtgggaaaagtatgtggcaacataatttgtgtgggacagacaaaaaaattttggtgtgggtttacaacacactcgggggcgcatacaaacgatagctggggatgcacaatctacaatttggacgccaaagggcaatgtttatatttgaacaggtgttgcagccccacagggaggggccaatattgctttagtggtgggagattaatatgcagac

SEQ ID NO: 556150 - DNA, 132 bp, Homo sapiens
taagagctcttggtcagtaggttcattatcagtggtactatttcgaacggaatctctgaacagtatgtataccagtgggcttaaaatattcagtaaaccatgctgtaaatagatgtaaatacgataccacag

SEQ ID NO: 556151 - DNA, 118 bp, Homo sapiens
gactagccatggaaatcagacagagaaggcacagggaagtcctaacgtttcccctgctgtggccacctgttgtgctggatgcccaagctagcacgctaggagagcacagcccctagag

SEQ ID NO: 556152 - DNA, 789 bp, Homo sapiens
  misc_feature (547)..(547): n is a, c, g, or t
  misc_feature (550)..(550): n is a, c, g, or t
  misc_feature (558)..(558): n is a, c, g, or t
  misc_feature (564)..(564): n is a, c, g, or t
  misc_feature (579)..(580): n is a, c, g, or t
  misc_feature (587)..(588): n is a, c, g, or t
  misc_feature (591)..(591): n is a, c, g, or t
gctaccctcccagttgcttagtaatacccataggtgatacaagaagctctgaagatgcaaaaatgacattactaatgatgtgattgcaggagccacagaagaacgttatcagcttttcgctcgaatcagtccttagcgctcgtgatcatatgcttctaccatccacgatactatcactctagtttgtcaccatctattcacaagtaaagcaaaggatgcctggaaggtcgtgactttgtatcttcagaactcacagagtgaatttcagcgtcgtgtctgagattcgaatgacctcaaccatgtgctctttaggagtttacgaactgtagctagaacaaatgatatatttttgccatagggattatttagcgagcaagaaacgatgggcgtacttgtagactgaggaccgggtcaaagaccatcgttgacccatcaataggaaggagtattcctcttataataagtgcgctactattttcgaagatcgcatttaggttgcgataggaccgggtcaccgcttcaaatgatagcggcaaggtagcaattngtncccagttncatttncttcctgggaattanntcgtcanntcnttccttcagtcatcttctgtgtaggtgaccggagcactgagaggcagctctgatgcactattgtgtgtcagcagtctcaaaggcgctaaaacactgaaggttctgcatctgaagtattagattgttagcagcaaaatatgacaagatgaggtggacagtcctctaagccctatttagggaagctttccaagtcacaat

SEQ ID NO: 556153 - DNA, 812 bp, Homo sapiens
cgcagtggctcgctcctgtggtcccagcactttgggaggctgaggcgggcggatcgcggggtcgggagatcgagaccatcttggctagcacggtgaaaccccgtctctactgaaaatgcagggaattggccgggcggggtggcgggcgcctgtggtcccggctgctccgaggctgaggcaggagaatggcgtcaagcggcgaggcggggcttgcggtgggccgagatcgtgccgctgcactccagcctgggcaacggagcgggactccatctcaaaaagaacaaaaaaagtagagatgggatctctagcctcctaagttaatttagcctcccaaatgccagacaaggaatctaacataaaatttaccttgaataagatatatgatattgattctgagctgcttggtattttttctgactttggcatctgtatcttggtgctttctgttagactggtagagttctaagaacctaaggagtatgcattgtacttcagtgctaactttttccttcatttactttctgtgtatataggcagcatatttcctggtagaaccattaacccagatggctaataggcttcatgttacggcattcttccacacagtcccagatgacttcacggaaacagccgaactggcaagtcacagtgtgtcataacctgagcactgaaacacattgctttaaaacaatagatttcactttccttaccacgttggaattgccatggtatgggcgggtctctggataaattcagctggtctggggccccgtattttggaactggtcaacaattttgacgccttcggggaa

SEQ ID NO: 556154 - DNA, 111 bp, Homo sapiens
gtgcaggtgctgcaacagtaggagtggctggttctggtgctggtatgggaacagtactgttggcagaccttgatagattgggttatgacagaaacccttgcgctgatgcag

SEQ ID NO: 556155 - DNA, 363 bp, Homo sapiens
  misc_feature (121)..(121): n is a, c, g, or t
  misc_feature (124)..(124): n is a, c, g, or t
  misc_feature (132)..(132): n is a, c, g, or t
  misc_feature (138)..(138): n is a, c, g, or t
  misc_feature (153)..(154): n is a, c, g, or t
  misc_feature (161)..(162): n is a, c, g, or t
  misc_feature (165)..(165): n is a, c, g, or t
aaagaggctgattggtaggccaacactcgtgccctacataggaaggtatctttaatagggtctatttcaaacctatagatgggaggagaggtcatgctacaagtattgaggcaatgcattngtncccagttncatttncttcctgggaattanntcgtcanntcnttccttcagtcatcttctgtgtaggtgaccggagcactgagaggcagctctgatgcactattgtgtgtcagcagtctcaaaggcgctaaaacactgaaggttctgcatctgaagtattagattgttagcagcaaaatatgacaagatgaggtggacagtcctctaagccctatttagggaagctttccaagtcacaat

SEQ ID NO: 556156 - DNA, 342 bp, Homo sapiens
cctttagtcagaaaagccacaagtaacagttaaaatcacctggtccaaccatatggaaagactcaccaaggttcataaaaatgaaaccacccaaagtatatgaggtcttctgagtcctaatccagggctttgacatggcatcaccaatgcatcacatcccacatggctctcacttcttccctggcacctctgcaaagttccaggggatttcctgcctctcactcttctctcctcattctctggactcaccctgatctcatttatgtatgcttttatcataattttctctaaagtagccccaagtcataattacattaaaacctgaagtctgataaaatagcg

SEQ ID NO: 556157 - DNA, 351 bp, Homo sapiens
taccgtcagcgagagataaccaacgcagcagtgaccgtcctcccctgaggacttaagtctgagttcacaggaccacaaaatactggccatagtgcaatgcctgttactggcagtgcgtttaccatgacaacaaggatattacaattcaggaccagtgttctgaacagtctcgggaactggtggaatactaggatatttgtatggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaac

SEQ ID NO: 556158 - DNA, 169 bp, Homo sapiens
  misc_feature (155)..(155): n is a, c, g, or t
gctcttaagatccatccggtcgggtatatcaccgagaggtaacagcaaagctgaacgcagacatattctatttaacctatagtccttccctatcatcgactaatttacactcacaacacctaggctcactaaacatttatactcactctcactanccaggaacggggaa

SEQ ID NO: 556159 - DNA, 1234 bp, Homo sapiens
  misc_feature (298)..(298): n is a, c, g, or t
  misc_feature (425)..(425): n is a, c, g, or t
agacttcggttgatggaaacgggatctttcatgtctcaggggtagtttggttggttgcaatgttacaagttttctatctgtctggtatgctataaatctatgtaattggagcttggaaagcgagtaatcgtgacaaaggagtatggtatggagtccagaaagaaataaattgagaaggacgagaggttgctatgagctgtcgatgctacatggagtagcacattaagaagagcttgggagtcgggtggatgttggggtgggccgatgccatactttgccgtggtcctcgacatgtttntcgatatcgaagcgagggtgacttggcaggcagtgtgatgggaagtccgatatatcgaaggccctgaacagttgggccctgtgggccccgttgacttcgtccgtcgtggaggaactactactaggcnctattaggcggatttactcaacaaacgggggttggttgactcgcaagacgacataatccccacggatacattctacgagtggaaagggcacaagcacccaacattcaagggggcgaataatcttgagatattcgatggacgagttgcattagttatgtactagagtcgaggcattggggttatccaaggaagaagggtatcagggttaaaatttccttgactctggtggggctctagtggtgagaacttgagaatcagagttaaaaggggaaatctccagagggctgccccttctttacgttgcatgttttatgatggaatgtgttaaggtttttgaatgttgctctctttggatatgtatattttggggaaggaatgtaaagaatatggtaagtggggtgagtgataacgcataagtaggttaccgggtagtcggttcaggtttttaaatggggtgtatttcgaaccaaattaaacgtggaaatttttttcgagggctctcttccacatttttcacatccttccatctcccaagggtgctcttcccctggcttttaattggtgaatcgaagagcgggcgattccacggggcgtcgatgacaatacgacgtccggttacatgcttaggggaactttcggcaagatctactgacaattggtttccccaagaattgccttaatgggggtaacgtattccaaaaggcgaaaagaaattcctctggggcaacttcggaaagccgccaaagtcgtggacatttgcacacaccggggccaagaaactaacttatggtaaagggaggtgtcactac

SEQ ID NO: 556160 - DNA, 321 bp, Homo sapiens
agccacaagttacaatgcaacagccgtggcggttcatgtacagggtcaggaaccttggacggcttccaggtgggccatccgcccctcctcaagagcaaacgcaaatgtggggtgacgggctgtttcctcttattcaagccatgcaccctactctggcgggtaaaatcacgggcatgtggtgggagatggcataattcagacacttcttcatcatgctcgcagtctccagcagtcatccgtactcaggtggatgaagcggtagctgtcctaccaagcccaccaagctaaggcaggctgccccagaaagcagtcaacagtgcc

SEQ ID NO: 556161 - DNA, 336 bp, Homo sapiens
  misc_feature (152)..(152): n is a, c, g, or t
  misc_feature (171)..(171): n is a, c, g, or t
  misc_feature (218)..(218): n is a, c, g, or t
  misc_feature (279)..(279): n is a, c, g, or t
  misc_feature (294)..(294): n is a, c, g, or t
  misc_feature (334)..(334): n is a, c, g, or t
gtcaataaagaactggtatggttcatatggtatcataaacttaaaataatggtattttctatatccccaaattctgttctgtggggggaaaaaaagtcctatgcagatataaggtagatacaaccggaaccaagaagaattctggtgaccanaatggattttggagaactncgtgggctaaataagttaaatacgcttcgttatcacggggacttctnacatagcggttagaatggttactcaggcattggtgaactctacaagagagatggatatcanaatgcatgtttccanaacttagaatatttaatcactggaatttactgcctgcccntt

SEQ ID NO: 556162 - DNA, 218 bp, Homo sapiens
cagtggcagtttgggacctccctgtgcctttcagcactcccttccccccccccatagcccaaggacaaggctaccccagaaggttaccccaggacctggggtttgtttccaggggacaaggagaccctgtcagcctggtgttccccaggcctggtaaattaaatggcttgtttcatcccccccccaaaaggaaataaaccatgtggctttaattttta

SEQ ID NO: 556163 - DNA, 400 bp, Homo sapiens
agatcctgtgtcatcccccttgtgctatggggctgcgacctaggagtgagcacaccttcatcatgcagtctctcctgaagagagctagctgggcagggtgcgtgtaggctgagagcagcaggaggaaaccttctagtgagcagaggacagctcctcaacacacactggctctgggggtctcttgcagggttgtcagtgagaggtgagcgccttggctgtgagctgggagttatcagcatggctggagatgagatacacattgctccatcaccctcacctgggaccaggttttgcctatctcaatggcagcgtgactggtgggatgtgacacctctggggaagaggaccaatgctgtgttcagccatgggtgcagggtgggaaaacctgatgggggaaaag

SEQ ID NO: 556164 - DNA, 185 bp, Homo sapiens
ccatgttagccaggatggctcgatctcctgacctcatgatccacctgccttggccaccaaagttcttggattaaaagtgtgagccaccacggcccgaccattgactaccaatttttaacttcacattttaaataaaataatatgccaccattgtaaattaaatacccacactgcggtgtgttggc

SEQ ID NO: 556165 - DNA, 517 bp, Homo sapiens
  misc_feature (215)..(215): n is a, c, g, or t
gaaatagatgtgcacagctcctcttaaactccagctaaaaatttaatccaaagaggtggaaagtcgagagatcctcttcccagccaatggtgagctgagatcacctcatccccttgagcccaccaagccaccaattcttagtaactctttttttaagtgtagcccatgtttcgctttgggttgtgtgaaaagattacaaagcagtctaggacttncgagtcccagaattatcctcagccccttatgtggatactttgaaaaccagtaagaacttaagaccattcattttctaatttttccccaataagttttgctcttgacaagtgaaaaatcaattaatggttgataaataacgaaaaaagctcaggaaggttttgcccactgtgtttttttctggccgtgcagcagtaaaaacctcctcctccaagtttgtctctttctcgtgaatatgtatcactcgggaaatacgtggaaggaaataaagttcgccgggttgtattgcggtgttattacggtt

SEQ ID NO: 556166 - DNA, 349 bp, Homo sapiens
tgcttacaaaactttgaggtaccacaaccactctccaaatacaaatgctgcaagtgatttgaagatcatagaaatgataatacaggcaaaaaatgcgggaaatctcccctgccaaattattcaactatgtatgacttctgccttttcacagcgccaatttgccatgctatgcgtttcatctttgcatcattttcaatactggatgtataaattgtgtaaagactttcagagttctaattcattttatgcattttttgcaaatttgattccatgaaagtgcattatcacatcatcgactgtgtgtaatcattgtgtgtgcatataaaaatgaagagataaatgaagagat

SEQ ID NO: 556167 - DNA, 1615 bp, Homo sapiens
tgtcagctgttctagggttaggctgcgtccctcttcgttgtaggcagcctcgtgctgttttgtatggatatgagtggtctggtgcatctctttgtttctgctgtcgtgtgtggttgctgttgtgctgcgctgtgggttgtgcgcggcgcgcgtcgtttcgtcctcttcgcctgttgttggtgggcgttctccgccgacgttgtttcccctcgttgtgtcgccgattgtttgcgattgggggtgttaaagttcccgctggcttgcgtgggtgtctgcctcctgagggggccgagggctctatctcgtgcggtgcgcttgttctttctggtcggagtggggctccacccccgtgtcgagatgttcgcgggggagctctctattgggggctgtgttgtctcccgtggtgttgtttcgcagccgcctgtcgctgtttgcacgggggtgtagtgtgtgattgggaaagggtgtgtcgtgctgctaacgcctcgggggtttttctacggggggcatactccaatggggtagtgttgcccccgtgggtgggggcccggtgatgtatgttgtcttgcgccggggacttatttgtcggccccccgggatggtgctcaccatagggggtccccttttgtgtgtggcccccgtagggtcctcgctctctttagatagattggtgtctggcccttttgtggtattggtgtagattgatgtagggggtgtgttgttcatcttggggagggaagttgtgggaggcctctccatgggggttcacagcgtcgtctcacctctgttgaaatgtgttccggggttgcccctgcctgctaggtgttccgcagttgttgttccgtgtgctccgacgtttcgctcccccctgggtgatcgccccctgttggtgccccacccccacgggttggtgcctcgatatgagggaccctcacataggcccccgctcgcgggtttcccgctcccacgtgtcgtgggagatttgttgcgggtttccccgtgtccccgcaggggcttggagagcacacggggccgcgggggctctgagagtggaaatgtgccgcggggtttgttcccacttctttgttaacgcacgcactgtcccggcggtttgaggtgtcactagtcccccacccacacaggtaggataatatagtgtggaatattggcccacggccagtagaagaaaatggagacccacaacaagagtgtggcgagagctcgataagagcctataaagtggctctggctgttttggccccgtgtggagccacagagtataaataggagaactatttttcgcacttgatgttgtagatagcacgccactcggggtgtgtgtgtattgattgtgttgactcgaagagacgtgtcttctgtttgtggtgaatgaaccgataacgtggtgtgtttttaaaaagcctcggttgtttgtctgcacataaacgcctcttaaaggtgttgttgaaattggtgtgttcaaatgtctgggtgccagttggaggattttttagagacttcctttttaatttgttaattaaagatttaccactggagtgtttccaaaaagatcccaccaactgccagcccctgtttattaaggtctttaataatt

SEQ ID NO: 556168 - DNA, 109 bp, Homo sapiens
acaataaagcaccacacaacctaaagaaaaacgaacgagcactttatacatatatgggccatggtttagcgaacgacgagcgccaggagctattgagcgaggaagcgga

SEQ ID NO: 556169 - DNA, 404 bp, Homo sapiens
  misc_feature (32)..(32): n is a, c, g, or t
  misc_feature (48)..(48): n is a, c, g, or t
  misc_feature (60)..(60): n is a, c, g, or t
  misc_feature (78)..(78): n is a, c, g, or t
  misc_feature (112)..(112): n is a, c, g, or t
  misc_feature (118)..(118): n is a, c, g, or t
  misc_feature (123)..(123): n is a, c, g, or t
  misc_feature (241)..(241): n is a, c, g, or t
  misc_feature (331)..(331): n is a, c, g, or t
  misc_feature (396)..(396): n is a, c, g, or t
caccaatcagcactctgtaaaatgcaccaatnaacgctctgtaaaatncaccaatcaatnctctgtaaaatgcaccantcagcaggatcctaatagtagcctatcacagggnggattnaaaanagggaactctgttaggacaaaaacaacatgggtggggacaaataaggaaataaaagctggccaccccagccagcagtagcaacctgcttaggttgccttccacgctgtggaagctttnttcttttgctcttcccaataaatcttgctgctgctcaccctttgggtccgtgcctcctttaagagctgcaacactcaccaggaaggcctncagcttcattcttgaagtcagtgagaccaggaacccagctgcaggaaccaactctggccacaaanctactaga

SEQ ID NO: 556170 - DNA, 212 bp, Homo sapiens
tataatatagtgaaatatttgatgtagcgaagtggaccttaactggtgggtaaatgcggtgtgaaattgcaagacggtggaggaatgggttccattcgtggaaatatttctccaatctcgaaactcgtatacagatcgaccctaagactgacaggtcaaggagagcagcaaagtcaggaaatgggattggggttaacttctgccaaaccgac

SEQ ID NO: 556171 - DNA, 569 bp, Homo sapiens
  misc_feature (432)..(432): n is a, c, g, or t
agcgggtcaggtcaggacgggagtccggcgggttacagcggaggcctaggtggcagacagggggcccgggtccgctgcgtgttgtccacccaaggatggagttcctcctggggaacccgttcagcacaccagtgtgtctgtgcctcgaggaaaggcaacagatggcatccgctgcaaagtggaggcattggcgcaagttgaatatggagatctgtgacatcatcagtgagacggaggaagggccagaaggatgccattcgagccctgacgaagcggctcgaacgggaacctagtaaactacagacgaggtggtgctggcattaagcagtgctggagacactgtagtagaatgaactgttggccagctcggattgccaagatccattgtgtgccaaacctgagatgttcactccgacaggtggttgcttggtncaaaagagttatcagtcatcgcgcaatgaatcaaggcctctctcactccatgtgttcatgtgagctagatgttgctttggtcttgactccatgtgcaatggtgctagatgcctttctgaaggcaggtcctgatctca

SEQ ID NO: 556172 - DNA, 236 bp, Homo sapiens
  misc_feature (225)..(225): n is a, c, g, or t
ctctagatagatatccagtagtgtaattgctggatcaatggtagatctacttttagttctctgaggaatctccacactgttttccatagtggttgtactagtttacattcccaacagcagtgtagaagtgttcactgttcaatgcatccacaccaacatctatctttttttaattttttgattatggtctttcttggtcgtttgaaagaagaggaaaaaaggagnggatttgttgg

SEQ ID NO: 556173 - DNA, 404 bp, Homo sapiens
aaaggaaaaactaaggagacggtaaaacatcgatggttgccaaggggcccaggaaacaggaaagaattaataggtggagcacagaagatctttagggcagtgaaactattctgtatggtactgtaatgtgggcacatgtcattataagttgtcaaagcatataaaatgtatagcacaaagagtgaagcttaatgtaaaactatggagtttaataataatttgttaccattggcacattcatgtaacagatgcactatactaatggaagatgttaatagtggaaactgtgtttgtgtggtagagtaggtatgaactctctttactgtacttttgttcagtttttctgtaagctcaaaattgcttttaaaaataataaaatctattaattaaaaagaaaaaaaaaa

SEQ ID NO: 556174 - DNA, 195 bp, Homo sapiens
atcagctccatgtagctgtgattacaggcatgcgcaccactgcctggctaatttttgtatttttagtagagacggggttccaccatgttggctaggctggtctcaaactcctgacctcaggtgatccacccacctccctcggcctcccaaagtgctgggattacttgaggtcacgagttcaagaccaacctggcc

SEQ ID NO: 556175 - DNA, 391 bp, Homo sapiens
aaatctcatgttgaaatgtaatctccagtgttgaaggtagagcctagtgtgggaggtgattctatcataggggtgattctatcatattaaactcattaatagtttgacacatcctcttggtgataagttagttctccctcagttagttcatgggagatccagttatttaaaagtatgtggcacctccccactagctttctcttgctctggcttttgccatgtgacacacctgctcccccttcgccttccaccacgattgtaagcttgctgaggccctcaccagaaggatatgccagcaccacacttcttgtactgtccagaaccgtgaacaaattaaatctcttttctttagaaattacccagcctgggtgacaaagtgagactccatctg

SEQ ID NO: 556176 - DNA, 246 bp, Homo sapiens
aatcgagctcggtccactccttcctgagactacaagtgtgggcatcatgcacagctaatgtttatatttttagtagagacgcagttttgccatgttgggcaggctggtctcaaactcccggactcaagtgctctgcgagttcagagctcccaaagtggtgggattacaggcatgagtcattgcacccagcctcaataatctcttctttagagacagggtctcagctcttattgcccaggctggagt

SEQ ID NO: 556177 - DNA, 153 bp, Homo sapiens
gtggtaagtcgttggagtgggcagagaggctagctgctgccttcctgcctggctcagtctctgcccagtccccagtccccagcagccagtggcccgtggcagtggccctcctggggtcacagcctgcgctgagctcagtccaggcaagaacaa

SEQ ID NO: 556178 - DNA, 818 bp, Homo sapiens
  misc_feature (4)..(4): n is a, c, g, or t
  misc_feature (67)..(67): n is a, c, g, or t
  misc_feature (88)..(88): n is a, c, g, or t
  misc_feature (98)..(99): n is a, c, g, or t
  misc_feature (101)..(101): n is a, c, g, or t
  misc_feature (103)..(105): n is a, c, g, or t
  misc_feature (116)..(116): n is a, c, g, or t
  misc_feature (119)..(119): n is a, c, g, or t
  misc_feature (122)..(122): n is a, c, g, or t
  misc_feature (134)..(134): n is a, c, g, or t
  misc_feature (140)..(140): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (163)..(164): n is a, c, g, or t
  misc_feature (168)..(168): n is a, c, g, or t
  misc_feature (177)..(180): n is a, c, g, or t
  misc_feature (220)..(220): n is a, c, g, or t
  misc_feature (229)..(230): n is a, c, g, or t
  misc_feature (232)..(232): n is a, c, g, or t
  misc_feature (236)..(236): n is a, c, g, or t
  misc_feature (242)..(242): n is a, c, g, or t
  misc_feature (253)..(253): n is a, c, g, or t
  misc_feature (257)..(257): n is a, c, g, or t
  misc_feature (275)..(275): n is a, c, g, or t
  misc_feature (289)..(289): n is a, c, g, or t
  misc_feature (293)..(293): n is a, c, g, or t
  misc_feature (296)..(296): n is a, c, g, or t
  misc_feature (320)..(320): n is a, c, g, or t
  misc_feature (328)..(328): n is a, c, g, or t
  misc_feature (331)..(331): n is a, c, g, or t
  misc_feature (343)..(343): n is a, c, g, or t
  misc_feature (346)..(346): n is a, c, g, or t
  misc_feature (384)..(384): n is a, c, g, or t
  misc_feature (392)..(392): n is a, c, g, or t
  misc_feature (400)..(400): n is a, c, g, or t
  misc_feature (409)..(409): n is a, c, g, or t
  misc_feature (415)..(415): n is a, c, g, or t
  misc_feature (427)..(427): n is a, c, g, or t
  misc_feature (456)..(456): n is a, c, g, or t
  misc_feature (458)..(459): n is a, c, g, or t
  misc_feature (561)..(561): n is a, c, g, or t
  misc_feature (568)..(568): n is a, c, g, or t
  misc_feature (571)..(571): n is a, c, g, or t
  misc_feature (573)..(573): n is a, c, g, or t
  misc_feature (581)..(581): n is a, c, g, or t
  misc_feature (646)..(646): n is a, c, g, or t
  misc_feature (667)..(667): n is a, c, g, or t
  misc_feature (673)..(673): n is a, c, g, or t
  misc_feature (690)..(690): n is a, c, g, or t
atgngggcatagctaaaattccctgggtggaattaatgcctggaccattgctcctccctttcagganaaaagggaaaggatgaaaaanaacagcaggnnangnnnccacctcaggnggnggngggggacctggngctgcntntngngntgggaacgtgttggnntgtnaccagttgnnnntggagcacagtgtcaagtgggccaggatgggtgtgggganacccaggtnntntggncccgtnggggtccaganggtnggggtccagggggggggnggggctggggtggnttgnttnttccacctaaggttttgggaccgntggggtcngtntgggagggtgcntgnttattttggggttggggggggggtgcttcccatctggncgtaagtncacaaacnatgtttatntgggtntggaaagatganttcccctttacacaacccccactccctgngnntgcgggtcccagcggagtggtgggagatcttggcagtgggaaccagaatggtgttgccacacagcacacaggctgaggcacattggtggagggttcagaggnacgaggngangngagggagngggatctgtgacccgccttgtgactggtgggcagattcaagtctctaccgctgctgctgagcaantgggcatctgcttcttggaanaacaanaaaggggtggggtaaanacttgaggcctgggttctaggttgggcaggaagggatggggcagaagtcagggttccatctatagtgacaaatcataggggcttgcttgggaagtaccatctttcgtggaaggtgccgggtgtataaa

SEQ ID NO: 556179 - DNA, 894 bp, Homo sapiens
  misc_feature (671)..(671): n is a, c, g, or t
  misc_feature (680)..(681): n is a, c, g, or t
  misc_feature (694)..(694): n is a, c, g, or t
  misc_feature (696)..(696): n is a, c, g, or t
  misc_feature (719)..(719): n is a, c, g, or t
  misc_feature (732)..(732): n is a, c, g, or t
  misc_feature (742)..(742): n is a, c, g, or t
  misc_feature (760)..(760): n is a, c, g, or t
  misc_feature (781)..(781): n is a, c, g, or t
  misc_feature (833)..(834): n is a, c, g, or t
  misc_feature (853)..(853): n is a, c, g, or t
  misc_feature (862)..(862): n is a, c, g, or t
  misc_feature (874)..(874): n is a, c, g, or t
  misc_feature (889)..(889): n is a, c, g, or t
gagacagaaggaggaaggacagcacagctgacagccgtactcaggaagcttctggatcctaggcttatctccacagaggagaacacacaagcagcagagaccatggggcccctctcagcccctccctgcacacagcacatcacctggaaggggctcctgctcacagcatcacttttaaacttctggaacctgcccaccactgcccaagtcacgattgaagcccagccacccaaagtttccgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacccgggaggacgcaggatcctacaccttacacatcataaagcgaggtgatgggactagaggagtaactggacatttcaccttcaccttatacctggagactcccaagccctccatctccagcagcaacttaaatcccaggggaggccatggaggctgtgatcttaacctgtgatcctgcgactccagacgcaagctacctgtggtggatgaatggtcagagcctccctattntcttcactnntttgcagcttgtncnaaaaccaaacaggaccctctttnctattttggtgtnacaaaagtanacatgcaaggaccctatngaatgtgaaatacggaacccnagtgagtgcccagccgcagtgacccagtcaccctgaaatctcctcgcaagcnngcccaagccctacatcacnatcaacaanttaaaccccagngagaataaggatgtnttagc

SEQ ID NO: 556180 - DNA, 1090 bp, Homo sapiens
  misc_feature (396)..(396): n is a, c, g, or t
  misc_feature (419)..(419): n is a, c, g, or t
  misc_feature (443)..(443): n is a, c, g, or t
  misc_feature (446)..(446): n is a, c, g, or t
  misc_feature (466)..(466): n is a, c, g, or t
  misc_feature (481)..(481): n is a, c, g, or t
  misc_feature (544)..(544): n is a, c, g, or t
  misc_feature (549)..(549): n is a, c, g, or t
  misc_feature (567)..(567): n is a, c, g, or t
  misc_feature (617)..(617): n is a, c, g, or t
  misc_feature (639)..(639): n is a, c, g, or t
  misc_feature (659)..(659): n is a, c, g, or t
  misc_feature (678)..(678): n is a, c, g, or t
  misc_feature (685)..(685): n is a, c, g, or t
  misc_feature (728)..(728): n is a, c, g, or t
  misc_feature (771)..(771): n is a, c, g, or t
  misc_feature (776)..(777): n is a, c, g, or t
  misc_feature (788)..(788): n is a, c, g, or t
  misc_feature (824)..(824): n is a, c, g, or t
  misc_feature (869)..(869): n is a, c, g, or t
  misc_feature (888)..(888): n is a, c, g, or t
  misc_feature (893)..(893): n is a, c, g, or t
  misc_feature (896)..(896): n is a, c, g, or t
  misc_feature (907)..(907): n is a, c, g, or t
  misc_feature (911)..(911): n is a, c, g, or t
  misc_feature (914)..(914): n is a, c, g, or t
  misc_feature (921)..(921): n is a, c, g, or t
  misc_feature (929)..(929): n is a, c, g, or t
  misc_feature (939)..(939): n is a, c, g, or t
  misc_feature (945)..(945): n is a, c, g, or t
  misc_feature (968)..(968): n is a, c, g, or t
  misc_feature (970)..(970): n is a, c, g, or t
  misc_feature (1001)..(1001): n is a, c, g, or t
  misc_feature (1015)..(1015): n is a, c, g, or t
  misc_feature (1062)..(1062): n is a, c, g, or t
gagacagaaggaggaaggacagcacagctgacagccgtactcaggaagcttctggatcctaggcttatctccacagaggagaacacacaagcagcagagaccatggggcccctctcagcccctccctgcacacagcacatcacctggaaggggctcctgctcacagcatcacttttaaacttctggaacctgcccaccactgcccaagtcacgattgaagcccagccacccaaagtttccgaggggaaggatgttcttctacttgtccacaatttgccccagaatcttgctggctacatttggtacaaagggcaaatgacatacctctaccattacattacatcatatgtagtagacggtcaaagaattatatatgggtgtggccctgcaatacangtggacggaggaaacaagtatanttccacattgcattccctcgctgnatnccagcaatgttcaccccggnggagggacgccaggnatcccttactacctttacaccatcggtaaaagcgtagggtgtatgggggacataggagggagnaaacntgggactattttctaccnttctacctttattaccatgggagacctccccaaagcccctcccaatctcncaaggcaggcaaactataatancccccaaggggaagggacantgtgagaggctggtgaagncttaaancctggtgaatccctgtagaactccgggaacgcaaagcataccntggtgggtgggaatgaaatgggtcaagaagccctcccctattnatctnnacaagacttgncagtttgttccaaaaaaaacaaaaagagtacccctnctttttctattttgtgttgttcacaaaagttaacactgtccaggnacccctcatgtaatgttgnaaatnacngggaacccccnctgnagntgccccnaccgccanatggtacccnattcanccctgctaatctccctccccgcnanactgccccaagacccttacaatcaccaatcnaacaaactttaaanccccaggggagaaataaaggcatgtcttagcccttcaccctgtgaancctaagaggtgagaaactacagcctaca

SEQ ID NO: 556181 - DNA, 148 bp, Homo sapiens
gcaggtagcatctagtggatacttcatcctgccattcctccttcagctccgactcccctgtctcagggctgctccatgttctggtgctactgcagttctcccttagccccaacatctagtctgtatttcctgcctacttgtataagta

SEQ ID NO: 556182 - DNA, 922 bp, Homo sapiens
  misc_feature (397)..(397): n is a, c, g, or t
  misc_feature (418)..(418): n is a, c, g, or t
  misc_feature (426)..(426): n is a, c, g, or t
  misc_feature (464)..(464): n is a, c, g, or t
  misc_feature (479)..(479): n is a, c, g, or t
  misc_feature (487)..(487): n is a, c, g, or t
  misc_feature (699)..(699): n is a, c, g, or t
  misc_feature (708)..(709): n is a, c, g, or t
  misc_feature (722)..(722): n is a, c, g, or t
  misc_feature (724)..(724): n is a, c, g, or t
  misc_feature (747)..(747): n is a, c, g, or t
  misc_feature (760)..(760): n is a, c, g, or t
  misc_feature (770)..(770): n is a, c, g, or t
  misc_feature (788)..(788): n is a, c, g, or t
  misc_feature (809)..(809): n is a, c, g, or t
  misc_feature (861)..(862): n is a, c, g, or t
  misc_feature (881)..(881): n is a, c, g, or t
  misc_feature (890)..(890): n is a, c, g, or t
  misc_feature (902)..(902): n is a, c, g, or t
  misc_feature (917)..(917): n is a, c, g, or t
gagacagaaggaggaaggacagcacagctgacagccgtactcaggaagcttctggatcctaggcttatctccacagaggagaacacacaagcagcagagaccatggggcccctctcagcccctccctgcacacagcacatcacctggaaggggctcctgctcacagcatcacttttaaacttctggaacctgcccaccactgcccaagtcacgattgaagcccagccacccaaagtttccgaggggaaggatgttcttctacttgtccacaatttgccccagaatcttgctggctacatttggtacaaagggcaaatgacatacctctaccattacattacatcatatgtagtagacggtcaaagaattatatatggggggggagagaggtggaagngaagaggaggaggaggggggngggccatnccctggctgcatccgagaaatgttcacggcagggaggnatgccagggatcctnacaccttnacaacattcataaaagggtacgcgagtggggactgggagggagtaactggacatttcaccttcaccttatacctggagactcccaagccctccatctccagcagcaacttaaatcccaggggaggccatggaggctgtgatcttaacctgtgatcctgcgactccagacgcaagctacctgtggtggatgaatggtcagagcctccctattntcttcactnntttgcagcttgtncnaaaaccaaacaggaccctctttnctattttggtgtnacaaaagtanacatgcaaggaccctatngaatgtgaaatacggaacccnagtgagtgcccagccgcagtgacccagtcaccctgaaatctcctcgcaagcnngcccaagccctacatcacnatcaacaanttaaaccccagngagaataaggatgtnttagc

SEQ ID NO: 556183 - DNA, 839 bp, Homo sapiens
gagacagaaggaggaaggacagcacagctgacagccgtactcaggaagcttctggatcctaggcttatctccacagaggagaacacacaagcagcagagaccatggggcccctctcagcccctccctgtcctcacggagctcacacagtcatcggggggggaagacagacatgctaagtgatctagaatgtgagatcaggtgttgacgagactccgtctcaaaaaaaaaaaaaagaaaaagggaaaaaaagaaaaaagaagaaaggggaaagaaggctctgttggagcctggataggggaaaataccccagagggtccaattggaaagtcactttgaagcggaatgggtaagaggtaggaaaatcttaagtgtcctgtttcctgattaatcatcaggggcccccattttttgaacaattgataccaataactatttcagatgacccttcaatgaaaatttaagccggacatgaaacactgtcctcagcaagaaacctcaccattgcggggaaaaagaacctcagagggtgggccctgaagaactctcacttctacaggagtttgccgctgtcccaggtaagtgcggtgcaacccagaccacgggtgaggaggagaaactcctgcgagagaccggacggagaagccgaagtactggaatgcgtcctgccaaggatgggtcccgacacgggaagaagccgcttgggaggctattggcggaccaggaaacggagtcagacactctggccaccgggaacctgtttttaaaacaaattacccgttggtgcccgacaacaccagcggggggaaaacgccccgcgattgtcccaactcgccctgaa

SEQ ID NO: 556184 - DNA, 389 bp, Homo sapiens
  misc_feature (375)..(375): n is a, c, g, or t
tggagaaccccatctcaaagaaaaacacataattggtatttatgtaatttactatttctacttcaaaggtgccacacagccttcaggtgataaaacgaagcattgggtaagtctaagcactgagaaaaaactttctttctctccacctcccaacctccatcccaacagtggggacaggtgtttttctcgtgtgccttattgaacccttcagctacgtgtgccgagggagctcgtggtctccctttggggggaattgtggcagctcaggttgcgtggcagggaaccctcgaaggtggcttgaaaggattcatttaaaaataaacgctgtgtttcaaaggggtggtgggctgtgggccaaggggagacccatgtgangggatgtggccgca

SEQ ID NO: 556185 - DNA, 348 bp, Homo sapiens
ccaacatcatgaggtgctatctatgaaaagagcggtgccaaatggaccaaggtgcacgaactcaagggagcacaggggcaggtaacaggcatcgactagggcccccgaagagtaacctgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccac

SEQ ID NO: 556186 - DNA, 1404 bp, Homo sapiens
gccgacgtgctgagtgctggcgtgcctgaggctgcacgatgatgcatgtcatagtctataattcacgtcggtgtaagtgcaaagaattgagtgatgtgctacagataatggctaccgtgtggcgacatctctgtggccaagggaacaggatgaatgtatggatgactgcagagctgtcgtgtgcgaggctaggtcacgtgtgcatcggaatagtcccatatagattgtttgcaagcttgactcgtggtgatcgttgtgagagttgatccttgtaagatgtgaagtactgactaaagtgatgactagttggacaagttgatcggagtgtgtcatgagcgtgtgaccgctagttgagaagtgggcgataggattagtgtgagagtctatcacatcagaacctatggatgactgacctccacgcagacttcgttgagaggactcatctatgaacaagagatactatgttgaggcatgtgtgcctggtgctagatgtctggaacagatctatccatctcatgatgtatgtgacggaacagggagctataacatttacaagtctcatgggtacgtagaacgttacgagctcgaattagtgaggaggcgcgtgcaatcgtgcccaatgtgaatcaccactttcacaagcacgcaaatgaacgttggttggcccttggagacaagtcgccagttcggcatggcgaacgtgccaattggaccccttgactttggtccaccacgacaggcggaacgctgatggggacgcaatctcggcccgaacggggggaaggggtatgctaacgcagatttgcgaaccgtggaacgaaattgggtgcgcgactttttgccggcggtaacctaaacagtaaacaccccgaagtggacctatatgttgggcgccaaaggcggcgcgtcacggttgcgggcagacacctccggaggaggtatccacctatagagcgctaacagcactggtttgtgcacaagcgactgaacaacccacggccggattggcagatatttccttccccttccagattggaccacccaaaatgtgcggcgcgtaccacctatggtgattttcccgtcatcggcgcgcagtgggcggcaaacctccggggaggacatagggacatccacccgttacgtatctgtgtgcgattgggcccgttcgagcccagttatacccacgaggaacggttagtacagccacttaggtaggagaagacattcaaagagggaccttcatttgcaaaataacagcttttacacactgtactactcaataataacactcctgtgacaactctgactagtacaatcagcagatagatagacatcttcggagacactatcttcgttagctcaaataaccagctgaatatatatcacatctcgcaagtagactcc

SEQ ID NO: 556187 - DNA, 328 bp, Homo sapiens
gggttaaaaggaggtggccatgtaattaatgctttataaagaatcttggccgggcacggtggttcacgcctgtaatcccagcactttgggaggccgaggcgggtggatcacgaggtcaggagatttagaccatcctggtaacgcggtgaaaccccgtctctactaaaaataccagaaaattagccgggcgtggtggcgggtgcctgtagtcccagctactcgggaggctgaggcaggagaatggcatgaacctgggagacggagcttgcagtgagctgacatcgcaccactgcactccagactgggcgacagaagcagtccagtctca

SEQ ID NO: 556188 - DNA, 361 bp, Homo sapiens
  misc_feature (9)..(10): n is a, c, g, or t
  misc_feature (299)..(299): n is a, c, g, or t
  misc_feature (353)..(353): n is a, c, g, or t
tactgtccnnctgacagtgagtgagttctcatgagatctgattgttgaaaaatgtgtggcacctccccattctctcttcctcctgctctggccatgtgaagtgctgtcttcctttgccttctgctgtgattgtaactttcctgaggcctccctagaagctgtacaggaagcatggcagcttctgcttctaggagacctcaggaggcctccagtcatggcagaaggcaaagggggagtgagccactgcacctagccaagatgtctacttttaaatatttttatatttaattttttggtancttcaaaaaatcttgataattgaaccctaagtttaaaatggatgggtttaattnggtaatta

SEQ ID NO: 556189 - DNA, 851 bp, Homo sapiens
  misc_feature (182)..(182): n is a, c, g, or t
  misc_feature (184)..(184): n is a, c, g, or t
  misc_feature (202)..(203): n is a, c, g, or t
  misc_feature (210)..(210): n is a, c, g, or t
  misc_feature (222)..(222): n is a, c, g, or t
  misc_feature (227)..(227): n is a, c, g, or t
  misc_feature (265)..(265): n is a, c, g, or t
  misc_feature (280)..(280): n is a, c, g, or t
  misc_feature (282)..(282): n is a, c, g, or t
  misc_feature (291)..(291): n is a, c, g, or t
  misc_feature (293)..(294): n is a, c, g, or t
  misc_feature (307)..(307): n is a, c, g, or t
gggggagattagacaaaaaaaaatccacaatattccaagtacaactcttcatcaagttctctgttaatgccaagatttaacagacttaagaactatgtctctgaatgacagtgtaagagaaatgtaaattttttagaactcttgctgttaatctgtttggttgttggttttttttttttttntnaagggtaaaaaaaaaatnncaccttnagttcccggggngtganccgggttaaaagggatgattttccattgaaagtttggntgattaacaattaangngggatgatntnngggcaaaactcanttatgaaagtagaagcaaatatcagtgggctttgctaccacataaagccatgcgtgttttgggtcaaactgtttacccgggaaaatttcacatcatttctgagtttaatccactttaggatattttcacttggtttgggtgaattggctgaattgaatggtttttctttctcaaatctgtgatctcttttcttaatccggttctcttggtcccttccgttggcttcttattttcctttggtcccattcttttcttactttttcccctttccctttttgggggaggcgggctagtagtgtgtgagaaaagaatagcacgctgacaattggcactaatgaactgtaacgggaaactaaacagtctttcggaaggtacgctatactagcactttgtgaccatcttcagggccacaaaatttgttgtccaagatttcacacgggtttataattctggctaaagctctagtgtggacttaagggtatcctacctattgtgggcggggaattcgccttggttaaaggttggattaaaagcaagttcctcg

SEQ ID NO: 556190 - DNA, 659 bp, Homo sapiens
  misc_feature (16)..(16): n is a, c, g, or t
  misc_feature (29)..(29): n is a, c, g, or t
tgcaggctggttacgncccccggggttantgggcatggtgtcgatgcaagagaggggtcaaatcccagccaataagcatagctgtagtaaagtaggattctacctggattggtgatacccgttcatggacttgttacggcttagctaagactagatgacatggtacccaagtgaatggcgagagcacgtaccatgcccaggagaatccaggtactggcgacactcaagccaaagcagacagtcttctactgctacaaatggggtgagacgcaaaggtaagttcacttattgagaatcactaacatttgagaaaaccaacactacatgaagagaggcataaaactcaacaaacaagaatgaacactggagcaaagaggaatacttataagagtatcacagtcagagtatcttcagagtgactcagagagagtattgctatcctagaaactacgaatgtggctgttatgaaaaataaccaaacatagaaggcagaacaagtgcatggacagcgctgaagaatacatctgtgagcgtgaaacattcagctgtgaaatcctcctagaaagccagtgtaataataacaatgaagtgaacagtatgaaacacaacatttagagttctgaaggatatatccattactcaataactccaagtatcca

SEQ ID NO: 556191 - DNA, 824 bp, Homo sapiens
ttacgggcatggccaaaggagacggtggccaggaacaggcagtctcgtgcccaatctgtggacgctccctccagcccctgcgcaaaaagacccagccggagttgagtgcgctgccccgtgaaggccccaccttacacttggctgggtggccggagccagtgctcccagtgactgctccagaaccgagggaagctcgggtccctccaatgctagccgatggtgatggctgccggagtgccccggtggccccaccactcccctgtgccatgaccacactgccctgggtgccctcctccagaagcccgagatgcggggggccgtggagacaacactcctggctccccagagatggcgtgggtcttggggctgatgggccagtggccctggatgcccaggttcctgggactagtggccttggcagccatgcagggggtggggaccactgggcacccagagaaggtcctccacacatcccagtcgccggtctcccggacatggagcccttgaagagcctcttcctcaagagccctctaggggtcatgggaatggcagtggcagcgtgggagtggtgggggcggtggaggatggccggcctgagagggtctccaagtggcagcgggttaatgccaaccaccggtgtggacagacctgttcgactacgagcccagtgggcaggatgagctgggcctgaggcacgggtgaccgtgtgcgaggtgctgtcccggggacggcagccatctcaggagacgagggctggtgggcgggctcaggctggctggccacggtggggcctctccccgttcagactatgtgtctcggggtgg

SEQ ID NO: 556192 - DNA, 200 bp, Homo sapiens
gcccacctttgctcgctgggcagttgggcagctctactggcccgagcagtggtaacggggttgatggccatcagcactttgaccctgtatgtcgccgttatcaatgtgcactcctaggcatgatgtctcagacaatgatgtaccttctatccctgcctcgctccagattttagtgaagtaaacagtcattggaaatgtga

SEQ ID NO: 556193 - DNA, 360 bp, Homo sapiens
  misc_feature (336)..(336): n is a, c, g, or t
agacactattctcagagatgcccggcctggaccatctggctgttgttctgtgatggccgcggggaggggcttcggcttcttctgcgtgacactgaccgcttcttcagacacgttggagggacccttggccagttttaccaagaggtgctctggggatctccagcagcatcagatgaccgcagacgcacgctgagggttcaaggcaatgaccactctgtcaccagagagcgcaagctggattaccaagaagggcccccgggagtggagaattcctgctggtctgtggagccgtaattctgatggaaggagctgtgcccaccctgtacacttgggttncccctggctggggggcgcttttgg

SEQ ID NO: 556194 - DNA, 108 bp, Homo sapiens
  misc_feature (2)..(2): n is a, c, g, or t
antgaaggatgagagaagatggaactgcaggagatgcagctgaagaaggccaagcacatcgctgaggattcagaccgcaaatataagaggtggccaggaagctggtga

SEQ ID NO: 556195 - DNA, 397 bp, Homo sapiens
tagagttaaattatagtgttaatattatagtagcagagaatctaggggaattcatttaacattcttcattaatattctttactcaatctcaaatagcaaattttctccaacaaatttttcttgtatttcattttttgcatattttggaggtataatttatgtaccataaaattcaccaattttgaaataaaaattcaataatttgtgcagtcattaccataatcacattttataacatgtttatcacctccccaaaaaatgctgtacatattggcagtcacttgacattctcccctacctacacccttggcaaccactgatctatttgtatctctatggatttacctggtttatatatttcatataaatggaattaaacagtgtgtggtcttttgtg

SEQ ID NO: 556196 - DNA, 728 bp, Homo sapiens
aagaggaaaccaggcgctactgtggcagggagagaaaacaagcgctataatactaaggtcaagagaagtatcagcctcacctggataatattagtaatgaggacaagcctcaactccctctttctggagagaagcatccgaaggaatgcttgacgtacccctgtgcttctcttaacatttaagcaagctgtttaaatagcagctcttaataataaagcccaaatctcaagcggtgctttaaggggagggaaagggggaaagcgggcaaccacttttccctagcttatccagaagcctgttaaaagcaaggtctccccacaagcaaattctctgcaaaataggcaccccgtgccttttgatctagcaaagacccttaacccctcacctcaatgcagccagtaagttggatccttgtgtgcatgatccaatatcggttacaaggtaaagaaggtgtcgaggtctttggtagagtagaattatataagaaaaggctttaatttgcctaaactagttcacaaaaggtataaaccacagctaagtagcctataatatacttatccgtgacaaaaccacttaaccatacgtggaatacctgtcagactggatgcggtgaacttaatgtaatggaagtagcttgatgcgaagctttgtagatgaaatctttacatttctataaactgcgttttaggatcccgctaagagaggcacataatattcacaaacaaata

SEQ ID NO: 556197 - DNA, 450 bp, Homo sapiens
atatactagtggttgacaagttatttctgttagccaaaatggagattattgtagaaaataattagtggtactttctggatgaagacattccttcttaacgtaattatgccccatttcctgggtggagtcacagtctttcttctaaagacagattacttcaagctttagtagggactcttagttctgtcttgaactaacaataccttaaaatattctgcttcttcatgtgccccaaatattgatcagaaggatacttgtggtcaaatggatgctgtagaaattcaaaccagtgattttactccacttgaaatttaaaggattcatatgagttctagttgagtatgtcagttttagaacatagttcatattgagtaaacacagaatattttacctacaagggtcacacagatgtcattacagtgaatatacttctgattaaactaatcttgt

SEQ ID NO: 556198 - DNA, 113 bp, Homo sapiens
ccccaaaaaatgggaattttttttttccccttttccccccggatggggaaaaggccccctttggtaaaaaacccaaaaaaaaattggaaaaataaacccctgaccctttggca

SEQ ID NO: 556199 - DNA, 368 bp, Homo sapiens
caacgaagtgaaatatagatatatttttttcaccatttttagaaaaggaaaacacgtcaacttgggtaggatgtaagtctaagagagttcgtgattattttatgaataaaccaactccttctaaattccgttcaagcccgggaaggtttccgtgacactctgaggggggggtgaggggcaataacgatgtacagaaatatgagctcatacagtgtcatcttgaccaccttattcgtttgtgaaaaaacgatcaaatatttcaaccttaatcttttcgtacggtgtaaagtcggactaacgtttcatacaccagtaaaaaaagaaacttcaacctacccgatgttggaaatatgtaagattcttttgag

SEQ ID NO: 556200 - DNA, 611 bp, Homo sapiens
taaaggagggagaaaaaatggcacacaaagcagggaatagtaggctagactcatgggggggtaattaccctagaaactcctaactttccaggctagtggaggaaactaaggaaggcctcccaatattccaaccctcaaagctcacactggcgccccagaaaaacaaaacactcacccccaatccgaatggaatcatctggcatagaaaaccagagccagcaggcctagggaaggagcggatgtttggtggccctcctctaagcacatactagttcagtgggtatgttctggccaggcagtggtgggggccttcaagagggcctcacataaggggaaaataaaactcacgtggaggggtgtcctcctttcccaacattcttcggtgtaaaattttcaacaaattttggtggtggtgggcaaaaggtctcaaactttataccattcagcaccacttcttaagctcagaaaagcagaaataagggtcacttataatggccttagggtgtggtccccgggggtattcccccccttctggcgccatcattatttttggggtgtcctattaacttaggatggctctcctttaaaacaataataacagaaagataaac

SEQ ID NO: 556201 - DNA, 437 bp, Homo sapiens
aatgttaaaggattataattaatggaattaaaaaatgcagggtagtccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggcccgtttggcccaagcaaatttaaaattgggcaagtttaagcatggggccggaattgggggtaaattggccaattccccctaaaggggggcgtattaaaattcaatgggcggggttttaaaaaggcgggaatggaaaaaccctggggttacccaatttaaatgccttggaaaaaaatccccttttcccaagtgggggaaatgcaaaaaggcccgaaccaaagggcttttccaaaaagtggccaacctaaaagggaaagggaaattggaaggggaaaaattttggta

SEQ ID NO: 556202 - DNA, 97 bp, Homo sapiens
gcgcaccagttacattgatgaagctgaggcggcagattacttatggccaggagttcgagaccagtctcgtcaacatggcgaaaccctgtctctacag

SEQ ID NO: 556203 - DNA, 502 bp, Homo sapiens
  misc_feature (262)..(262): n is a, c, g, or t
agtatgttcctgagacacagagtaacgttgcactgaaaagtagcatgctctgcggcctttagaatagtctaattatagttggggagctacaccattacgcatctccactgctttctccatcttgtcatgccatataagcggtacgattctcaattatctacgcaggacggacagagatacttttaaggaaagggacataatatgcaactcaatttctctaaaagccaggagaaatcatttttagtcagaacaaacacacttngtctttcatctttttttttttttggggcaattaaggagtaaaacgggctatttaaaacatccatttaatggcaatttgggatttcccaggagaacagggtcactcatttaattagacgggataatggcccacctttaccatttccctcctctcccaggttttaaaaaagtgtagctttagcccacacaagtcaggtcagccgggagtcctcacatctaaaagactcccactcagatgaaa

SEQ ID NO: 556204 - DNA, 410 bp, Homo sapiens
atacagttgcccgccaccatgcctctctaatttcgtatattagtggagatgaggttatcaccatgttggccaggctggcctcgaaccccatgaactcaggtgatctgcccgccttggcctcccaaagtgctaggattacaggtgtgagccactgtgcccggctttttatttcttataatcgaggttagtgactctgaaatctagctcagctttttgcagcatgcatttcagcacatgcatcatttatcattcacaactactccagcaaaccacattcaggctctggcacccaaattgtctgcagttccaagtccttgcatgtgctcactttcagctgtgtgcaccttgcagccaaatttctcaacgccatttaggtcacccttccatccatgggcacagccataatcatc

SEQ ID NO: 556205 - DNA, 443 bp, Homo sapiens
  misc_feature (105)..(105): n is a, c, g, or t
cagtccttcacgtatcgcagtgagagaaaactgatcagcatcttccggagacacctgatacccatcctctttaaggaatacctaggataggataaagtaatcctnctcacccccccccccttaaaagatatagatgcactattgtaaagtggctgtaccactggatgtcataaggtgaatgtaccaatttgtaagtcgctctggataagagcgtctgctaaatgacttaaatgtaatgtaatgtaatgtaatgtgtcctggagggcaggtagtttgcccccggtgatgcgttgtgcagacctcactaccctctggagagccttacggttgagtgcggagcagttgtcgtaccaggcggtgatacagcccgccaggatgctctcgattgtgcatctgtagaagtttgtgagtgcctttggtgacatgccgaatttcttcagcct

SEQ ID NO: 556206 - DNA, 416 bp, Homo sapiens
  misc_feature (17)..(17): n is a, c, g, or t
  misc_feature (37)..(37): n is a, c, g, or t
  misc_feature (55)..(55): n is a, c, g, or t
  misc_feature (224)..(224): n is a, c, g, or t
attggaaccacaacccngtttttggttttgaaaaaanccgtccttaagaaagaanccctgttaccctaagccatccccattgaagtccaaagcttgccagcccagtagagatgacttgtattgccaaatacagtaaactttagttttgtcattaaaaagatggatttgggcctcaggacagttgaggtttgaataatgagtcctgcccagttagtagttcctcnctggttacatgaacccatttcctcatctgttaagtggggataaaaataactacacttaaggattttaaaggattaaaggggataatgtatataaaatatctgacattcagtgtggtggttaatgatttatatgtactaactactcttgattactgtggggaaaactgaagaaataaaaatcaaagagcctga

SEQ ID NO: 556207 - DNA, 604 bp, Homo sapiens
tcctgaggttcgactctaaggatcccccctgaagggtgctgacagactgacgctggctccttttctgtagtcacacacctaattgctagtctagtagatcaacatgcatcacatttttaggcaggacctagattttaccctgtcaagctaaagatgaaattaatttcagtgttgattcagaactgaacattaagtaggccctcgtccttgcagttggccacttgagtgtcgatgttttgtatagattttttaaggtgggcatttccctttaacctctactttttcaaaagcaacaaaggggcctcaacctgagttacctatgggcctctcttctgcatccccaaagcggccaagagcaaaatcctgggggataagacaacaagtgtaaacttaggtaggattgtgatgctcaaaataaccatctagcaatatcttggcgcttgagaatagctttggtgggctaatttcttcttgcctcttccccatcctttcaagagagaacttattttagaaaagtatctatttatacacacaccacacagacagcacacatattattatgtaggtttttataccatactgtattggcgagaatacactatca

SEQ ID NO: 556208 - DNA, 213 bp, Homo sapiens
tctagaggatcccggcgcgtggtgggcatgggcagaaggactctacgtgggcgacgaggccagagcaagcgtggcatcccgaccctgaagtaccccattgagcatggcatcgtcaccaactgggacgacatggacgaagatctggcaccaggagcacacgaagagccacgcgaagagccacacgatgagccacaccaagagccacacgaagag

SEQ ID NO: 556209 - DNA, 722 bp, Homo sapiens
  misc_feature (488)..(488): n is a, c, g, or t
  misc_feature (596)..(596): n is a, c, g, or t
cttggtttcccaggtgaatggctctccccaggatatattggaacctgttccccaagtcctgcattaccatgggccctcgggccggcgggtttggcctcctggggtcttaggggccaaaacaaagcccaagccaagttgaccttgggtgggaagggcctataggaggataaccagctcgctggggcttcaaggacaccagggcccccccaagtcccaagtgtcctactcctggcaaggagttgggtttggaccaaaagtgtttaaaattaatatgttggcagtgattagaacacccctgtttacataaaaaccatttttctaattctaacaagttagaatgtgaggaaggaatgaacatgagtgtttaggaacctgccctttggtgctgggctggcgtcccgcactggggtgtcctccctgtttgggggctgctttgctgccccggcccaggtccccttgtggtgttgccaaacgggcctcatggtttnctgtgcaaagaaaggcaggaaggatccctgaaaagttttggaaaaaaggttttgtgccctcaggtggggcttaccccctggtatttataattttaatttaaaaagtgncccccgtggaaacaaacgccttttgtattgtcatgtacatagtccaaacctgagtgctggacataagttgttttgtgtataaataaaacaagcctgtttttgattttcccaaaaaaattctgcgta

SEQ ID NO: 556210 - DNA, 271 bp, Homo sapiens
tcgggggggggttttttttaacaaagcttttttttttaaccctccgattcccttggaaccccctccccccttttttttccccccttaaaaaccccgggggcggttccccccccgggtttttaccttgggcccggggggggtttccttttttccccgggaaccccttttgccctttggccttttttggttgcccttttaaaccagttttttccaaaaaaccgggtgggtccggttcgggatttcccgggttttttttccccccgggtcccca

SEQ ID NO: 556211 - DNA, 242 bp, Homo sapiens
atgcaggccgcgtgagccaacaggcactatccgaggcgctatggccacatcagaggggccagtatacattgagagacagcatcttgctctgcgctagtaactacgcgcaaccactgactcctgctcacaaagaagcccctgcctcagccttctgagtagctacgactgcaggcacatgccaccagacctgactgatgattatggtgccatgcgcagagaccagagcaccgctgtgacgacca

SEQ ID NO: 556212 - DNA, 390 bp, Homo sapiens
aaaattaaccccctaataaaattaattaaccactcattcatcgacctccccaccccattcaacatttcccgcatgatgaaacttcggttcattccttggcggctggctgatcctccaaatcatcacaggaatattctagccatgcattattcaacagagggtctcaaccgtcttttcatacaattggcccacatacacttggggaagtaaattatgggctgtttcatacctctaaatttcagggcaatggggggctcactattctatatctcgtctctttcaacacatagggggggggtctatattggggctcatatctctactcagaaatctcacacatgggcattatactcctgctcgcactagggcaacagtcttaggggctatttc

SEQ ID NO: 556213 - DNA, 782 bp, Homo sapiens
agcggggcaatcgcaggcacatcggtccctcaagctaacaaggcctggcagtttcctcctcacgtcaacgagtggcaggcaacacgactgacctttggcaggcagaatcaagtcgtaagccttttgatctgtctactttgggttctctaataaatggagatgaaacagttctactagaagagtggtttacagagtctctcagttcttgctagtgtaaaccggcgtattagatctggcttgagtctctgtgtgtcttgcttggagtataaagggaaaaaagtgtttgaacgaatgaatagcttgagccttgtgaagaaatcaaaagagagtgagagcaaagctctgaagtaaagctgattctgtggtggacgcactagagtgccaggcagatgagacatgggtacggctgaaggccgatggacagctcgagagaacgcgccatctgggaagtgcctttggaagtcaagaaaatttgacggtggaggacaacgatatgactcactggtcgtcaacatacagcacgtacgaagcgtgtgacaacatcaaggagcacgagattgatacacgaagcactgtattgatggcaacgctggctactagatagcataatccctaatcgatttatagatacgttagagattgttgttcagaccgttgctgtgatacggacatcctagagacgaagcatgctttggttggaggtggtgaaaagtggtacctagacaggatggcctgtgaccaaagtgcagttatctacaagactgtttgctacacaggagagc

SEQ ID NO: 556214 - DNA, 505 bp, Homo sapiens
agagatagccccaaatggatggtgctaaactattcatgagaatccgcccccatgatccactctctttccaccagaccccacctcagcattagggattacaatttgtaggaataatgcttacaattttaagaaattgaacacttgaacaaaggatatttagcaaagcaattttatttttgcgcagagaggtgcctttttggccagtcgccatgagagcacacttgaacaaaggagtacgagagcctttatttttgacgcaagtcttgcccctgtatcctttttttattggctggggtcaggtgtataaaccaattttagttggctaaacatttgaatttttttagataaggtgggcacatagaagaaagaggaaaggggaaagggtgtctgtagtgagtcagaaagttgttttttttttttttttaaataaggaaaggaatgtgagttggtactgataatggctggtattgtggcatgcctgcgcatttaacaaaggcagaaagga

SEQ ID NO: 556215 - DNA, 413 bp, Homo sapiens
acgccgggccatgcatcatatactctagaaatcgcttcaacgctataatccgccgcttactattaagcgtcgatggcgtacggtacacatggcatgaccgaggtaatcgtcccagcagttatagcgttacagatctgggagagcctaacctctactgcctactgctcattgagctagcagcgatgcttaatcagcgagcgcttaggagaattgggacgacacgagggaagactgtgcatctgacgggtgacgcaccagatatgatggcctgccctgactttccaccagtcgagatgtgatatcccgagactatgcccatacagatgagagcctctgtggacctgactgtcaagacggtaacatgtgctatataacacgcggtttcacaacagccgtgcatgctggtaccagtc

SEQ ID NO: 556216 - DNA, 912 bp, Homo sapiens
  misc_feature (229)..(229): n is a, c, g, or t
cgcatacacttcaaatacacgggttttgtatgtttctgttcaacagagtgcccgatggtgggcgccaccaaaaataggagttacgtcaacagttggttacagtttcaagtgtggaacgagatgaacagacactgtaatggttcctgggataacaagaaagagacctgtgaataacaatgtgaaaaactgtcgaagtcctgcaggaaccgctctgcttgccactttaagnggaatactttctcccccattgccaacacctgatatgtgatggggccctacacctgggagacgaatataataatatggggggctggacgcaacagggtatgtgtagaaaaaaaaaggaagggcggctatttgaaataggcagcgttggcgagtattgagaccacctgttagtggtccccttctaaggggaacatactgctcccgagactatttgatacttggcgtcttgtgcggcagaactttcttttgttaaaagatgatccaataatggatttttgagctgttatgacacgaccggagtctcctaaacgctgtgggttttggacaaaactcggctgtgttgaccagtttccgcggggctccaaaattttggtacactcttccccaaatagttttggggtaaaaaaagttttcatctcccccccacttaattttctaaaaggattgtgtaaaatttgtcccttctcccagcgttttaaaacccactgtctttgtaaaactctgtgataaaaatataacccctatgcccctgtaaatatcgggcccaacattatggtgaaccacttttttttcttatattaaaacacacgaaggcccaccatatttttggagatccttttaaattttttttttgaaacaaagtttccaagccaagaaataaaaatccatgtgtttttaaaaaaa

SEQ ID NO: 556217 - DNA, 746 bp, Homo sapiens
gtggtgggacctgtctctactgagggtacaaaggtgggctgggcgtggtggtgcatgcctgtggtcccggctatcgggtggctgaggcaggagaatcacttgaaatggggggtggaggttgcggtgtggcccgagtgcctgtgcacacctgcactcccagccctgggctgtgaccgggatggttgcagcacctcccgtcctccacgcacaccacgggcacccacacgcaaacagcgaacacacggccccaccttaacatttacaccaacctggttgcacttgtgcaggcgctggccaaagacgggaaaaccagcccaactttaaaggaacattttcccacgaaacattccacggcttggggggttgccggcgttgggggcttccaacgaaccccttggttaaaattaccgccaagggacaactttttctggtgcggcacgggccctttgcattgtggccagcaggctcggtggatttcccaagccaaaaaggtggttcccagcgccgacggtttctccccgaaacgagaaccttaaaggaccccttgtggtgttccaaaaaaccctaatttggtgtcggacacaacacccgctcgtttgggtttcccttacgcgcagacgcttgtggacacgaggggacatttaacgcgaaaagagcagaagaaacggtgacacttcccagcgcgaccgttttcccccaccttgaaaggttttggggggctttgggggggagaaatttcttgggca

SEQ ID NO: 556218 - DNA, 103 bp, Homo sapiens
ttgatagcttctacagttaggttgtcttctcttttcggtttcctactggttgatgtgcttgtcttctctaatgtagacttgagtcttgcaaatgcatcagctg

SEQ ID NO: 556219 - DNA, 342 bp, Homo sapiens
  misc_feature (71)..(71): n is a, c, g, or t
  misc_feature (78)..(78): n is a, c, g, or t
  misc_feature (183)..(183): n is a, c, g, or t
  misc_feature (259)..(259): n is a, c, g, or t
  misc_feature (261)..(261): n is a, c, g, or t
  misc_feature (331)..(331): n is a, c, g, or t
tgaccaaagccgtggcgcacgtggacgaaatgcccaacgcgctgtccgccctgagcgacctgcacgcgcanaagcttngggtggacccggtcaacttcaagctcctaagccactgcctgctggtgaccctggccgcccacctccccgccgagttccacccctgcggtgcacgcctccctgganaagttcctggcttctgtgagcaccgtgctgacctccaaataccgttaagctggagcctcggtggccatgcttcctntnccttgggcctccccccagcccctcctccccttcctgcacccgtacccccgtggtctttgaataaaaaaangagtgggcggc

SEQ ID NO: 556220 - DNA, 886 bp, Homo sapiens
gatgtcggctgcgtggccagtgcgcaaaccatattacggtcggtattggtgcgcctcggttcggttatcctccggcaaccatgtgctgacaagacgcgatatggtgtgagcatcagagaaatctcgataagtcgagaaactgcagaggaccgagacgcaagagaaaaatcgcactgccttccaacagaaacgattgaccaggagaagcaagcaggcgaatcgtaggtgaggcgtgcgcggtcacatatgcactgtacattccacaagcattgccttcttatgtttacttctttaagctgtgctaactgttgtaagatgcagagaggttggctcaagtttaactgactgtgtctgcccctttcatgatcatacagaactactgacaagagaaggccgggcttgacttgcccatctgtctatctatctggcatggcagggaccggaatgacacttgcatgttggtgaaggaagagaggtggggggtggaagagaggtcggggggtgttgccgacagtggacactctactaggtgagataggcacacgctggtcccaaggtgtccttgcagggcttgtaattgaccgttctaatgcagagttgcgcattgcacaggcttctggctcacactgatgtgacttagtggtaagtgccccaagttagtatacgtgcggccctatgaggtttgtaacctactgattatcattcgaaggaaccacttctttcgggtgaacaaacccagtaggacactggtgttaaaccacaggtttggggacgggcgccgatgtcttgggtcacaagtttacaacgaggttttagcaccatctgtgatgagaaccgtgtgctacaaaacaaaggctggggagcgtgaacaaccaccggtcggatg

SEQ ID NO: 556221 - DNA, 775 bp, Homo sapiens
  misc_feature (38)..(38): n is a, c, g, or t
  misc_feature (73)..(73): n is a, c, g, or t
  misc_feature (112)..(112): n is a, c, g, or t
  misc_feature (172)..(172): n is a, c, g, or t
  misc_feature (202)..(202): n is a, c, g, or t
  misc_feature (231)..(231): n is a, c, g, or t
  misc_feature (300)..(300): n is a, c, g, or t
  misc_feature (317)..(317): n is a, c, g, or t
  misc_feature (383)..(383): n is a, c, g, or t
  misc_feature (399)..(400): n is a, c, g, or t
  misc_feature (424)..(424): n is a, c, g, or t
  misc_feature (462)..(462): n is a, c, g, or t
  misc_feature (539)..(539): n is a, c, g, or t
  misc_feature (561)..(561): n is a, c, g, or t
  misc_feature (627)..(627): n is a, c, g, or t
  misc_feature (640)..(640): n is a, c, g, or t
  misc_feature (646)..(646): n is a, c, g, or t
  misc_feature (672)..(672): n is a, c, g, or t
  misc_feature (747)..(747): n is a, c, g, or t
tttctcctttttaatgtggtagatgtatcccccgtgtnactctgtggtcttgtgtctctctttcgtccttttnctggtatccgtgccttcttgggcccgctgctcttggctnatcactaggcgctaggtctgggtccagctccagccctctggcaaagtcagcatgggcctnctgggcattccacaaggccgcgtgggcctngcccgcttgaagtaggccttgacgttgtngtggtacttgtggaggatggaagagcagtggtccagcacctggtagtacttctcgaccaccagcttgcnctggcagttgttgagcngcagcggcgtgacctgcttgtgcagctggatccatttaggggacccaggctgttccttcatctgcnggttcttgaggcaggnnatggcatcgtagttcttggcagcngcctccttcacatgcgcctcgcggtagaaccggttgcnctcctggtggataagtggcactgcctttgccttctcttcgtctgttatggcccatgggtgctgctggtacgttccangactcttcaccttcagcatctncatgttgaagaagaggggctgggggttcttctgcagggcgttcaggttagcatggcccagggagcngttttcacgcatnttttcnacaacgcagcagttccgctggccctncagggggttcttgcccaccgcgatgttgcggagacttttggccaccagcgggtacaggaccacatgctttaagtnacaaaggaactgggcaatctccccttct

SEQ ID NO: 556222 - DNA, 595 bp, Homo sapiens
  misc_feature (448)..(448): n is a, c, g, or t
caggatatctttccatttatttgtgtcttcttcaatttttacatcagtgttttatagtttccagtttgcaggtaatttactttccttagttaaatttatttctaagtgttttattttttcactattataaatggaattgttttcttgattacttttttagatagttcattgttagtgtatagaaacactattaatttttgtatgttggttttgtgtcctgcaaagttactgaatttgtttattagttctgtttgcagatgacaggatcttatatgtagaaaaattctaaagattccattaaaaaataattgtacactgccaaaaggtgttattgttgttgttgttgttgtttttaagacaggcttttactctgtctcaaaaaaagaagagagaaaatgggcaagagatttgaacagacacttcaccaaagaagatatacagatggcanataagctcatgagaagaggctcaacatcatttgttattaggtaaattcaaataaaccaccatgagataccacacacaccactagaatgactaacatttaaaattactatttaagcccggtgcggtggctcacacccaagcctgaagt

SEQ ID NO: 556223 - DNA, 429 bp, Homo sapiens
gtgatggcttctctgactggatgactgagcgagttgatttcacagctctcctccctctggagcctcccttacccccacggaaacgcatcagatagttcagaaagcaagctgaactgggaacgggtaaagtgtgcatcgcacgcctcatcagagcaagggaacccagcgaatcgggacaggcaccgaccgctcacacacgcaaaagtgcgcggcgaccgaccgttgaagaataaagaggacgccccccacccaagcgcgcactacgatgatgaactagccgcgaaaagcacaccagaaacggacacaccacaaaccaaccaaaaagaacgccaagcaacaaaggggcgaaacacaacacaaagacacagctcagcacaacagcggaggaggcacctcggacactaccgacgaaccaagcaacgacccccg

SEQ ID NO: 556224 - DNA, 911 bp, Homo sapiens
cggtgcgcgccaggacacaagcctatggcgtggcaaacgcgaatgaccctcacaacgggcgtccatgggaagcttgcggcccaaaaccccagtgggacctgtaacgcgccctgggctctccaagggggcgttcgaccgctgtaaccaaaggatccgggacgctacacgggaccgttctcctgtcgccgcctttggggggctccaaccaacgagggagatgccaactccgaacgcgctcggttctccaacgacagcgataattgtcggcgcgtcttcaagggggcaacggctccatcgatccaaacccaacgaggggctttttcgggccaaaccgtgcgacggctgggacagcctggcaaagggcctgatcaacgacatggccgctctcaagcctggggaatcgaaagccaagggcatcttggcaaaagaatcgcccgaacagccgctgtaccacgtgctgcacaggtattgcgcgcaaggagccagcagtcctgcctcggctggggcaccaggggttgcctagacaggccctgaggccacacagatggctgcccgtacggcactggcccatgggagccaaccggaactcatgaattagcctggtccgactcacacatgtactggaaacaacgggcacagggatgtaagatcgcagcaatgccatcagtgtctcaaagagagctctcagaggcctttgcatcaactgcgcagaagttagggccagagaagaggccagggaggccagtagagggccagggagtgagtgtttagaagaagctggggcccttagcctgccttatgattgggaagatgggcttcaatgagatggcaaaggagaggacaccgaccagtggtccaaaaaggctgctctcttccacatgatacagcatcgggtggggcagcagggacgg

SEQ ID NO: 556225 - DNA, 239 bp, Homo sapiens
aacgagggaaaccttctcctctggggctttgttgccaggaatgatcataaccaaatttatttttttcatttctgtcacgaaatcattccagatacctcttttcttctttccaaagggttttcacatagtgtttgaaagtaattgtcccttgaattgtcggtttttccatgtccacctttctcctttgtgcccagcctgagtcagcaccatcccgcattcacaacatcccagtgaaaggg

SEQ ID NO: 556226 - DNA, 1154 bp, Homo sapiens
tacactgtgaaggtggaggtgatcagccggcacttgtcccgtccttggggcttaggaaccggggcaatgggcgtaccgcagcgcgtgttgagctctctgctcagacagacgtatccaggagtcagctcgtcggtccgagcgcttcgctgctgcatctcctaccgctgaaggacgaagactgcgggtagccgctagtgagctacatgggagtaactattgaggcaatgtcttcaccgaagatttgtagatgacggggaaatgcgcactgttcggttcacaagcgagcctccctgtggatatctagtctaagtaagatggcagtctcgattctgtcaacccagagttggacgtgcaggttggaacgagcttgagttcactggcaagccacaggaccagtttccaggcagatttacaaggtttccgtttcagctatgagacctggcatcagtagaggcatgtaagtgttgatagcaccaggtgttcaacgcgtacacatgcagtgagagacgttcagaaattgtgagaaagtttaaaaggtaagaatggttatcagatccaaaaaagactatccgtctaagtaagaatttccagtgttccgtggaacatcttcagacttcttactgtgggcttgtgcgaagtggatatgcgtatgacttgggttaaaaagcttaggaaattagacttgagtcacaacatattaaaaagcttcagttacaattgggagaactcaatacacctttcaggaattcactctggaggcattcactgcgggcacttagtgtgtaacctttgtcgactcccactcccgaagtactttcggagtttgggaccctgggaaaacaatcaagggctccgttgcgttggcaccccagggatatacaaatttaactgtcgcaaagtgaagggatcacgaccgtgcggccagaggggcccacttaacaccccgcctgtggacgcggtgacaaaagagccctaggcccgtatcacacaaacacacgaaaaaaggagctcgagaaaatctgaccagcaatcccctaagaggcacaccactgccgtgacccccaacaaacgggcgctacccaccagcgggcgaggtacggccacctcacacaaccgaccgcgcggcaccatgataaaattgatctttctaccgg

SEQ ID NO: 556227 - DNA, 830 bp, Homo sapiens
gggcaacccactcgggtccccttccacactgtggaaagctttgttctttcgctctttgcaataaatcttgctactgctcactctttgggtccacactgcttttatgagctgtaacactcactgcaaaaatctgcagcttcggttcctgaagccagccataccagagcccaccggggaggaacgaacaaaatccagacgcgccaccttaagagctgtaacactcaccgcgagggtcccgggtttcattcttgaagtcagtgagaccaagaacccaccaatttccgggacaccacccagcaacttggggaggctggggtgagtggatcactttgaggccaggagttcaagaacaaggcctggcaaacatggggaaaacccggtctctactaaaaaatataacaattaacttggttgctgtagtcccagctactttggggggctgagacaggagacttcatttgatcctgggaggtgaaggttagagtgagctgaagtctcgtcactgactcaaggtgggggaaatagcggagagtgtctcaaaaaaacaaaaagattacaaaataaaagcaacaaaattcttactaggtacatttcaaaatgattccagagtatacattatcgtctaaatacaaagaaaaacaagttgtttaaagtaatctaattagaagtactggctgggggaaattctatggtagcatggtttaccggggtaaaataatccttggcgttataactggtgtttctgaagtttgggagaatctaggtatgttggaatagcgtccataggtaaatttggcgtcgaccctgttgtgtactagttttcccagggg

SEQ ID NO: 556228 - DNA, 833 bp, Homo sapiens
  misc_feature (27)..(28): n is a, c, g, or t
acttaggctaagtacgaggctgggtgnngcgacagcaccgctgccgccgtctctaaggtcgcccgggtccaccgccgccaccatgcctcggggaagccgcagcgcggcctcccggccagccagccgcccagccgcggccactcgtgttcatcgcggcatgtccatgcttctggggatcgtgacgaggaccgatgttcctgtggtctagtctgcttcattgcgcaggcacatcgaagtgtaactacttgcaaggattcagtcgagagatgagttctcaaccgaagtggtagggcaatgtcggtcaaaactagtccatgggtcaactgtcgtagccatggagagccttccatacaggcgtaccagtctcgtcatggcgctttctagttctcgcatcgcgcgaatggatgctggcctctggcaaagggcgtgagaccaacgttcgtgtccggcgaatttggcccgagggcagacagcgccgagggcatacgaggcggtctcgctgaacgcatgcaaagaacgcagacgtggacggccggacgcctctccttccaaggaacagtcaaggagagccagactgaacggatgagttgagggtaaaaaggcccaagaccgccattgaaaaagctgcacattgggcccgtggtacggagagaaaacgctgaacgcgagagcccgtgtttgggactctttcaatgacccatggggtttcttggacacggcacgggagcacccccaatcttcttgtgacgtttccctgggcagacatcaacctttcgctaggaatgaagagaaagtgacagactttattcaacagaaagaatggggtagaacca

SEQ ID NO: 556229 - DNA, 974 bp, Homo sapiens
ggttttgggggagcactctggcgacagagaaccctgggggcctccgggggcccccccccctttgatttgttcccaccccgcggtgagatcatgatggtgtccccctgggtttttcctcaggggggccgcctctactttaggtgacccctccgcggcggtgtgaggatagaaatgctcccccttcccttcatgaaattttttgcccaccggcggtctttgaagaccaacgagaagcctcctcgcggggggaaatcaaaaaccgaggttagtgaatggcccacaagagtgtctgtcgcccccctcaagcgggagccgagttagttgatgttgaggacatttctccccgaggatgggtccttcaggggagatcgtagtcacccgctcgtggtaggatgggttataacatcggagaggggcgccccaaaagattctcttcccccggggagcccacaccatattctcgccccccttgtgggcggtcccccccggagggcgggaagctttggcggcggctacccctgcggttgctttgttatggtcccccatccaccccccccttttttcgttggatccacgagttcaacggagagtcctggtttttgtcgtctatctgagctggcttttgcgacaaaaaagatctcaagggcgacaacaacatatgggccgagaaaaatcgtgctcgcaatcagtaggggaccccccgaatatgtgttattctggtgagcaaaatagattcgcgtgcacacagagggggcaacaagcgttgatcccccgcctgcgcttaacctagctttttttttgggagcacagctttctccccactggtggataatggccccctctgtgtgggtgtgtgtgggtgtgtggtgtgggtgggtaagttcaagcgacccttgggccgtcaggctttttgggcaagtacttaaaaaggggaaattataatcaattagcccttttgcggcccctaggcctta

SEQ ID NO: 556230 - DNA, 376 bp, Homo sapiens
  misc_feature (27)..(28): n is a, c, g, or t
acttaggctaagtacgaggctgggtgnngcgacagcaccgctgccgccgtctctaaggtcgcccgggtccaccgccgccaccatgcctcggggaagccgcagcgcggcctcccggccagccagccgcccagccgcgccctctgcccaccgccgcccgcacctcggcagccgccccaaaaccccgacccctatcgggccaacacagaggcctcatggctcagaatgggcgaaccaacaggcccagcagaggcgtagcacgatgggactcgcgctgtggagaaccacgatcatggagcagacaacaccatgaaccggcagaccctatcagaccggcggggcagcctcgagaagacccctcccaagccatggcaagtac

SEQ ID NO: 556231 - DNA, 192 bp, Homo sapiens
ggggttttttccccccccccctttggggggcgcgggtttttttttttaagggggcccttttttccccccgggaaaaggtgggttgggggggggtttccccccccttttttttaccgggggtttttcccctttgggcccgggggggggggggtttttttttttttccccccaaactttggggggtttttccca

SEQ ID NO: 556232 - DNA, 821 bp, Homo sapiens
ggcggctgactttgtcttctccgaacgactgtctacagaggtctccagacgccttctctctcctgtgcaaaaggggcaactcttaatggagaaaactcaagttgcaccagattgcggaacaagaggcaacagtcttccaaatcaagaagatcatctgtagtgggtgtcggacaagttggtatggcgtgtgctatcagtcatgctgggaaagtctcttggctgattgaatcttgctcttgtggatgtgtggaaagataatgcttaaaggagaaatgatggatctgcagcgatgggagctttatttcttcagacacctaaatattgtggtcagatataacgcaattgattctgtgaccgtccaattctaagatggtatgtggtgaactgcaggatggcttccgtgctagcaagaaggggagagtcggctcaatctggtgcagagaaatgtcacatgtcttcagatccatgattcctcagatcgtcaagtacagtcctgattgcatcatagttgtggttaccaacccagtggacattcttacgtatgttacctggatactaagtggattagccaaaacagcgcgtgatcgcaagtggatgtaagtctggattctgctagatttcgctaccttatggctgaacaagcttgtgcattcatgcccatccagctgccatggcatggatctgggggaccctggcgactcaagtgtggctgtgtggagtgctgtggacatgtgcgcaaggtgtgctctccaggacttgataccagaaatggggaactgacaatgatagtgacacactgggacggatgccctaaaaggtgt

SEQ ID NO: 556233 - DNA, 295 bp, Homo sapiens
tgtatgtgtatgggtacatcatccgacatgaagttgcattatgaagaatggagagagaattgaaaaagtggagcattcagacttgattttcagcaaggactggtctttctatctcttgtactagactgaattcaccccctagtgaaaaagatgagtatgcctgccgtgtgcaccatgtgactttgtcacagcccatgcatagctcaagtgggatcgagaccatgtacagcagcctccatggcggttcgcacagcatgccgcatttggcatcggctgcactcccaaattctgcttg

SEQ ID NO: 556234 - DNA, 776 bp, Homo sapiens
  misc_feature (387)..(387): n is a, c, g, or t
  misc_feature (482)..(482): n is a, c, g, or t
  misc_feature (484)..(484): n is a, c, g, or t
  misc_feature (549)..(549): n is a, c, g, or t
  misc_feature (595)..(595): n is a, c, g, or t
  misc_feature (600)..(600): n is a, c, g, or t
  misc_feature (631)..(632): n is a, c, g, or t
cggacgcgtgggtcgacccacgcgtcgcagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccactttttttttttttttttggagagacggggtcttggctggtgttggcccaggctgggatgtggcagtgggcctgggtcatgggcttcaagggctcattggcagcctgggacctcctgggttcaaggtgatcctntggttctcagtccccttgagacaatcccccacggcccagctacatattttttgtggggatacggggtctcattctgtggcctaggcttgtctggnanctccggggctcaagggatcttgtagccttagcctcctaaagtgcggggatataggcatgagtcantgtccccggcctgctctaccgctttaaggacgcttatgatcacttngcgcntacccagagaacccaggtcgtctttctattnncaggtcagctgatttagccccccttagtcccttctgcaattttagttccccaccgggctgtgtaccctacacttagtcacaggctctggggactgtcccgtggacttcttggggaggccgttattcggcccaccgcaccctcgt

SEQ ID NO: 556235 - DNA, 950 bp, Homo sapiens
gtgatatatggttaaggttctaaacttgtgtaacgcgatacttgtgagacttgtgacgatcaaagtagggtatgtttcttacttaaggccttgattaaggacattcgtgtgctcatataagatcgtttgcacgagtatgcatttattataactgtagctttatacgcggtttcacgagacctgctgtgagaacatgaagttatgcatagatccattggttctctagcatggttttactataaataggccatgtgcagatggctcacatctgtaatcctgagcacttttggtgccggccgaggtgtgcagatcacgagaatcaggacatcaagaccatctggctaacacggtgtaaaccctctgcctctacatacacaaatacaatgagacgttagaccagtgcgtggagggtgcggtgcctgttcgcacccagactaactcaagggaggctgaggcatgtgaaatggtgtggcccccggcgaggtcataagctttggcaagagagctcgagattcgagactagattgcataccagaacttgtagttggcagagtgagactcagtcctcatttagtacatatcttattttaaatttaggcctggggtctgttttgatgtgacaagtaccctaccttctgataattaattatgataatgggtgtgatagttaacactggtcttttaaggattgccaaacagaccactagttgtctgctgaattggactttatttatcggaaatgtctgaggttagtcacgccgataggagagttgttcctggttaggcaaaacttacaaaaaatatcggtttgtaagggcaaaaacaaataatgaggcagttaagatcgtgtggcagattgtattaaggcgagattggaaacaacttcgaagagagttaagagaaaaagaaagagagaaggagaaatagaaatatgtgaagtcaaatgtgtg

SEQ ID NO: 556236 - DNA, 148 bp, Homo sapiens
ttcaattaaagcctcaaagcagccaaaaccaggctttcccccttcctggagtttgaatatccaggatcctttgtacttcttgttggttaaagtgtttattttggtacaaaatacaatatcagtagttaatacaatcatgtttcacagc

SEQ ID NO: 556237 - DNA, 116 bp, Homo sapiens
gatagagcaacaatgacgtgcaggtgagcctgagcacaaactaaagtggctcaactcaccagtgagggcttcttggaggaagcgacacttagggaaccctctcacagggcctgttc

SEQ ID NO: 556238 - DNA, 352 bp, Homo sapiens
tttgttcttttcttaaatgccctatgcccattttgtcattgggatattcatttgtacccattcatctactgcaaatattaactacactgggttacaaatattttccccaccctgtcatgtgaattgcccctcccccacccgacctgagcttattaaggggtaaatggtataaaaaaaaactgcacgtaattcatgcatacaactgggtgagtttggatgtatgtatacactcacgttgccatcaccacaatccaggtaataaacatatccatcacctccaagtttccttgtgtccctacgtgtgtgtgcatgattgtgtgtggtaagaatacttaacgtgagatctaccctc

SEQ ID NO: 556239 - DNA, 307 bp, Homo sapiens
ttgtggtcccaacttttcgggaggctgaggcaggttaatcatttaaacccaggagccagaggctgcagtgagccgagattgtgccactgcactccagcctgggagacagaacaagactctgtctaaaaaagaaagaaagaaagaataaaacataaatgaagcctatatgaggcttcagtgaactagtcttggaacttttcagtaggttgtattgaaggatgatatctgaaataagacaatttattgcttactatagcaagggacaactgtgctttttaggcacagcttctctgggcatagagattgc

SEQ ID NO: 556240 - DNA, 426 bp, Homo sapiens
  misc_feature (24)..(24): n is a, c, g, or t
  misc_feature (52)..(52): n is a, c, g, or t
  misc_feature (67)..(67): n is a, c, g, or t
  misc_feature (81)..(81): n is a, c, g, or t
  misc_feature (149)..(149): n is a, c, g, or t
  misc_feature (197)..(197): n is a, c, g, or t
  misc_feature (360)..(360): n is a, c, g, or t
  misc_feature (392)..(392): n is a, c, g, or t
  misc_feature (411)..(411): n is a, c, g, or t
gacccagcacagaccttcccaaancagtagcctcaaggctctgagaaccagncattttaataaggancaagactcccttanctgcatactcctgtggaaagactaactgccctacacccacatgttattccccagcttcccaaactttntcaggtgactcagttacacccaacatagttatactgcaaagatgtgtnttattctatttcagttctcagaaactggtgttccaaatgagtagtatgcatagcaactttatggttaccagaacctatcattggtgaagctgtctagagcagcactgtctgaaagagctttctgtgatgatgcaaacattctctttgctgaccaatatgggancacatgtggctgttgagcacttgaaatgcagnctaggtgggattgattttnaattcatcttttatt

SEQ ID NO: 556241 - DNA, 752 bp, Homo sapiens
  misc_feature (67)..(67): n is a, c, g, or t
  misc_feature (198)..(198): n is a, c, g, or t
gggaaagataacttcaggcccccggccaggttggatccagtgtgtaaggatagaactaaagaatccncccccccccatcaattttcagaaatgggatggtctagtaaggataacctttgttaggaaaaacaagacactctctgctgcatttaaatcaagtgcagtgcaacaactcttggaaaaaaactacagaattcnctgttcagtccataatattataaaccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaaaaaatgaattttgtattttttgtatttgagaaaataaagcttttgctttactgagacattatttacttgactatttttggttcaaaaccaccactgttgtccccatttatgattttgaattttaaagttggaaagttttaaggatcaaagtttttaatatataaagctggtcccatctattcataataattttcaagttcaggagccgcaaaaacgcccaactttacacttatcatttttaacagtttattgtataaaaatgttacttttctatttactgttaaaaactgtaaggccttttttaggcctttagctttgttcctccagtaataaaaaagtttaaatattga

SEQ ID NO: 556242 - DNA, 246 bp, Homo sapiens
gcagtggcaggatctcagctcactggaaactctgtctccccaggttcaagcaatcctcctgcttcagactcccacattactgggattacaagcatgtggcactatgcctggttaattttagtattatttagtagagacggtgtttcaccatgtttgtccagcctggtctcaaactcctgagctcaagtgatccacctgctttggtctcccaaagtgctgggattataggcatgagccaacacgctc

SEQ ID NO: 556243 - DNA, 213 bp, Homo sapiens
cccgggcgattgcaactaattttccgttaaaacctgcaaaccatgcatctttggcatcattggttgttcctgtttttccacctaaatcgttacgaccgattttaagtgctgctcgtccagtaccatgctgaatcacatcgcgtaaaatattagccatatcataagctgagctagattttaaaatgcgttgcgcttggcgataattactccttt

SEQ ID NO: 556244 - DNA, 712 bp, Homo sapiens
aatttcccaccgccctgttgtcgatgaaggaagctgtacttatcggaatcaatgaaagacaccgtatgttattggagtgcatatcactagtacatgggcggggcgccaagtgcgggtgagtaaatgtggggaggtgcctcccctgacagtgtacacccgctgcagacccccgtttagacactcaccatgtagcattgttacacttagaccggcgctgacacataacatgtgggtcctgtgtagacatctcccctatttttgttgcccccgcaagatacaggcattgggacatgtgacacacgacatcaatgctcgctccgaattcagagcgacattctgtctcatctttaagacacaccaaggagtgttgtgcgcagccaccgctgtttgtcgtgctcccccagacagggattggtcgcggtggggggcgggcacccagaagtgtcccacacgccgtcctcttctatggcgcgcacacgacacccgttcttgctggtggactcaaggagcgttggcactccctatgtctctcgcccctatcgaccgcctcctcttactggctctctttggcccccagcaattatttctccaccttgatttatgccatatccaaaacaaaccttttggtcaagcctctgtgagggagacaacaccaccattgtttcccaccgtttctctcccctcctccccccgcccaacaataacaaacaaa

SEQ ID NO: 556245 - DNA, 361 bp, Homo sapiens
gttattacgaacctgcgagacgatggtttcggtggtgacaatcgtattgaatgccagtacagcctggagattcgttacctcggtacagatccacgagtgcagcgtcgaactgagctgcgaccggctcgaccgtagcagcctggcggccctgcgcgaatccttccaccagcggcacaaggcgctgttttccttcagtgagcctaacagcccggtcgaactagttaatctagagtgctcggtgatcgcgcggttacagcgtccaccaatgcctgaacttgcaaccccgctcaaggcaacggccgcgattccggctggtcatcgtccgatgctgttcaatgcgccagacgattggcaggacacg

SEQ ID NO: 556246 - DNA, 457 bp, Homo sapiens
tgggaaaggcgttgctagggccaaaaggaaaacaagaaaccaaaataggaaagactgatagagtcaagtacagttgtttaaaattctgtgtctcagaaagcacctaaacgttatttaaaaacagagtgaggaaaatatatgctacaaataaagcaaacggctaataaaaggtcattcaaatagataagaaaaacactaaaatcctaatagaaaacaacagcatagactacgaatagactagagtgggagaggtgcatccaagaggctcaaggtgatttctgggtgtacagggaaaaatatgggaactattttttaacctatcctttaaaactctattttggtgaacagtggataccctaaataccctgactgacttgatcactatgtgttatatacatgtaaggaaatttcacatgtaccccacaatttgtacaaataaaaaactttaaaattcaaa

SEQ ID NO: 556247 - DNA, 293 bp, Homo sapiens
gtccctaacaaattggggggggccctggccctattactatccttcctcttcctggcaataatccccttcctccatatatccaaacaccaaggcataatttttggcccattaagccaatcctttttttgattcctagccgcagccctcctctttttaccctgaatggggggacaaccagtaagctccccttttcccttctttggacaagtggcatccgtattatatttcccaccattcctattcttaatcccaactttttccctaattgaaaacaaaatattcaaaggggccta

SEQ ID NO: 556248 - DNA, 100 bp, Homo sapiens
gcacaggcatgcagctgtcaggttttgcgcttcaggcaggttcattggccattgttctcacagtcacttcactatgcactcagccaacacttcaagcctt

SEQ ID NO: 556249 - DNA, 123 bp, Homo sapiens
ttacgaactcgagctgagtaccctcgataagggcacttcgagttcccttcaccatttccgacgggatctacggctcagcattttttgtagccacagggcttccacgggacttcactgtcaggt

SEQ ID NO: 556250 - DNA, 215 bp, Homo sapiens
  misc_feature (5)..(5): n is a, c, g, or t
  misc_feature (74)..(74): n is a, c, g, or t
  misc_feature (117)..(117): n is a, c, g, or t
  misc_feature (127)..(127): n is a, c, g, or t
  misc_feature (170)..(170): n is a, c, g, or t
  misc_feature (206)..(206): n is a, c, g, or t
gaatncggcacgagggctagggggcttttcattccatcatctatttttcactatgaaatccaagtttactgatntttttttgtcttctttgtcacatggtgcagcttgcagaatctnagttccctgnagtatggattgaaccggaaactcctgaaatggaagtgtgaggncttaatcatgggactgccagggaagtccccaacttnactaacctt

SEQ ID NO: 556251 - DNA, 449 bp, Homo sapiens
tagcaggatgccttatcatttcagttccctggaacatgacagcgatgacgcggcatcgtctcggcatcgtggccctcggcaggcctgggcctgcgaattgtcgctgaaggggtggagaccgatatgcagcagcggttcctcacccggctagggtgtgactccttgcaaggttacttattggggcatccattgccggccgatagcttcatggcgaatatccggggcgccgaacagccggcgcctgacaaaagcagtcagtgacgggtattcttggatccaaccctaaacatccggttgaatcgggaggccgcagccatggacaaagtcgtcatcatcacggggggcagtcgtggcattggcgcccaaacggcattgctcgccgctcgccaaggctatcgcatctgcatcaactaccagtctgatgaagacgctgcccgaactgaaatgag

SEQ ID NO: 556252 - DNA, 379 bp, Homo sapiens
tcaaaagctgcagctgggtctaactctttggcagtgctgccaaggaaacaagctggaactcatcttcctgagtcaaaccctgacacggtggtgagcgcatttatccctttgcagaagggcgctcatgttcatgtgtatccccgaatcttatcccaggaacacggagaagatccaggtttcaaaataagagaatcacacggaaaggcgattactttcacgccctgagtcaagggcgccacaaggagagacattcatgcctgtgacccatctaaggagataaaggcgtgggaatatcacacaaaagattaaaattgactttgccctttgaaaaacaataagcaattctggatttgaaaccacccatcttgtgatattaaaa

SEQ ID NO: 556253 - DNA, 298 bp, Homo sapiens
  misc_feature (9)..(9): n is a, c, g, or t
  misc_feature (30)..(30): n is a, c, g, or t
cccaggttnaaagtaatcctccccaggttnaaagtgatcctcccacctcagcctcccctaatagctggggccacaggtgtgcgccacccaggcacagttaatttttgtatttttagtagagatggggttttgctgtgttgcccaagttggtctcgaactccctggactcaagtgatccacctgccttggccttccatagtgctggaattgcaggtgtgagccaccatgcttggcccttgtaattggcaagattttaagcaaggcgatctgtgttcaatacccatactcttgaccacga

SEQ ID NO: 556254 - DNA, 918 bp, Homo sapiens
ggagcgcagagcgggttggtcgttcgttgggcggtgctggttttcgctcgtcgatgcggctcttcctcgggcagcggaaggcgggccggggtcggagaaagtggccataaaacttcggcgctggggctgcaaagaaaatggcccgaaccaagcagatgctcgataagtccaccggtgggaaagcccccgcgcaaagagtggccaggaacagccgccaggaaaaggcgctccttctaccggcggggtgaaagaagccctcatcgcataagcaggcccgggcgaccggtgccggctcgaagagattccgtcgttaatcagaggtcgacgcgagctgcatcatccgggaaagtcggtgccccttcacagagtgttgggtcgagggcaacatcgccgccgggattttcaaaaaccgaaccttgagggtttcagaagccgcacccaaatcgggtgcccgctgcaggggagggttaggcggaagggggtacctggggggcccgtgttccgaagtattcccacctggttgttgccactccacggctaaggagagtttacaccaattagtgcccaagagacttccagtgtgtggctccgccgaaatacgggggagaagagagctataagtgaagagacagttaaatgggcgttggcgatacatttccggtaacaatacctgggttaacttggcactttgtgtgcaaaacacttgtaataagaggttgcctgtgacttagtacatgcatcttccactcgtatatgcgaaagtggtgtccaagacctagtgaggtgacctgttgccgcggagtacagtgtcaatagccaaggcagggaacttgggcccagaagggtgaggggcaagcgtgggacactgagaaagctgacgttgcgcctgcaaacgtccgtccagttacggggtccacc

SEQ ID NO: 556255 - DNA, 1130 bp, Homo sapiens
tatgagaagtacatggtcggagcatggacgagcttatatctcaggtggatgagaagaggaagaagcgagacatccccgcaatactcatgatgtggcaagatcatgctttgagctgatgcggcgagccgtgcatcacagcccagtgtgcatcgacctacgacctgcaaggacatcgaggagcacctgtcagcagtgtgtgagtcatatttgaccccgtgacccggagccccctggacccaggaaccaagctcattcctccaactgtggactatggaaaggacggtatactttgagccgacacttgcattcatactaggagcaacttgagtctgagggtagggacgggagcttagcgtgaacgtgctatccacgtgggacccataaagccttgagccagtctcaatgggatcccacgcgggggaaggacgcccttggggggcaagaatagtacgcacgcacggggcaccgggtaagtaccatctacaggctgtgcctagggtgtacgcgtgtgcgcacacgacaccccgggagcctgacgcgatttccgcgcgccaaagggctgtcttagacacgtagggtagagagaaccataccgttggtggaaacgatcgggcacattatcatcacgacgagttcatccgaaggagcgcacttccacgccactatattatggcacgaataggagaagcccccagtagttgcaaatctcgctgctatcacaaccaccaccaatattatggcgtaaggagaggggcaaattggaggcaaaccatataccaggggcaaagcgtgggagttcggacacgcacgagacggttggagcgcccagttggagcggccccattggacaagagggagcacaccacatttttaggcacggccctggccctcgaaccacttaaagtttcgcattgggctgggcgttccaactttaacgacgacacactttccgccggatattgtggaccggaccacaaccccggaaaaagaagcacgcacaccactcccaaacacagcagctctcctctacgaacacaattcaagaacgacgcaatagctgctccaccacatacatcactccgcctaccacgaaacccaactagagacaataacgcaaacagcaacaacaa

SEQ ID NO: 556256 - DNA, 277 bp, Homo sapiens
tgattatacaggactgctcaatcaaatgtcaaaatgtcgaggttcgacctacagagacagtgtcacgtaaccctctcctgaacgcccatcaaactacgagcgtatctcgtcggcagaaagcctacaagccagaagagagtgggggccaatattcaacattcttaccgaaaagaatttcaacccagaatttcatatccagccaaactaagcttcataagtgaaggagaaataaaatactttatagaccagcaaatgaagagagattttgtcaccacca

SEQ ID NO: 556257 - DNA, 243 bp, Homo sapiens
gggcccctggggcccctgccccggcaggggcccagggggaagggggggcccctctctggtggggggtccttgccacactgagtccccccccccagtggatctcccctcctcccaggtcccatgtgggccccttgacggggggggggcccttggggcccgccccttgtcttgttccgccaataaagtgccctgtgctctgccaaaaaaaataataatgatggaggagaatgaaaaaaaaaaaag

SEQ ID NO: 556258 - DNA, 93 bp, Homo sapiens
ggattaggccttttaattggtaaaaaaaggaatacatccctaaaaaaaaaattccaggattttcccttttgttgttcttttgcaaccggaaag

SEQ ID NO: 556259 - DNA, 407 bp, Homo sapiens
gtggacgagtaggctggatggtctcgatataactagtatgggataaggggtgtaagtgtgcacatgtcacctgtcatcagaggccttccctgaccactgtcagaaagacagccctggctttcgctctcacctttccatctcactctgcttattgttctccattgccgctgtcaccatttctcatattacttatttcttcctcatcattttcctctctcaccttggaatgtccaggaaaaactttattttcttaatctcttaaaacccaaaacagtgccggccagatatacgtctcctgaatatatgtataatactggctctgagtccttgtgccatgatcctacaacaatttcatgtacctttattggtgatcttacgtaatcattctatacgtatgtcgtccaggc

SEQ ID NO: 556260 - DNA, 651 bp, Homo sapiens
  misc_feature (61)..(61): n is a, c, g, or t
gagcccgtgtatccgacggcagtggaatctgacgcccgtagtcgcgccgtgccgaggtccncgacctgacacttgacatgaccatggctgatcacttggccacgaggcttcggctccctgccagctcttgaggttctggacttcacttacaacaagttgagcgaaaattctcttcctggcaacttcttctaccagaacaccctgcgtgcacgtctatctaagtgacaacgatatcgaaatcctgccgccagatatagggaagctcacaaggttgcagatactcagccttagggaatacgacctgatctcactgcctaaggaaatcgggtagcttaacccggcttaaagagctccacattcaggggaaaccggctcaccgttctgtccccagaactaggatactctggatttccctggccagaagcaaggtattcgaaagcagagaacactcgctgggtgacccccattggagaccagttcccagcttggcgtgtccccatgtcttagcgtatatcccgttctgagacattcaaattacctctacggtagacacatgcaggccatccagaatcaccgaaaaacatcatgagcaatcgaaaaagatcagccggaaacccttgcagatccgataccgtcaaggaacgagcacaa

SEQ ID NO: 556261 - DNA, 320 bp, Homo sapiens
cacagctgctggaagactacgtggaagccatcgagggtgtcagaaacgcacctactgcggcactccgcagcccagtaagctcacctttgttgggagcttgccaacggccgccttcagttccaagatgggacgcttggctcttgggcgtctaccacggcctgtccccccaaccacatggagctggcccacgagctcatggagactttttaccagatgaaccgcgcagatggagacggggcttagtccccaggatcgtgcacttaaacctttatccccagccgggccgtcgggacgtggaggtaagccagcagacaggcaca

SEQ ID NO: 556262 - DNA, 321 bp, Homo sapiens
aagaaaaatccttatcccccctggatcaactttgggtgttattcccaagggactgtcatttaagtaaatgtgagcgaattgggccttgtgcccaaggaggcaaagttatttggggaaaatatgccccggtttcccccaatcctgaaaatgatggatgtataaaagcagtcttactggtttggcagccattttatatataattattgagggctacccccccattgaagaaactgccctttctgtgatgtttttgaatactacccaacagccaaacatgtttgcaatgaaaagatttttttaattgttaaccttaaagtggga

SEQ ID NO: 556263 - DNA, 173 bp, Homo sapiens
tgatattaaacaaagtaactttagaatgagtgacatattacataggaatttagtgtcaattaacatgtgttataaaaacatcatgggaacaatgctatagaggttactattattgactacacacagttgcagtttttttactgtaattacccattaatttccattcaaagcca

SEQ ID NO: 556264 - DNA, 214 bp, Homo sapiens
acaatcgcagcctacgggctgaggtggagaccatctccaaggaactggagctttagtattgacagtgctaccatctgttgctggagggcctggagggggtgctgcgggaccagctggccctgcgagccttgaaggaggcgctggagcatggccagagccttgggccggtggagcccctgtacggtccatcaggtgctgtcctgtattgcctggt

SEQ ID NO: 556265 - DNA, 140 bp, Homo sapiens
  misc_feature (7)..(7): n is a, c, g, or t
tgcggantacatcccctgtcctgatggccatgggaggagactggcctgcatctctcataagacttagtacttgacgccatgcgcatctactatgtaactagtagttcaatcagtagtaccagtgtgagaagcttcttgct

SEQ ID NO: 556266 - DNA, 338 bp, Homo sapiens
  misc_feature (63)..(63): n is a, c, g, or t
  misc_feature (158)..(158): n is a, c, g, or t
  misc_feature (190)..(190): n is a, c, g, or t
  misc_feature (229)..(229): n is a, c, g, or t
  misc_feature (306)..(306): n is a, c, g, or t
aaaaaccaaggtgataattcatggctggcagatatttacaaaggtcatatttccccataattngtcaactaatctaggtttgtgaatctgaaaagttaaagtccttcattgcatgaaaattttaacctgtcatgcatttgacaaattcattacttatngtttttctccaatcatgaactacatataaatnatacatattttaaagtaaagcctcagggtttaaattttncttttctattggctttgaactgctcatcttcaaaattttaacattgttctgaatccaaatttcagtttgtgctattnttattcaattcagtctcttcatattttttgag

SEQ ID NO: 556267 - DNA, 402 bp, Homo sapiens
gcccgtggagcttatgcggaccagctgcaggcacaggcagtggtctaaccggaagctggtgtgccttggttcgaaccgcagtgggcctcagggttgtctggcgctcaatgtggtcttggtctgggccccactgcaccttcgagactgtgccccttctcagccctcgtaactgggttcaactacggagctcggtgaagagtctggcttcaaggggttcaggccgaaggaccagacttctggtgggcatgcagtctttctggcctcggtggctatctcagggacgctaggctgcacgttgcgtgactcgtaccctttgacgtggctaaagacccaacgccagctcgctctgggaggcgagtggaggctgtgagagtgaacccccgtgcatgtggactccacctg

SEQ ID NO: 556268 - DNA, 266 bp, Homo sapiens
accgcggcctactgtctgacaccacatcttatttctggcctgtataatttgattattttaagtaattcaaataagtagaatcttacagtatctatccttttaactttattttattcatttttttttttttagacacgggatctggctcggtggcccaggttagagggcagtagggcatccatagctcacggcagccttaactcctcagctcaaggggtcctcctaccttagtctcccaagtagcggggagacagggtagagccgag

SEQ ID NO: 556269 - DNA, 984 bp, Homo sapiens
  misc_feature (619)..(619): n is a, c, g, or t
gttaatatatagtatgtgatgttgctcttcttgatctgtgcctttctgttattaagactatgtatacaaaagtgctagtgtttgtgtgatacttgcttcatgtatcataatatataagtacaatcttctcgctgatgaatgtatgctgatatgaataaaatctaaaccatgtgtcttacgaaataggacgaatagactagggttgtatttttcatgattttatagttgtagaaataatttagagcagaagtagaaatagagagacatggagagaacgatgtcttcctgctagcaggtaagtcttgcgggacaggagctgaaaatctaagagatgatagtaggaagtgtggagactttatcgataaaatctatgaccgctcaacaatgttttgcagcttgattattgtcaattgctactgttccttctcacatctatgctaccatgtgctcagctgtgctgcctggacgttaagacatagcagaactccagaagtttaaggcattcacggtggtagagtcttagtggagaaaagtcctttgaccaaagatcggaacccactgtgttaaatagttaggtgggacgtacttaactttgccgaggttttatcgtaatgttccncatgataacgcctttgtgattgtggtctccagctttttactagataacaaaaaaatttttgcggataggatgctgtggatcccattggggaagaagctcaatcctctcactgttactgaacttctgcacttcgctgttggacatatgtactatcggagcaacgtacaactccggggttgaacatacttataatgagtgctcacatacctgaattttgctgcgtcccatgtgtcatacactgatgggcattgtgattacctgtgcatcgtgttcgtttggcatccttaatttgcgcgaacacttggtccaaggggctcagcaaaagcaaagttaacagttttagaaataacactacaaagaacaga

SEQ ID NO: 556270 - DNA, 1170 bp, Homo sapiens
tcgggggtgcgtgcgagggtggtggcggtgggtgggggggttgttgtctggtgtgtcgggcgtcgttggggggttcgtggctacggccccgtgggagggcgtgtacgcagaactgcttggccaggtgggtttgacgccgattggcgcccgggttcccaaacgggggaaagcgttgagtttgccggcatatgcgtccggggtgtgatgagatgtggtgtttgtggcgaggaacatggggagggtccatgggtagtccggtgccataagtgattgaggggggcgtgttttgccgaagacacagggggggaaactttttgtttgtagaggcaggctacggccgcttctcgtggggggtgcgcgacaattgtccggtggttttcttgccggggggttttcacgggggggaacacactttgtggggagtcccacgggtgtttgggggggggaggcttccgagggctcttggggccgagctgttgtgaaggttgtctttgtgcgccctgtctgtaaggccgcaggataacaaagaagtgtttgtcgtccactgatttttaagggtttgtggagttttttggtgagactcgtttgttttttttttggtagtgttggggggccgcccacgttttatgtaaaaggtgttgttttgagagggtgcctcatgttggccgcggggctcggggtgcccacggtttttgttccgcttttgcccagggggcgcctctggcgtcccctctcccaggattccaccccccacggcccccgctggtgtggcgccacagacaccctaagattttgtccgaaacacaccccattttgctcccacacctctcctgccactggcgcaccgaagacccggagacccccccttcaatttttatagagattggggaataagggagagaaaagggagggcccaccggagaaggtttcccccgaatttttttttacaaaggaaatttttttctcccacgagagtttgagaattttttggtgcttttcctggtgtttttggccaaatataggggggccccgggtgttcaaatagcgggaaagaggggctggcccgagaggagtcccactgggctttcacacacaccacaggtgttttgtaacacaggactgaatgggtgaatattttgtttttttggaaaaaacagaaaaaaaatggga

SEQ ID NO: 556271 - DNA, 365 bp, Homo sapiens
tccgacccctacataatgagtgcccagtcattataagtacggctgcacctagcgtcttacaaaactattatttccttgaatttatctactacaccctgactgtgatgccctttaactgataagctggtcctgcccagcctgcttataaagcccatattcagaaatgtaccaggtgtattaaacagaggcatcatttaatggaaatctgcacttcaaaacagcactagaaggaccagccattggccctccaatgtaaatacttctcatttcacattatcacagaaacagtgcagtttactaaccactccttccttataagaaattcagcagctgcaaaattttttttcagtttcaaaacatttcaa

SEQ ID NO: 556272 - DNA, 116 bp, Homo sapiens
agtcgcatgggtttgtccacgctcacggtgctctaggcgcaccctcctgccctagcagagcccaggcttgccctcatgaagcatcattgacatagcaggagcatgttgatttcttg

SEQ ID NO: 556273 - DNA, 662 bp, Homo sapiens
tggcttggtaaataacttaaagggttgatgtgggagtcacaggggaggttatgttggccccaagggttcttcagtgccatcctcaaagctggttagtgcatgggagtgtagggcagagtggtgttccagttttctctccaggaaggggttatagggaggtcccagagagcccctaggaatgagtccctcggtaccatggcaaccacaatttaaaagggtgttctggcccacccttggaagccctacccccaaggtccagcaagatgagaacagggaggccaagattgggccaatttgtctataagacagccgcctgtatccaagatgccacatctttggctcgcttgggtgtcattttacttcttctggggcagatcctatggccagaaactcttttctccttctcacactggtgtagacctgggacgccaaagtggcagagtgtgggcctttggctagcaaagacggcctttcaggagccccaggagcggacactccgcatcgaagagtgggagaaggtggcggcacacccccgacgacagaacgccctataggagagcagatcgagacaacagagggaggccacaagacatccggcaggaaaaagagagtaccgaagaagacaccccccccaagggcaccagagagagagagagcgccca

SEQ ID NO: 556274 - DNA, 1017 bp, Homo sapiens
gacttcccggaagcgcagtagtaccctgctcaagttcatcctgggttgagcgcggacggagaacattctgagaatttatgcgcgcacagtctcggggctgaggcaggacccgcagcagcactagattgctagctcgacatgtgctaaagctgggctagatagaccgtagattgcggagtcgctggtatccggcaggctctggtgtgtttgacctagacgacggtggacttgaatcttgcatccttgcaagggttttcctgacaacgcgggtaccctaagatgacttaattacctaacgaagaattgggtacacttctcatgacgatagaacagatttttgccatagattaccagttgcgacaagaagcggtgatgggacattcaagaggcaaggtacctttggtggaacccagatggagaagacaggcaaagcattcgggaaacatatttattcacccaaaggtcggaaatttgacacatactgaccaaaggaaggaaattgctaatcgaggggttcttcaggttgtcattgaaggttccaccgtttggtcaccggccggaaaatgttaccccttttaaacttgcaggaaccaggtttagccatggaacacggtcttgggggcattgagggaccagagaacttcccggttgacttagtttcacggaagcaaattgagcttcccatttcacaggcgtcggtcaattagaggctttatacctttaccggcactctatagagttcggaccgtaattggcctcgtccactcttgtaacatgggcaaggaaaccctaactgggttaccgacagggttaaaacaaaaaccttgatgtttccaggccgcgtttttccttcgaaatctctttgccttccttggggcacttcgaaagcggcgacctttttgggaaggccaaaaggttggcacatggccaaaacagggcttaagcgaaggggcccctgtgcgcaagggcacacactttacgcacctgcacgttcaaacttccagtggaaagttccag

SEQ ID NO: 556275 - DNA, 306 bp, Homo sapiens
tcgtatacggatcggcgggggaaacaggacggagaggctctaaccgattgcccgtcgtgtaggtcgccagcgaagccagcacctaagatccgtcgtgaattggtgcccatccaatcctgcaaacttccaagaagggcagtagataacttttcaagaagaaaaagaaattgcataaggtccctacataatactgaggctgaaacgagaagaggctgtccactgtaaaagcaaggcacttggggcaggagccaggcaggtggcctgagcagggtccctctaagtgagtcaacagcttgagacacgcga

SEQ ID NO: 556276 - DNA, 327 bp, Homo sapiens
gttttggccccccggctgccaaggaggcaggggtgccagctccccccgctccgggagcccttaaaaaggaggggaggatggcccttaacgggtcctgcaaaccccccccctccccccagggactggggaggaaacagggtggtcctccccaaaactgtgagctttgagttaataaacttaaagggcttaaagctgggcccgtcgaagcgtttgctattatcattagcgcagtgattatcatttcctgtgttgtcaaataccctgcaaggcgctaaacaaaactttttgttttcaaagatggcaaaataaaaaaaaaatgaggatgga

SEQ ID NO: 556277 - DNA, 748 bp, Homo sapiens
  misc_feature (620)..(620): n is a, c, g, or t
  misc_feature (673)..(673): n is a, c, g, or t
  misc_feature (722)..(723): n is a, c, g, or t
agactgagctcagtagccaggcatgaaagagactgggcaagttgcaggggctaattggaaaggggctgtcggttgcacttggggtttaaacaagaggtttcttttgcaatgagaatttttaggtggctaagatcagtcttcttggcaaaaaaataaactaagcatagagtgcagttggatatgaccgaggaaattacaaaaagggctccaggagcaaagtctgagctttccttatcagtgttgcagtggaatagctgggggcctgatgctgtttgtgctgatcatactttgcaaatgcccacactttgttgctgtttgtctccttggacgaggtttgctgcaacttcaattccttgacttcggccttactttgttttcatagcagcaagaattgaagacttaagggtttgagcagatggttttctacctaaattgaataattcaattacgtattctcaactagcatggatttgggtcatggaattaaagtagaaacgtatccggcatgacttctttgtgcttatcaaaagtgatcctgataaacagatcttgctctttcatgtaaagaagtaaaagttatttatgattccatctgatatacataggagagaaactgatanaagaattctgaagggcaactgtatgataaaaagctatataaagtccaagtgtncaatttccttcaaccataattttgagcaaacccaaggatttaaagtccnnggggaacctgaacaatttaatttgg

SEQ ID NO: 556278 - DNA, 325 bp, Homo sapiens
gtgacacctcatgactgactatcctaaatcacgtatgcagttctcttagcagggttattcgtgcggttcatcgtgagtagaagcctgctgctgtgcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcatcgtcacatcgtcacttaga

SEQ ID NO: 556279 - DNA, 181 bp, Homo sapiens
ctgtgctctgtggacaaatgctcagacccaaggtggcttggtcaggatcgcagcgttgctagttctcacctagcctatgtccccatagggcaaggagggtctgggctgctctggctccgtgggcactagtgcttggttggtggtcctccgcagcttggaaaccaactccaaacgtgttctc

SEQ ID NO: 556280 - DNA, 153 bp, Homo sapiens
acaggatgatacgaccgaagactacgagaagcacttgacggtcatgaactatgacccggatgtggtgctgaagcaggtgcactgtgaagagttcatccccgagtttgagaagcatacccagaatttccctggacggacgtcacaggctgagat

SEQ ID NO: 556281 - DNA, 750 bp, Homo sapiens
ctaagaagaagaaacgggacgatggaatcgcgagcacgtgaacgggctgtgcacagatagatggagggattcatacagcatcgacaagaaggacaagctcagatacctcaacagcagccgtgccagcaccgatgagccccccgcagacacccaggcatgagcatcccagcacagacccacgcatccacccgggcaggctccggagcggagtccggagcagacgacgcgctgctgtcctccttcactggcagctggtgacagtgacatgcatcaagttcaaaacaggctcaagtgccggaaggaaaaagctcaagttcgtgcgaagagccaacattcacgaacatggggcttgtacagccagtggagcccatccgcaggactgacgagatggtcatcgaaggtcagtgggccagaaatcatccgtccaggtgatccgcccgaccatgcgagggcgaaagacgtacattgacggacgacggaggcaatacgggacgcaggacttaccaatgtaccagggggtgagaccagtggaagacgcgagtacaatacagaccgccagcacagagtggacgagaagaattatcagcagcgctcttccatcacaacacacggatggaaaccacacgaaactagactatagccccagggtggatcaacgagagaggaggcaacagaaaggaagaataagaccaaccacctacgcagaaagaaagactgaacgtgaaagaggagattcaccgatgactataa

SEQ ID NO: 556282 - DNA, 141 bp, Homo sapiens
gattggacatgtcgagacattcctgcgcatggtgcagtgctgtctgtagagggtagctgtggcttctagtgtgcccgagtagcatcctgtgacccctccccagtgcctctcctggccctgaatggtgccgatgaatagcga

SEQ ID NO: 556283 - DNA, 393 bp, Homo sapiens
cacccacaaaccccctctcaccacaaaccccctctttttataattcctttaaatggtatcccaaaggcaagatctagcctgatagtgtatgagtaaggggataggaaaaaaaaaggattcattttcattatcacagggatcaaaggctcctttcctccttttcagtcatctccgtgaatagcccttttatcacaatgaggcattaacaaatgctatttcattctagccacaataacaaagtatactttcttcactgaactattttgaattgcaataaactttactcacagataaaataagggcctgaagcatagtgtaagcatacaagtctctaattagtgtcaattacaataaacttaaaagtctatgcccatcctaacacccatataaaat

SEQ ID NO: 556284 - DNA, 347 bp, Homo sapiens
ctttgacagtgtcatgcctgttgtttgatgaaacattttttcttaatataattagtcctttgttcttcttttcactttggatagagagtgatatgtacgtatcttagtttctttttttttttttttctttttggtcctatttaatttttatggttaaaaaaattttctccccttaagtttaactgattggttaaccatatggatggtctccagtgatggtgatgggctaaataaggtggaaaatgatcgtgaccatgtatggagagctcatggtatggcaagcataactctgtgctcttttgtcctttccttattttatatttgggggggacaccctcaaaagtcac

SEQ ID NO: 556285 - DNA, 210 bp, Homo sapiens
atctacataaaacctttgttggaatgctttacactttccacagtacagaaactaaaataacctgttatacaattagtcactaatactgtcctcgagttttttggccatacacttgagtatttgtctaaaacatgtcttctttgaagcagctaggccctgccacctctgtgcttggctgagttcacaaatctgttgtaacctgtagcttcc

SEQ ID NO: 556286 - DNA, 266 bp, Homo sapiens
  misc_feature (22)..(23): n is a, c, g, or t
  misc_feature (42)..(44): n is a, c, g, or t
  misc_feature (63)..(65): n is a, c, g, or t
  misc_feature (76)..(76): n is a, c, g, or t
  misc_feature (124)..(124): n is a, c, g, or t
  misc_feature (133)..(133): n is a, c, g, or t
  misc_feature (164)..(164): n is a, c, g, or t
  misc_feature (175)..(175): n is a, c, g, or t
  misc_feature (178)..(178): n is a, c, g, or t
  misc_feature (194)..(194): n is a, c, g, or t
  misc_feature (202)..(202): n is a, c, g, or t
  misc_feature (234)..(234): n is a, c, g, or t
  misc_feature (256)..(256): n is a, c, g, or t
  misc_feature (259)..(259): n is a, c, g, or t
  misc_feature (263)..(266): n is a, c, g, or t
tattataataaacaccctcacnnctacaatcttcctaggaannncatatgacgcactctcccnnngaactctacanaacatattttgtcaccaagaccctacttctaacctccctgttcttatnaattcgaanagcatacccccgattccgctacgacaaactnatacacctccnatnaaaaaacttcctaccnctcacccnagcattacttatataatatgtctccatacccnttacaatctccaacattccccntcnaacnnnn

SEQ ID NO: 556287 - DNA, 541 bp, Homo sapiens
tagctatcggcgggtgttatcggcgaggctgtcgggccgtgggggtctgacgcttcgctccggtctcggatccgagcgcggggaggcagacgactgtgagctgctgtcccatcctgcggcgtcctggggacacagagccctccggtgcccggggatggatggagccaggactccttcctcctcgccgcccctgcccctcccagcacctggccacaccctgcagcgcccatggtctggccctgggtggcgatgggtcaggtggggtccctcatggctggtccgtgctgctctggtcctgggggcagtccttctgatggacgcgttgcacggctgcaacactcgtccactcgagagagagtagccaacagggaggagaatgagatcctgccccagacactgaacggggtgaagctggagatggacgggcacctcaatcgcggttcacagaggtctccaggcaagactgggtggctttgatgaggacgcggagccgcggcggagccggaggaagctgatggtcatcttttccaaggtggatgtg

SEQ ID NO: 556288 - DNA, 599 bp, Homo sapiens
atttgattcttctaccttagaaactccttttattattccaagtctcagatagctccgaaatcccccctgcccacccctagcctaccagaccatttctgcctctctcttatgccatagtgccatagttccattgaacaattggtttgttttattcatttccctatcatactgtgggagcagatgttgtgtcccttcatctttgggtcttcagtcctcaattaatttgaatggaaaatgagtagatcagcataatatagtttgtgtgctagttctgttagttattaacagtgtaactttgttatctcatccgtaaaacgagataatgatagtgtttgtgtatatcataagttcttcgtgaggattaagtgagataacatggggccaggcgctgtggctcgcgcctgtggtcccagcactttgggaggtcgagagttcaagaccagcctgaccagcatggagaaaccctgtctctactaaagatgcaaaattggctgtatgtggtggtgcgtgcctgtgaccccagctgctcggaaggctgaggcgggagaatcgcttgagctcgggaggcaaaggttgtggtgagtcaactccatctcaag

SEQ ID NO: 556289 - DNA, 174 bp, Homo sapiens
ccaggagggttccttccaccttggacttgctgggtggctgcgcagaagcccttgccactcaggcagacttcacgccttttccaggacagcaggctccccagtagcatcctgtgcgggctagggaggatgcctcctgcctcttccagctgctgctggcccccatagcctccttgg

SEQ ID NO: 556290 - DNA, 195 bp, Homo sapiens
  misc_feature (48)..(48): n is a, c, g, or t
  misc_feature (86)..(86): n is a, c, g, or t
  misc_feature (142)..(142): n is a, c, g, or t
taggaaaccattctttaaaaaaatcaccttacttgtgtatgtagtccntacgagcgtgtttaatcccaaaggtaaaattttctccnacctgacttaaaacaaccgcatttatttgtaaataccaataaaagtaaagataacntagtctataatgtatatccctgtctctgattattatgcaaatttctaacaaag

SEQ ID NO: 556291 - DNA, 503 bp, Homo sapiens
ccctagtacttgcttaccacaggccagaagcgttaccgtgtgcagcagttgctagaatctataatgcaagagctaatctgaagatgtgaactgaagaggcacgcgacatgcacggtacttcagcacagctcacaaaagcgcaggtgttctcactcatcgacacgagagccgcctgacctcccgttactcacagaaacagccattaccctttcacctacactggtcgacatcaactggatagtagaggactcggggtcttccgatatcgcagcgtgcatctgcatcctgaaatgctcatatcagcattccctttggcggccagtgagaaacaaagaagggataaaaactggatatgcatctgaaacaagatgtaagtcactgaagatttttagaagaccaaggaaactgttcatgcaaacagtttcttcagatgattctgaatcacacatgagtgaagaaaaaaaggaagaagatttactaaataatttatgcaatcaatgtca

SEQ ID NO: 556292 - DNA, 427 bp, Homo sapiens
acaagtttcccactagaactcgggacagccactgtgtataattacgatagcgaagataacattttcaaacggaatgtctcatcttgccacgggttcatccaaaagcattcattcattcaactacatctattgagtgttagcacgtgctagtccagtggtgtcacagtaatccagaggtactgacacagagctactgcatggaagagtcacagcctaatttggaagcaaatgaataaatgaattataaatatcatactaaagcagaagcatgaataagtaactagaaataacagctgatggtaataaaattacatttggaattaacactggggaatgtaagagtttccaagcagaaaaaatattgcgtttacacaagcaattaaatgtgctcagggcataaataggcaaatccaaaaagtggatctag

SEQ ID NO: 556293 - DNA, 107 bp, Homo sapiens
cccagattattatgagatctggcatcgacggcatgactactgctgctagccggcattataaaccatggctatgcccggtggcaagacatccagaaggtccaggtatg

SEQ ID NO: 556294 - DNA, 406 bp, Homo sapiens
cgcggcggaagatgtctgtggacgaggtgtcggacactcagctgatgcttggagtagtgctgatcggtctcaccagggaccgaggagcgcgagactatacgtactgacgcccactatacggaggaacacatggaggcccaggccgacattgtgcacggacactccataagacgtacagagccgagagtgcgactctcgcagtagtagcccacagccgacaacctagaccagtggagagctcctgcatcatgtgatagagcttgtgcatgcatgcagacagtactacgcgaatatggattactacttcgcagatgatgatgtactataattacaggttgcacactacgtttatatctagagagtactctgtgaggaatgcaagcgatagacggaggtgagaggacct

SEQ ID NO: 556295 - DNA, 1126 bp, Homo sapiens
taaatggtatatttttaagcattcctttggtggttaaaaattactttggtttatataattattattggtcaattaaaaataaaaagaaaaaatcatactggctcctattttttactttgagagcaactctggataacaacaacaaaaaaaagttcagtgggggccaacgctgtttccctcctgggagtttcccgggttcacctgggtgggagcggggcctcccttgggtctggcaattccctccctttcttttacagtgtgtctggcacggaaaggtggtgtttcaccaggggtgatccggtggatctgggcttatttggttccctttggtgggggtgtaaagggggctggggccaccctcaaatatattctcctggttattcaccaacgtcttagataatttcactaatccgcgcgctgggttaatgtgtgttaatccttctccacatattcagaccgcgggggtaaagtaaatattggtcccccaagttctcacgacagaaactttatccaagtgggtgggattttatctcagaggcacattaagaatccccgggaaattattcgagccctcgagataaaacgtttttcccccaaggcctcccgaggggcggcttgcggttaaatcaggggcttctttaaaaaacaagcgtttttctgggcccggggcggccaggatatgtctcacacggcccgttgtgtctatccccaaggccacttatgggggcagggcccgaagagcgaggggggaaatccacgaagggttccaagaagttttcggaagaacccaaagctcgtgggccaaaacattgggttgaaaaaccctctgttctcgcaacataaaaaagattccacacaaaattataagctgggggacgatgtagaggagcaggagagcgccccgtggaaattcccccaaggccaacacctagcagcgaaggagccgtaggaaaacacgagggagcaacgcggaccgtgtaacccccgggaagagggaggtgaggatatgacagagagaggccggaaaaataaccgccgccgtagtaactaccaaggcctgtggacgacaaacggtaaacacacccggggtccaaaaaaaaacacacgacgacaaaccaagaggagg

SEQ ID NO: 556296 - DNA, 723 bp, Homo sapiens
  misc_feature (723)..(723): n is a, c, g, or t
catagacccacctttcagtacgtctaatttgtctatgattactaaaaatgaggaggctccattttgctcagagagatcttcaactcatgaccgttgagtaatcataaccttcattatggtgtgtgctctcagatctgtaacaagatttatatgctcatctttatcaacgttattcaacatatagctggtagtgctggcgagcgcaatttattttgacaatagagggcgtacacattgcaaaagacgacatattctgacttaaacataagcttatataccttgtatcctaatgactccatctggaaaatactagtactgcataatgtgttaatgagtgtagaaggatacaccactttacatatacatgagcataacatttagtatccactagcatgtgataacctgtgagaagatatgaaggggagcgatcacacttaagaagctacattgaatagagcagtagctacaccgtttgtaaaatacataggattcatagttaccaaagaagtgatagatgtgtgtgaggaataatatgaaaaacttgtgaacgaggtttaagaggccacacatgaccacgatacattatgcttatggcttttatcgaaatgcccacgtctttcttcatagaaagaggtacaccatcctgcaatgtatggagaccccttaagacctggggagggaaggtaattcttgcagtgaccacagttgcatcactattctgcn

SEQ ID NO: 556297 - DNA, 221 bp, Homo sapiens
caaaactaattgagaacccaaaaaggtcccagcttgaggcaagggggaaatgttttccagaaggtaaattcttgatagagcccagtgaggtatttcagatttgttcaaaatgtctttgtctatgttttcagtaatgtagatgccttataaagactgatatctatgttaacatgtaatgactcttttatcataacaagtggacgtgtaatgtctttggacta

SEQ ID NO: 556298 - DNA, 340 bp, Homo sapiens
ccagctcggttctccatttcacctgctacttaacctgtttagaacacacaagtctaggccaggcgcggcgtctcacggctgtaatcccagcacgttgggaggctgaaggcgggtggatcacctgaagtcaggagtttgagaccagcctggtcaacatgatgaaaccccgtctctactaaaaatacaaaaattagctgggcgtggtgtgcgcgcctgcagtcccagctacttgggaggctgaggctggcggatcacgaggtcaggagatcgaggccatcctggctaacacggtgaaaccccatctctactaaaaatacaaaaaaattagccgggcttggtg

SEQ ID NO: 556299 - DNA, 286 bp, Homo sapiens
tccatatgtagaagtttcatctaccaaagaatgggtatggtataattacgattaggaattaccacgtttaacatatcataaacattacctggaagaactttttaatcgcagtaatatagcctccaaaaggtacctattctcgttcatgaaaattaatgagcgcacttaggaatgggagacaggttatttctctttctcctttttaatgtagagctgccgatacacttaagttgccatagtaatggcagaaggggggaagggggttttctttgtaaaatcattggtg

SEQ ID NO: 556300 - DNA, 256 bp, Homo sapiens
agagcaaagctctatctggggaaagaaaaaaaaaaaaccatctgtggaaactatgcttattggccccttatgtgaatgaactatggaaaaaaatttcctttaatttcaagaaatcacctctgggcatggtaaattcaccttcgggcatgtaaattcacccttttatattgttaagacaaactttctaaaattcctggatctgggcaggtaagggcctaagggggtacctatttacattgcaatttccccttgacgg

SEQ ID NO: 556301 - DNA, 276 bp, Homo sapiens
  misc_feature (238)..(238): n is a, c, g, or t
gtatatagtgaggagttgtcatataagatgggatatgaatgaagaatgcaaagctacaacttcagttctagaagtgatctctcgtgtctgcacactgtctgtatccgttattctagttggaacaactgaaagatgacctagcagattgcatttccgacatcaacgagatttcaatggcaaagataattttctcgagtgggtgtgtatgaactaagataaaaatagatcataactttgncccattctaaatttctgttttgtgtcatgctgttatgt

SEQ ID NO: 556302 - DNA, 367 bp, Homo sapiens
atacctaaaatgtgtaacagtattaccctgttggcgacatgatgatgtttattttttaaacatgaatatttctgttcagcgccagatagtgatttaacagtgaatggtccaacatttgtgtttcttatcaaattgtcttctttagtctaagccaagctagcaacatcatttggaacacactcagtgactcactataggacaagagctatagaaattcagagaccaagtggcagacggcatttgctccatatgccatgctatggctcctggccagtgctcgtcatgcccttgcgaagctttctcaccctttgtaagaaagtatctgtgccgtgctgtgcaagccatctacctgctttctttctccact

SEQ ID NO: 556303 - DNA, 133 bp, Homo sapiens
aatctcaaaaggggaaaggctttgcatctacacatagagtgaagagaggctagatctgctttctagggctgagcctcactcctgtcagctgagactaatgtacctgcttctcaatgcggaaggacagcctgac

SEQ ID NO: 556304 - DNA, 117 bp, Homo sapiens
taacagatatgcgagaacctgagagacacctgggaacatgtgtcagtgcgttaaatcagttatagtacttcaaaatcattaatcattaatgattaaacctttatctacatatgtaga

SEQ ID NO: 556305 - DNA, 268 bp, Homo sapiens
cagaatgaaattacagtaaacagactatttgtctccacataaacacataccaggtctatcaaaggctaggggatctactttaagagaaagttaaaaaaaaaaaaaaacccaccgtatctatctgtggcttttattgacatttaaagtttaaaacataaaattatttactgaaaattttttcattaatccatgagtcacttcacgtactggcttcaaaaaaaatttattagaaaagcctaaatagctatgtgtgtgtgtgtcttttaca

SEQ ID NO: 556306 - DNA, 356 bp, Homo sapiens
cctacttatccagtgatttatatagcttggcagcagaaagtgagagacccatcagcgaaaggatacacatgtagtgacagctaaatggctttatagggaagtctcaatcatcacttgcgcatcgatcatagcaaaaagaccaatgaacttcaatttgatgttagttcgtgtgggtcctgacgcctgctgacagtgtggggtcccagtcacttatgatgagagtgatgagtgtctcccgtggccgtgtcctctctgaatctctgagcattttatctttcatctctgtgggagtcgtggcttggtaataccattcggagtaccctgagcatcggtgctttgtagaacacagcattaag

SEQ ID NO: 556307 - DNA, 312 bp, Homo sapiens
  misc_feature (128)..(128): n is a, c, g, or t
  misc_feature (130)..(130): n is a, c, g, or t
  misc_feature (167)..(167): n is a, c, g, or t
gttcgtatatcgtacagctgtctgcattgaaaattcatgcatggagaagggagtaagcaagggagaaacggtgcgattcacatattccgcgagatcatcagccagcagagaaatccctccatgaaagntnaaacaagataggcgctttgcacctcctcagcctactnaagctgcagacttaaagagctcctacacacctgagactgacattattgtgccaccaatgatgcttttagggatgctagtgagaaaagaatctgatacgggacaaaatgctcttcaaacatcattcttatcacccacacagggttt

SEQ ID NO: 556308 - DNA, 233 bp, Homo sapiens
  misc_feature (18)..(18): n is a, c, g, or t
  misc_feature (53)..(53): n is a, c, g, or t
ttttttttttgctctgcngctttttaaagatacagctacaatcaacaaaggantggcacatttcagaccacagctacttttctactacaatgtgacttcatatttatttagtcctatcctgtcccaaacaaggtttgttaagacagcttacaaaaatacacacagaataaaccataaaattatttataagggattgacaatttgtcgacgcggccgcgaatttagtagtagta

SEQ ID NO: 556309 - DNA, 359 bp, Homo sapiens
  misc_feature (314)..(314): n is a, c, g, or t
  misc_feature (329)..(329): n is a, c, g, or t
  misc_feature (357)..(357): n is a, c, g, or t
caaaatgatacagtaacattggacaaatgtttgggattttctagcaaaattaaacattcacctctcagatcacccaggaattctactcctaggtttttctcaaggagaagttaagtgcaaatatccatcaaaatgctcataaattttatttgtaatagctaaaaacaagacacaactcaaatacctattaaatgtttatctaggacacaatccaaatgtaatacagtcatgctctgcacaatcatgggtcccatggaaattatatggggaggggaaattcctatcacccagtggcacactgttttttaagtccncagcgggtgttccantaacatcctggggtttcacctttcactnac

SEQ ID NO: 556310 - DNA, 331 bp, Homo sapiens
taatagaaagcagtccttaaccctgcactcatctgtattcagctagtataaaactgcaaatctgctcttatgcctaagacagtttggagtaggaggagacttgggttcgctttggaaagtcaggatgatacgcttcatcccattcctggtttttgtgattaattgtgacctacaaaggggtttactactctcacaagacactttgactttcactatatacatctctttctggttcagcaggcagaggaaatatcgttgactttaggctacctggtaaatgtctcatttgccttgtcatatgttgattccttttccctaatctctgtgtggt

SEQ ID NO: 556311 - DNA, 258 bp, Homo sapiens
cccaaaaaaaaaaaaacgcctttttgggggggggggatttttgggccccggggccccccctttgggccccccccccttttttttgggggcggttccccaaaaaacacctttttgggggggggcccttttttttccccgggggggggaataaaggatgggggggcccccccccgggttttttctttggggcccccccccccccccttttttcccccccccccgccccccttttgggggttttttttggggggggggttt

SEQ ID NO: 556312 - DNA, 283 bp, Homo sapiens
gaattcccccccccccccccccccccatttcttgtcttctgttagattgaagtttgggtgggtcttggtttcctcgtcctttaagttatgatgttagggtgtccatttaagatctttctagttttgggatgtgagtacttagtgctataaattcccctgttaaaactgctttagctgtgtcccagagattctgttaaattgtcttttttttttttttgggggacggagtctcgttctgaccccaggttggagtgtagtggtgtgatctcggttcactgaaacc

SEQ ID NO: 556313 - DNA, 269 bp, Homo sapiens
  misc_feature (91)..(91): n is a, c, g, or t
  misc_feature (104)..(104): n is a, c, g, or t
  misc_feature (146)..(146): n is a, c, g, or t
  misc_feature (166)..(166): n is a, c, g, or t
  misc_feature (174)..(174): n is a, c, g, or t
  misc_feature (210)..(210): n is a, c, g, or t
  misc_feature (250)..(250): n is a, c, g, or t
ctgaaccccacagaaataacaaggctcccctcatccctttctctgaagattagtactagtcctaagtggttagctcccagcttcctttagncagaaaaagagangagagaagtgacacttgtttttttactcacaagcttggagtngggggtagaggttgggttgntgtagctngactttggattagaccaggtcaatccccaattaggncattctcagattttgatcctacataggttacttatcaagngtctatttataaaatgggg

SEQ ID NO: 556314 - DNA, 781 bp, Homo sapiens
  misc_feature (650)..(650): n is a, c, g, or t
  misc_feature (730)..(730): n is a, c, g, or t
  misc_feature (760)..(760): n is a, c, g, or t
  misc_feature (780)..(780): n is a, c, g, or t
cttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcaccagctaaaataggtccagggcagatgctagtttccataggacacaccgacctgtgtcaagtcagttcaccatggttctggcagcacccagaagttaccaccctcaccctggaaatgtctgcataaactgccccttcatttgcatataattaaaagtggatacaaataccactgcagaactgcctctgagctgctactgtgggcgcacagtctgtagggcagccctgctttgcaaggagcagcgcctctgctgctgctgtgcacagccggccgcttcaataaaagttgctaacaccactggcttgcccttgagttccttnctgggcaaagctaagaacccttccgggctatgcttcaatcttagggctcgcctgtctgcatcactgggatcatcttccantaaactagcccacttacatccatgtgtcanggacatttctggagaaagcng

SEQ ID NO: 556315 - DNA, 1078 bp, Homo sapiens
  misc_feature (758)..(758): n is a, c, g, or t
tgggttgagcaccagggtacttaatggagggtccatgacaaggtgcggcctccctaggcccctcccctcttacaaggggtctacatggcaacgtggtgaggaggggagattcaggtgtgtgggtgggggactgagttgttggcagggactccccagcagtgagggttctctctcttcctcgtgtgtgctcttgcgtggggctgggtggcccagggcgttctatactccttggaggccagtgttgggccattgaaggctccaccaccctgtgttgtgctgttaggccaaaattctcgctgtgctcataccagcgaaatttgagcctttgaacaaaagtgtggctcggtttgagggccaatgtgccagcccccaggcgttcaaaagcggtgagagagaggtgggttgttcgccagtggtgtgaacagtctctagagaggaagacaccccaccctgtggtgtggccctcagtgtggtacgcccccgagagtagttgcccttttgagagggggggcccccctcgcgagaaggcccgtgatttctcaaccaaaaccttttcgtgtgaagtgctccactcaatatattgaggggcgaggggtgtatttccctatagagacgcggccgaggtctcgaagggctccacaccagctgttggaacccaccgttttggcacaagtggtgggcggcgacaccaacgggaaaagaggccaatgtttgcccatgtgtttgaaagagccctctccccccggtgttgtccgagnctccttaccaagggggaatattgcaccccttttgtccccaaaaaaaggcctgttttgtgaaaaggcgcccccatatgttataaaacaaggaggccgaagcgggaacgtgaaatgagcctcctcgtgaggaagaaagcccccccccgggggggacccaatacacaagggcgccaacaagattttttccccccggggaggggggggccaccaaactcccaagacaggtccttcaacgaggggaggttgggacaagggtgaaactgggcacatactggaaccgttgcgtggcgcccacaatgaagagacccccttttcccaaa

SEQ ID NO: 556316 - DNA, 158 bp, Homo sapiens
gcatctagaggctgcccacattctttggctcatggctccttatacatctacaaagccagacccagtgtattgaattcttctccccattgctgccatctctcgtgttctgttgcttctgacaatccgtaatccgctatagaagcacccattgtgatata

SEQ ID NO: 556317 - DNA, 453 bp, Homo sapiens
agataaatatgtgaggtaatgaataagttaactaacttgatttacgtatttcacagtatacacatatatcaaaacatcttgttttacagcataaatatgtacacttttttccattaaaataaggaactaggccgagcgcagtggctcatgcctgtaatcccaagtagctgggaccgggggcacacgccaccatgcctggctaatttttgtatttttagtagagatggggttttgtcatgttggccaggctgatcttgaactcctggccttgagcaatctacccaccttggtctcccaaagtgctgggattacaggcgtgagccaccgcacccagccttaaaacattatttatacaatttcccatttaaacatcatatgaagctacaagacaagcactcatttctagaaggaaggctgtttatgaaagtgaactgcatacaataaaactatatc

SEQ ID NO: 556318 - DNA, 307 bp, Homo sapiens
  misc_feature (31)..(32): n is a, c, g, or t
  misc_feature (67)..(67): n is a, c, g, or t
  misc_feature (83)..(83): n is a, c, g, or t
  misc_feature (98)..(98): n is a, c, g, or t
  misc_feature (105)..(105): n is a, c, g, or t
  misc_feature (120)..(120): n is a, c, g, or t
  misc_feature (141)..(141): n is a, c, g, or t
  misc_feature (150)..(150): n is a, c, g, or t
  misc_feature (158)..(159): n is a, c, g, or t
  misc_feature (166)..(166): n is a, c, g, or t
  misc_feature (193)..(193): n is a, c, g, or t
  misc_feature (210)..(210): n is a, c, g, or t
  misc_feature (213)..(213): n is a, c, g, or t
  misc_feature (219)..(219): n is a, c, g, or t
  misc_feature (231)..(231): n is a, c, g, or t
  misc_feature (258)..(258): n is a, c, g, or t
  misc_feature (260)..(260): n is a, c, g, or t
  misc_feature (277)..(277): n is a, c, g, or t
  misc_feature (297)..(297): n is a, c, g, or t
  misc_feature (301)..(301): n is a, c, g, or t
gagcattttaaggaaatgttttggctttttnntaattttatgtcttacagtatggaattataatacngaaatctttatatgangttttggcttcttgngctattntgtacttattcaggnggaaaaagtctttcgattacntatgcctcnatagagcnnaatttcntgagaaattcaacagtcattttcaccngccatattttatcttanggnataacnaataggaaaagncagcttaattatttaaggccctagttncnacacataatatattcgnatagaaatgaaaatctgccntggnattaac

SEQ ID NO: 556319 - DNA, 359 bp, Homo sapiens
  misc_feature (24)..(24): n is a, c, g, or t
  misc_feature (45)..(45): n is a, c, g, or t
  misc_feature (164)..(164): n is a, c, g, or t
  misc_feature (282)..(282): n is a, c, g, or t
aaaaaattaaaaatagggtctttncagctgtgattaagttaaggntctcgagatgagatcaacctagattatctgggtgggccctaaatccaatgacaagtgtctttttttccccaagcaatcaatcctcttgttgctgggaccacaggcatctgccaccacanctggctgaatttttttttttttttgagacaaagtctccctgacatccaggctggagtccagtggtgctatctgggctcattgcaacctccggctcccagggtcaaggaattctcatgnctcagcctcccgagtagctggggttacaggtgttcccaccatggccgggtaatttttggattttagggggacggggg

SEQ ID NO: 556320 - DNA, 119 bp, Homo sapiens
gcggccgcctactactactactgctcgaattcaagcttctaacgatgtacggggacatgtttttggttctggaatataggaggtgctcaataaaagttgacgtccgaatggcaataaaa

SEQ ID NO: 556321 - DNA, 1246 bp, Homo sapiens
  misc_feature (855)..(855): n is a, c, g, or t
  misc_feature (974)..(974): n is a, c, g, or t
  misc_feature (1194)..(1194): n is a, c, g, or t
  misc_feature (1215)..(1215): n is a, c, g, or t
  misc_feature (1231)..(1231): n is a, c, g, or t
ttttttacaaaaaggatttttattaaagagaaatctgtttggtgggtcagatatgaaatagatttacagaaactttacatcaggtgtctccaagacataaaaggccgcccaggaaaagcaacgcccccttgccaggatgccagtgggaggacggcaggatggcagcccaggccacgtggcgtggaccctgcgtaggaggctgcaggaagctccaggctgcccgacagtcacggcgttccccggaaatgggttccctaggagggagcagcaggcggcgggggttccaggcatgtctgtgctgggctcggagctcgtgcacgcacactgtcctgcttaaactcctagtccatgtctgtgctgggctcggagctcgtgcacgcacactgtcctgcttaaactcctagtccatgtctagtgggacccccaaagccgtcccctaaggaatgtgctctggtacacaaggggaaaacacaccaacccagcccttaccgagacagcgggcgcaccagcctgggccacgtgagcctctgctgagctctttggcacagcacacctgggcctttaacacctgtcacttacaaaagtagacattcctgtagtaaaacttcttaaaaacacctatttctgcaaaataatgtgtttctgtatgtggagctctgcaaatatacatgtgctttgggaagaaagcagcgtggaccgagactgagggctggtccggggacgtccgagtgctgctggaggtcggtcaggcttcagtccctgcccgctgcccgcgctcacatgaggtcgttgagctccgcctccagcgccttggccatctcgtcggcctcggagctgctgccctcgtactcgttnctggactccctgctggactcgctggcggcgtcctcttcattcagcttcctcttgtggcctctggaccccggaccctgccgcgctcctctcgctggacgcaggtgccccgagcgtccganccctgcgggtccctggcttccggggctggggctcctcctcctgctcctcaggcctcctcttctcgctgtcgctgtcgtcgctgccttctccaaggatgtcgtccacctgaaggaagagggctcctggcggatgggtagggagctggagggtgctgggggcccccgggcgcccgtcctgatgagcttccccgtgttggagtcgtagatccgaacctcgggnccaggctgggccttgggaagnaccggcatcgggtggnacaaggcggtggggg

SEQ ID NO: 556322 - DNA, 508 bp, Homo sapiens
gagtggagagtgagacatcagtgatcaagcttggggacggtgggagcagtggcgatggatacccctttgagggtaaggacggactcctggctcatgctcttcgccccagagcagtggggttggggagactcccatttggatgacgatgagctatggatccttgggatgaaggccaagtggtccgggtgaacgtatggcaacgccgtatggggagtactggcgaggttcgcccttcttgttcaagggcgaggagtacaacagtctgcgctgggtaacggccgtgagcgatggcttcctctggtgctcgaccacctatcaactttgaggaaggatggcaagtacggctatctgtgcccgatgaaggacccggtccaccatggggcgggaacgctgagaggagagcctggaagttgtccattccagtttccagcgcacatcctatgacaggtgcaccactgaggggacggagggatggctaccgaatggtgcggtgctagctgaggactac

SEQ ID NO: 556323 - DNA, 191 bp, Homo sapiens
gcccgattatcttcatgccactgcttatcgaaatactgcacttggacggccaattgagggaccaactgctaatatcacagtctatacgtcgtagggatttagtggcttctattaccacacgttctaaggggccaagaatactgcttgctgctgctggagctgttgcccatgagacgcaatgagagatttgc

SEQ ID NO: 556324 - DNA, 245 bp, Homo sapiens
ccacgcgtccgagtaaacacaaagtaattatagttcacctttatacacacgttaacagaaatcatctgatcccctttgctgctaacgtgtgtgtaaaggtgaactatatgtaattcttctgtgatgcatcgctggtgtgtgtcatccactgagctcttcgatctccctattcaactgtgactctgtaaccaatctgctagaattctatagatttaataagtaacacaatataaataaaacaacat

SEQ ID NO: 556325 - DNA, 671 bp, Homo sapiens
tgggctgcctggctttttatgacccgtgtgtgggggaagagaagaacctgaaagtgctctatcagttccgggcgtcctgcatcaggtgatggtacatggatcagtagaggccctccggatagccaaagcagtcccacaggatcgatacagatggataaactgccaagaaccagagtttctgtaaaaggccagcaacaagaatcgttcttcgctggtgagtcgtaccaaagtcttcggaaaatcgatactacaactccagcacatgcagatgtttctgatctttatattattattatagaaggtggtaccattatcaattatgtgaagggacatgcaagacaccccagcttttgagggtgctgaggggctaggactagaggcagcccacacatgggaaccagactgcagcctggcccatggcatgttttcccaaggatcagttcctggagggaagggctatggcccggactccgcagtgtcccgagcacacgtgactgacacgcagcccgccgacactgtagttcttggctgggtctggaggtgtctgtggagcatcctgccctcaccacaggagcgtgagccacttctgcagtccacgctgaacatgggaaacaacctgaaaagcaggcaggcctcccggtcagggagcctctgctgtgctggcttcccaa

SEQ ID NO: 556326 - DNA, 395 bp, Homo sapiens
gactatagtaatggaagatatatttgcaaagtattcaactgatcaaagaatcgatagctgctcatatagtaaggaactcaacacaactcaatagcaatgtacaccaaataatctgattttaacatgggcaaaagatctgaatagacatttctcaaaagaagagatatacatgaacaacaggtatattgaaaatgctcaacatatcatcaaagacatacaaatcaataccacaataagattatcatctcaacccaattaacatgactattatcacaaagacaaacaaattatggatgctggcaacgatgtggagcaaaggggaacacttgtaacactgctagtgggcatgtcaacataactacagccactatggcaacaacatatggagtgtcctc

SEQ ID NO: 556327 - DNA, 153 bp, Homo sapiens
actgtgggaggcaaggtgggaagatcacttgaagccagaagtcaagaccagccttggcaataaaacaagactctgtctccacaaaaaatttaaaaactagccgggcatgatggcacacgcctgtagtcccagtcactcaggagaccgacgtgg

SEQ ID NO: 556328 - DNA, 290 bp, Homo sapiens
atgatgaggaattataagccaagcgtcatatagcaaggatctatacccctataccttctgcattcatgaatgtaactagaattaactttgcaaggatagcccaagctaatacccccgaaaccagacgagctacctaagatacagcttagagagcacacccgtctatgttgcacaatagtgggatagatttataggtagaggcgacgaacctaccgagcctggtgatagctcgtctctgtctggatatggacggcgtgcaactttgaatttgcccacagaatcctctagat

SEQ ID NO: 556329 - DNA, 87 bp, Homo sapiens
cccacagcctttctccctgccaccactcccttagtctttcccaggcttactctcccaataaatgtgctagagctctaaaaaaaaaaa

SEQ ID NO: 556330 - DNA, 611 bp, Homo sapiens
aatgtggagaccaggctgggcaacatggtgagaccctgtgtctgcaaaaaaaataaattaaaaaaataggtggacattgtggcatgctgctgtagtcctagctacttgggaggctgaggtgggagggtcacttgggagcccgggagagatcaaggtcgcagtgagcggtagtagaggaccaatgggatccagggcctggttggacagagggagactcggtccccaaaaaaacaaaaaaagagaaacaaaaagaagaacacaaaaaatgggtgggggggggcacggcggagggcccggggaaaagagcttaagaaaacacactgggggggaggggggggcggagggagccacaagatgagacagtagaggagcaacttgcgctacaaaccgagcagaggtaccccagaaaaagagacaaccagggtgaaacaaaaaaaacagggcggggagagatcgaccaaccaaagaaaaaaacaaccgccgcgggtgagaaacacgaaggagcggttgagcaaaaaacacaagcggagagctagggaggcaaaacagggacaaacaaacgcgaggaaagcagagcaggccagaatctaaatagccccccggcgggggga

SEQ ID NO: 556331 - DNA, 337 bp, Homo sapiens
taaacttatacattcctctctttcatatctatcccactacatcctaaccctacacctaatcacataacctatacccccgagcaatctcaataacaatatatacaccaacaaacaaagtacacacagtaactactactaatcaacgcccataatcatacaaagcccccgcaacaataggatcctcaccgaatcaaacctgacccctctcactatcatcaaatattcagataccataaactaataaaaagaaaaccacaaaacaacaccccaacatacacatttcacccacagcaccaaatcacataactccatcgctaaacccaaaaaaaaaactcaa

SEQ ID NO: 556332 - DNA, 282 bp, Homo sapiens
ttcacgtccgaagccactgaagagtcatgccgtgctgttctcatccaaggcggaccaggctgattctgaggaactggctgggatcgcatggctcggcgctttacctgggttggcacacctctgcatcgcagactgcaacatttgagcaatggggacatagtcaggtagacacgacattgtacaatatggacagagcatgtcccctgtggcctattctctgtatttatttactagaggagaggggccactgaaaacttcccaggatttaattcatcaactaga

SEQ ID NO: 556333 - DNA, 1029 bp, Homo sapiens
gaattcacgccgcacgaccgcgtcgcgcgctggctcgacgaacacgcgttcgacgccgaagacaccgtgatgctgcgccgcgtgatcgacgcgaacggccgctcgcgcgccttcatcaacggcaccagcgcgaccctcgcgcaactgcgcgaactcggcgagatgctcgtcgacattcatgggcagcacgcgcaccagttgctgatgcgtcccgacgcgcagcgcgagctgttcgacacgcacgcggggctcgtcgccgaggccgcgaacgtcgcgcgcgcgtggcgtgtctggcgcgacgcgacgcaggcgatcgacgcggcgaaggcgcacgaacgcgaactgcagctcgagcgcgaaaagctcgcgtggcagctcgcggagctcgacaagctcgcgccgcagccgggcgaatgggaagaagtgagcgccgagcacaagcgcctgtcgcattcggcgaatctgatcgagggcgtgcgcggcgcgctcgatgcgctgtccgaatcggacgaggcgatgctcacgcagctcggcgcgatcgtgtcgaagctgcgcagcctcgccgactacgatgccgcgctcggcgacgcgctcgcgtcgctcgagccggccgaaatccagctgcaggaagcggtctattcgctgtcgcattacgcgcagcgtctggatctcgatcccgaccgcctcgcgcaggtcgaaatgcgcctcgatgcgctgcattcgaccgcgcgcaaattccggctgccgcccgacacgctgcacgaggaacacgcggcgcgccgcgcgcagcttgccgcgctcgacgcggcggccgatctcggcgcgctcgaagccgcgcaggcgaaggcgtgggacgcgtatctggccgacgcgaagcgcctgtcgaaggcgcgcgcgcaggccgcgaaagcgctcggcaccgcggtgacggccggcatgcaggagctgtcgatggcgggcggcagcttcgaagtcgcgctcgtaccgctcgcggacggcggcccgcacgggctcgaacagatcgaattc

SEQ ID NO: 556334 - DNA, 366 bp, Homo sapiens
acatcatagaaggatccccgcccttccatcagcctggactaacatgtgataagacagtatctctactataaatacgaatattagctggccgacctggatgccctgcacctgctcgttctccactactcaggaggctaaggcagaaggattgcttacaccttagaggtctcggctgtggtaagcctcgagtcgtgccattgcactccagcctgggcaacagagcaagaccctctctcaaaaaaaaaaaagatgaaattttggaggcaaattttcagaagcaagaaaaccacagagagggtaaacactaaactctgattataaactctactctggcctgggttgcagtggctcatgcctgtaatccta

SEQ ID NO: 556335 - DNA, 559 bp, Homo sapiens
ttttttgtgggtataaaaggattttgtctatattctaaaagacacatgataaaaattttggggaatagagtgtagaaaatccggtgacctttaaagaggctccacaacaccgacccgttgatttgggtaaggttttatatatagagaaaattttaccttttttaaaattttaaatgaaaattgtccagaagtgtctggcctggttttccggttccttggaatgtatgaacctttcccataatagaaagttgtgggaacccagcaatcttggttcacaccggtaatcccggcactttgggaggccaaggcaaccggatcacgtgaggtcaggagttttacaccagcctgaccaatatagtgaaacccctgtttctactaaaaatacaaaattatgccgggcgtggtggcaggtacctgtactcccacctactcagtaggctgaggcaagagaattgcttgaacctgggaaatggaagttgcagtgagccaagattggggcactgtactccagctctgtctccttgtcatccaagcatgggtgacagaggaagactctgtc

SEQ ID NO: 556336 - DNA, 230 bp, Homo sapiens
tgactcgacataaatagaaatatagatttaaaatgtaaaaacaaacaaacaaaaaaacaaaaaaaaaaaaacggcctgggcccgggggccccacccttgaaatacccggcctttggatttttccggtttaattttcggaagggcagattgggcctcgacatttaaattgaaattatggactttcacaagtgttaaaacccaaccaaccaaaaaacaccaataaaaaacaa

SEQ ID NO: 556337 - DNA, 854 bp, Homo sapiens
ttcttgtgcgggccgatcttcttccccccggagctgggcgtgtgcggtcgtagaatgaactggtgagctgctgctgtggctggtggtgctgtgctgcgctgctcctgcttcttggtgcagtctgctgcgcttcctgagggctgacggcgcactgactggctacttatgtggccgtatgtgtgcaggcacgactcccagagatgtgggagctgactgatatggtggtgtgggtgactggagccgtcgcaaggtggaaaccggtgaggagctggcttaccagttgtctaaactaggagtttctcttgtgctgtcatgccagaagagtgcatgagctggaaagggtgaaaagaagatgcctaggagaatggcaatttaaaccgaaaaagatatacttgttttgccccttgacctgaccgaccactggttcccatgaagcggctaccaaagctgttctccaggaggttggtacgaatctgaggattctggtcaacgaatggtggaatgtcccagcgctctctgtgcatggataccagctttggatgtctacagaaagctaatagagcttagctacttagggacggttgtccttgaccaaagatgttgttctgcgctcacatgatcgagaggaagcaagggcaagatttgttactgtgaatatgcatcctgggtatcatatctgtacctctttccattgggatactgtggctagcaagcaatgctctccgggcgttttttaactggccttcgaacagaactttgccacaataccaggtattaataggtttctaccattgccacgacctgtgcattccatattggggggaatccctaatttgcaattcccgacttattgg

SEQ ID NO: 556338 - DNA, 716 bp, Homo sapiens
  misc_feature (211)..(211): n is a, c, g, or t
tggggggccttaaccaagcgtcttttaatttttaaaacggaaaagcccctgtcccacagttactggctgctgagccctttcaaggtgactcagtgaggagggaaaaaagcggaagcgggtgtgtgggaagaggcggggctctgtgggccagctgtgcgtgcctcctgtgcttctccttccctccttctgtggcctctataggcctcccagnggagtgtggttgggaacctgttgcgccagtggtgctcgttggaaggctggtggacagtgcagcgggcgttctggtgacacctgttggcgccagtgtgtgcctcgttgggggctggtgccaggggagagggggagctccctcggtgttcccctgtgcgcacaacacagtacagaaggctgttggattccacccagtgtgggcggctcgggttgccaggccagtgtggcgttacctccgccagtgttttgcagcccgaggccagcgggctgcaggtgcaggactatgcctcaggggtcagggtgccacacacccctgcttgtctcggggccccggggtagctccgggaagggcccaaatggggcctgaacttggagctgccgagggggggagctctcggggaaaggggatcccctcctaggggggagtgtcttgaccctggggccatgtgtccggacccgaaacggggtccatgggaagggtatccactactacggaaaggcaaggc

SEQ ID NO: 556339 - DNA, 693 bp, Homo sapiens
gggagaaggtggaattcgagacgtgagagtacgacgatgaccggagcaggggaaagaagaatgggcaaaaggagagggactgatacagaggcagaatggaagagatacgctgggagtaaacgagcgagggagtgtggaccaagaggcagagagggaagatactgagatcacagaacgagaacatagggaaagagctgtagaaaagaggtggggcaggagaccataggagaagctatcagtagagagcaggcatgaaggcacacaaaggacgaacgaccgatcatgaacgacaacaagccgcagaacaggaaacgatacgatcaagggagtgaagggactgccgaaagaaggggagggaaggttaaccaacaaccaaacagacaagggattagtatggagctatacgaagctctagaggaggatagcactaaaggactgaagaggcgagaaagaaggggatcaaaggacaggaacggacatgacacgggagacgtaccaggggcaaacaagcacaagaattggcgcgggacgcacaggagatacatcatgagaaatgcagaacaataactaaggacgagacaggaggcccgtccaggtaaagaatggctgaaaatcccgatggacggacaaggaggaaagaccggctgaggatggtgaaagaaaagggaaaccgagggacacaggaggcggcaa

SEQ ID NO: 556340 - DNA, 732 bp, Homo sapiens
ctcccggacgtaggtagttgttgggccgggttctgaggcctgtcttctctttacttttccactctaggccactgatgccgcagtaccagacctgggaggagttcagccgcgctgccagagtaagcttttaccgtcgcgtgagcctatgaagtgcacgtgtgtgtatctcaaatataggcattctgagtgggaacttgtgtgttaaagtaacagatgatttagttgtcggtgtataaaacagaccaagctcaagatgtaaagaacgattgcgaaattccacagtcaactaatgcgacttatggtagccaaggaagcccgcaagtgttaccatggaaattgagtgaatggttgagaaatgaagacttggtcgtgtacttaggaagtaaatatctttgaaattaagagaaagtgtggggacagacatgtacgtttagtgtaagctaagtgggctgttcagagagcttagaggtcatatttgtgtaattctctttttaatgacctttaagagagctagggagtgcgaaatgttttcagttagaaagcctttatttactttgtggaaactcgaacgaagaaatgcatctgtcttagaaactgggattattgactgttaggtaaaaaccatgtaagtggttgtctgggaaatcggtcggcaatttggcactgcgcttttggggaaaacccatctcttaaatttggtcaactttttacaagcaacttaatgtacccttg

SEQ ID NO: 556341 - DNA, 188 bp, Homo sapiens
cacggatcccctacacttcgatcgcggagaaccatgcttctggctttagaaatcgcttcctgttcaccatggagggtcctggcttcactcatactctggcttgctgtatccagcattctgcttgtatatgctggtagaagatcacggccgaggaattcgatgccccacgaatccgacgacttgcacgt

SEQ ID NO: 556342 - DNA, 154 bp, Homo sapiens
caccagcagcacatcatgctatgcctttcatagaagccttcagtagattcagtcgtcttagtcgatatttgcctttgtttggcattcaatggcacttattcactatactagtgcttttacatgaaattattttaacatatgcacaatcctctct

SEQ ID NO: 556343 - DNA, 269 bp, Homo sapiens
cgggagctcaggtctggggaaatgtgccatgcagaggcggagcatactctcctgcttctgctcgggcccctctatgagacgcggcacgaggccactcaggtgtggtcctgcctcacatcacatccttgttgctcctgcttggactccttaatgacctctccatcccgcatctccacggtcttccccacgatgttcctcttgtggtgtgccttctgacacagactttgtgtccaggctggtttctcgaatctgagctccccgggatacag

SEQ ID NO: 556344 - DNA, 411 bp, Homo sapiens
agtcgtgaacatctgactctgactaagtacagtatacgcccagtaactctgatgcgggcgatgctcacatgctgactaaactcagaacagcgaacaagactacatgaatctatgactatctcatggattctaaattaaagcttagaaacatttacaatgaataaaataaatccatagcgtggaaagtcaacagctgccttgattaataacaaacctaaagatttcataggtttgaggtatcaactttatcaacttggaattaattttcgagcacagtctctatttatcaagtacgtcctaatatttcaacataccttaatttttcccaaaagaaaaagacagttattattcactatgaaatgcatgctattaatgctacattttttaaaaatctgatttcctctttcctac

SEQ ID NO: 556345 - DNA, 98 bp, Homo sapiens
gtagcgataagctgtaccaccagtggctgtccacagtccgggcaaaagatcatgcaaaaatgggaataaaagaggtgaaaaaccgcttgaagcaaaag

SEQ ID NO: 556346 - DNA, 866 bp, Homo sapiens
gccgaaattccggttcccctccctggcgcttcccccgccccctgttgggcctccctcgtctcccttgtcggttgggccccacgactgggaacccgtgtccctttccgacgaccagtgcactgtgtccgctgttcactttggtccgtgccttttttcccccgggcatgtcgcgccgttactccccgggctggggagtttcaccacacacgcgggcctttctcggttgtgtcctccccacgccgccgccgtgtaccttggcctgggtagtgccccccccgtcctcaagataccccctgtgtgggcgccacccacgcgggtgaacgccctgtagtcttctctggggggttcattccccggcttctcttcgtctccctgcagccgcccgaggccacaaggggcgccccccccccgcgggcgaggggtctccttgttatccccccaccgttgggtcccgtacgggcttccccctggccaagtagtgtccctcccaggacaagtcacgctctgggggttgcgccgggcgcccaccgatcaactggttcggggagtcaccggctctctgcgcccccccggcgtgtttcttagatcttgtgtgggcaccacaggcgctgggctctctccaccgcccatttcccaccaggggatccagcacttctccccgctcccatctggcgtgcaaccccgcttccccttcgacctaatcaggtgctcaccaagctcgcccttggtttagccccgcggtctgccacatgtatccactggcctggatgccatctcgcgtcggtgagcgggagaacggttgcccaccacagggagtgcccttgcgggcatgttatccaaacttggaaagcgtcccccgataggga

SEQ ID NO: 556347 - DNA, 181 bp, Homo sapiens
  misc_feature (51)..(52): n is a, c, g, or t
  misc_feature (62)..(62): n is a, c, g, or t
  misc_feature (86)..(86): n is a, c, g, or t
  misc_feature (103)..(103): n is a, c, g, or t
  misc_feature (113)..(113): n is a, c, g, or t
ggcggagcagaagggtacacgacactatggaaatgtctggatcattccgtnngtgcgtactntgagattgggtgtgggatgtcatngttttcacagcactttnttatcctaangtaaatgctttatttatttatttgggctacatgtaagatccatctacacagtcgttgttacacattcg

SEQ ID NO: 556348 - DNA, 654 bp, Homo sapiens
tgtgttaaaagcccagtgtgacagcgtcatgatgtagtaggtgtctctactggttcttcattaaatccttcgtgttataaaaatgtattggctcttcatcatcagaataggaaaaattgtcgatggattacaacgattattaataagcataatgtcaggaagacagggcttgccgacaattagaggacatgattaaaattgcagtgaagttagaagatgttgattaggaaaatctaattgtgtgccatattgtgtcctccctgtccaaattgggaaatgacttgaatgtcaatgtagtgctgttagggtatgtctctgaacttatacttccttatgtagccattaagatctatatgacatattgccccaatggccagttttggctaaatttgtttggggccttatagacacaaattctggataatagtgtgcaaatagtacccctgtgcacagagtagttaatgttttatgcttccattatcataactaaggactttaacagtctgttaacttataatagagatgcggctacgattcacgagacgatatatgaacgagcatgtggtggaccttcatagattgactacaagtgttgagggcagggatttcatccgagcatatatacgcggcaaacaggctataccacggcaacgg

SEQ ID NO: 556349 - DNA, 171 bp, Homo sapiens
tttctacttctggatgaatgtgtgaccgcatcgactccctgctggagaacgaccggacagtcagagcgcacatgcgtggatgtcatgcaggaccagcttcagctcgcgcgttccaggcatcatagacgtagctcttcctaggacaggttcttcaccgcgggtagcccctag

SEQ ID NO: 556350 - DNA, 223 bp, Homo sapiens
  misc_feature (2)..(2): n is a, c, g, or t
anctagaggatccccgctacaacgccaaggcgattatcatggtgatgctgtgcatgatgttaattcagtgcagggcatcccaagctgtccgtgtgtgtacctgattgtataacttcacgttcgcgatgttatgcctcaggttaacacacggacatctttgaatgcactgaactgatttaagatcatgcacaacatcagcttgatgatcgccttggcgttgtag

SEQ ID NO: 556351 - DNA, 121 bp, Homo sapiens
  misc_feature (27)..(27): n is a, c, g, or t
cctgatgatcaaggcattccttcctanaatgcttgctcagaaatctggcaatattatcaacatgtcttctgtggcttccagcgtcaaaggaacagttgatacgccatctctacaagaaagg

SEQ ID NO: 556352 - DNA, 285 bp, Homo sapiens
  misc_feature (112)..(112): n is a, c, g, or t
gccaagagtttgagaccaacctgggcaacacagtgagaccctgtctttacaaaaaatttaataattaccctagtgtggtggcacacacctgtagtcctagctactcaggtgnttgaggtaggaggaccacttgagcccaggagtctgaagctgtagtgtgctatgatcacaccactgcactccagcctgagtgacagacaggttgtctcaaaaatctaggaaaaattttttttaaatttgctaacaaggcactactacctcacatagtttctgtttcactgccct

SEQ ID NO: 556353 - DNA, 211 bp, Homo sapiens
tatgctcctttttgttgtggttaactgaagaattttcactgtgtttcatgaaaagttttttgaaacctgattaaattgagaatggtagttcatgccttataatcccagctgaggcaggaagatcatcatgaattcaagtccatcctttactatgtaaagttttaggacagcctgaactatatatgagatcccgtggctccaattccagggg

SEQ ID NO: 556354 - DNA, 728 bp, Homo sapiens
cccactggaactggatggtcagtattatggattctactgaagctcaattacgttatggttctcgcattagtcagtctgctgggggatcctgtgacatccaagatcatcctcttcacgcgtctcagaattcagcgagaagagagaggatgactgcgcgagaagaagctagcttacgaacactgtggaaggcagacgacggtgccgaccttgcttagcgcccgtcaaggaatgatgtctgcgacgaggagacttcctaagattgatagctctgtctgctaatgcggtctcgataatgatggagcattctgatgttcttgccagttttcggatggttgttgctcattagaagcatgtggcatatgtattacaagcacttatatactggattaaggcagtgaatcacgcagacgacattggatacagcctcaagctagaacgcaaaaggacgcgagaactcgttggaactgggtatgaataactgaagattcagaacatgagaaatgatgatgacatccaatgcaaagtgtctactttgaagtgatacacggatgatgactctcttccctgcagaaagctggtccagagaaccatgccattgtgatccgacgttcagactccatgacattccttgggtgtatacccccaaatccatttgaagtgcctctgggtgaagccatgcccttgggtgatcagcacatctgttgcagccaaaatgctagaaagggggc

SEQ ID NO: 556355 - DNA, 135 bp, Homo sapiens
ctttttctttttcttcttctttgtcttccttttcttcagcctcatcatcgcttacttctttatcacgttccttctccacaaaaagcgtaatggtactaatccaataacactgagaatgtttcttcacaatctccc

SEQ ID NO: 556356 - DNA, 311 bp, Homo sapiens
ctgtgacaggagcttgagagcttgaggctgcatgtacgtgactgcaccactgggggatgacccaggcaaagggaagcatgaaccaaagaaacaagacctgtaaacacacacacacacacacacacacacacgcagaaagggctgggcacagtggctcacacctgtaatcccagcactttgggaggccgaggtgggaggatcacgaggtcaggagatcgagaccatcctggctaacatggtgaaacaccgtctctactgaaaaatataaaaaattagccgggcgtggtggcgggcacctgtagtcccagcta

SEQ ID NO: 556357 - DNA, 696 bp, Homo sapiens
ccgatgccgcagacctgatttaggcgcgatttgcgataattagcagatcaccgccagcaagctggaccgattgctcaaggtcatgaagatcaagctactgttggataactatatctggtccgtgtctatcaaggaatcagcgagcattggtatctttctagtagtctctgtaaagcttagccggctgatgatcatgcgagagcatactcagacccgtgtcgatgagcgaaccaagatcctgtcatcacgttgatatcagtgtcaacagtgttcacgtgattcgtggtaacaagggcatgttgcaggtggacgtcatcatctatatagacagtgacctgggcacgcgctacatcagtcatgctcgcataggttactatagtatccagatcgtctatcctgacactagcgcctagaacgagatgagccgctacggtatctgcgtgctacgaatcagccatgcaataaattgcagcagaagttgttccgctttgcctaatatgctgatcatgctgtctgttactgacgtagtgatttacgaacactgcagtagactgacatcatggccaagttcgcatcgccaccgttgtagtattgctagagactacatgtaccaagaccctaacctctccaagcagactcgatctaaccaactgtcactagtactaagtaactgagctccgttgaggttcctacccc

SEQ ID NO: 556358 - DNA, 1683 bp, Homo sapiens
  misc_feature (376)..(376): n is a, c, g, or t
  misc_feature (1683)..(1683): n is a, c, g, or t
ggcaagtgatggtcccgttaaccgcgtgaatcaggctcaagtatgggacgatgtgtgcatattcaacggattccgtcactgttcagaggcacagcgatctcttggcaagtaacagtaactctgtgttccgcatcaatagagaagagtctaacatgcagagcacgtcaacaagacatggagccaatgatcgggaggcgacaggccctagatgtgtccgggcgcgagcgccccgatgtccttcgagctaccccgaggtgttgaggtgcactatgacggctggcccagtggtgaggccgtggtgtctgggttcccgggacggtcctggtggctgggcgtccttgggatgaccgcgagtcgtggcagcgcgcgcgtgggnacccgtggcctcgtgggggcgtatcagttggggaggccgggtgacccactcggatgcgcgcacggttgggtcccgagggggctacacatggtagcgggtaacgccacacctatgaaggaacagatggggcgcaatgtattcacacgtgtgtcacatggcgtggacactctgttaaccaaggtttggggggcccgtgtgggtcttcccatggcgttcgttgagagctcaagggccggaagggcctagcgacgaagcgccaactggattggaaacgcctacttggcggaggccacttatacgccgcagaataggggttggaggcattgggaggacgaactaggggctgtgtggtcaccccatacagggtgaacgcgccattttttccaaatcagggaaccagggtgtggcctcttatacggacaggcgggggggaaggcagggcaccgggtggcccttagggaacccttaaaccgaggggggttggcccacatttcggcacttgggcgattcaccccccgtggagttggcgccccacccccacggagtggtacgcccccgacccccccaatgggctcatgtggagccgccttatatgggttaggggagaggccaaccgaccgggggcggtccacaagggcacccgtgggcaagctggaaactttccccacgaaaggccaccgccaacacgggacgccttgggtgttggccataggcacagcgacaggggggcgggcgcaacggccataggagcacccaggagagaggacgcattcccagggtaggactagagattggaggtagttagccgcattgagcaacaacgattagcgcaaagggagggaacaaagcgaaagagcgcattgaggacaggatgcatcagcaaaccccggggtgcccaatagaaaacaccacatagggccccctgagaaggcaaacgaaaatcgccttgtgggacaacggaggaccaacccagggccataaattcccacgcatataacaagtcacaaaactcggcagaaggaatggcttgagggacccacaagcaagggcccattaggaataggcaccgggtggcaacagaaaatctaagcccaaacgaggagacagagggaaacaggcgcacgacgcagcgcgccacatgtcaagtgtgagtagggccacaagacacgaggaacaaccagcaggccagacacgaaatagagaaaaaacgacccacgagaaccacctaacacagcaaggtaagcgcaacaacaaacagcgatagcccagacgaagaaaagttgaggcaaacaccacaccacgagagn

SEQ ID NO: 556359 - DNA, 464 bp, Homo sapiens
  misc_feature (434)..(434): n is a, c, g, or t
tcactctgtcgcccaggctggagtgcagtggcgggatctcggctcactgcaagcaggttcaagcaattctcatgcctcagcctcctgaatagctgggactacaggtgtgcaccactgcacccagctaatttttgcttttttttagagacgaggtttcaccatgttggccaggctggttttgaactcctgagctcatgatctgcccttctcggcctcccaaagcactgggattacaggcatgagccaccatgcctggcctggaagaatgtgctttatttccattttacaggtaaggaaactgagccctagagaggttaagtaacttgcccaagattacacagctactaaaaggcaagacaaggttctggaggaaagctgttaccttccaggtctacaaatcctaaactctacatgagtctggcttacatggcaanggggaatgggagttttcgagatgcccagaa

SEQ ID NO: 556360 - DNA, 158 bp, Homo sapiens
  misc_feature (120)..(120): n is a, c, g, or t
  misc_feature (123)..(123): n is a, c, g, or t
caggcgtggtggcgggcacttgtaatcccagctactcccaaggctgaggcaggagaattgcttgagcccaggagtttaaggttgtagtgcgctagacggcgcctgtgaatagcccctgcnctntagtttggggaacatatgagacccctgccatctca

SEQ ID NO: 556361 - DNA, 242 bp, Homo sapiens
  misc_feature (23)..(23): n is a, c, g, or t
ctgggctggggacagaggggccncttcggcacgctggtctacaccatcaagcagatgaagatgtaccggaggcttcagccaagaatgccccgactgtgcatgtacatccacacggtatgcttcctgagagtctctgctggcctataagcttgggggtcaagcaagtaccatgtacgctgctgcacaggtctgcgtctactgagtggcaatgatgtacacgtgggcgtgtgcaatctctcgtg

SEQ ID NO: 556362 - DNA, 147 bp, Homo sapiens
gtggagacctcaccctccatataccgtcagagagtccacgtgaagcctggctctaatgtctccctggatattacatttagcgacccttccctctatggccccaagagtagtccctaggaggcccctctgatcccaagcggagacaag

SEQ ID NO: 556363 - DNA, 1042 bp, Homo sapiens
taggccgcggtaatcggcagaggaagatgccgacggtaaagaaggcaaggaaagaaggtggctccggcccagtcgtgtcgtagaagaagcaggaggctaagaagagtggtgaatcccctgttggagaaaaggctaagaatagggcattggacaggacatccagtccaacaagagacctcacccgcttgtgaaatggccccgctatatcaggttgcacgcgtgcagagtagcctatcctctataagcggctgaaagtgcctcctgcgattaactcagttcacgccaggccctggaccgcaaacagctactcagctgcattaatgctggcccagcaagtacagagccacgagacaagtgctaagagaagaatgcacgagactgttgtgcccgggccgagaagaagggctgctggacaaataggggacgtcccaacgaagagaccacctgtccttcgagcaggagttaacatcgtcaacaccttgtgtggagaacaagaaagctcagctggtggtgattgcaacacgactgtggatcccatcgagctggttgtcttcttgtactgaccctgtgtcgtaaacatgggggtcccttgactgcattatcaatgggaaaggcaagactgggacgtctagtccacaggaggacctgcaccattgtcgccttcacacaggtgaactcggaagacataggcgcttgggtaagctggtggaagctatcaggaccaatgacaatgacagatacgatgagatccgcgccgctgggtggcatgtcctgggtcctaagtctgtgggtaggaatgcgagctcgaaaggcaaggtaagaatgcactaaagtggttaatgtcctgtgagtttctgtcctaaatatgcatattccaattctcaaagaaaaaaaccagggtcttcccgggggaaaaagtatgagggctgctctctgcccgcccccttgtaaggggatgggccccatgggcaacgaacgccgtaagcagacggaccgccacacacccacaaaaacaccgcgccatcacctagacaaaacagca

SEQ ID NO: 556364 - DNA, 1870 bp, Homo sapiens
  misc_feature (692)..(692): n is a, c, g, or t
  misc_feature (745)..(745): n is a, c, g, or t
  misc_feature (836)..(836): n is a, c, g, or t
ggagtgcagtggcgcgatctcagctgactgcaacctccacctcccgggttcaagggattctgcctcagcctcccgagtagctgagaccacaggtgcgtgcaacaacacccggctaatttgtggtatcttagtagagacggggtctagtagagacggatcactcctgaccacgtgatccggccaactcggctcccaaagtgctgggattacaggcgtgagcacaacatccgcggctgtatttcagagaggagagctgggggtcctggtggtgccaaggtggtacgataatgtcctcttagaggcttcctatggactgccttatatttcagtaacctcaagacaccagttaacctcaaccagagtttgggccttatcagaactcgtgtggtgcatcttattgacagccaggttaacatccctcacccaattattcttttcagtcaactaaatttaccatgccaagtaaccagatgggagcaaatgggtcgactcaacggcagaagggttcgactaggctagcctattcattcatggtccacatctaactggctaggcaccagaaagccacatttgggccagggtgctgtgaatgaataattcagaagacccttttagacactttcacggtcaactagaccattcaccttggggtagctgccttacattaaacttgcaggtgggtaacacggcgnactcaactttatttgtcgcagcacagctcgtcggcacaaaactgcgccagtgnagtcgtaggacagcgggaaaaacaacacccctgttttctttctctcttcttttttatcttaattaaataatttccattaatcatacttttnccacacacacagaatcctacacactgcgacacacacacagatcagcccacaacagcacgacaggcacccatacctaagcaccaaccacacaccagcacgatgacgctacgactagcatacaacactcagccgcagcagacgagcgaccgatacgacacaacgacactgccacaccacaccagcaacacagacagcacatcactcgacccacactaaacagactactcaccaaaacaacccaagctacgacacaacaacaaacattcaccgacatcgcaccaactaaactcagacatacccatccagctcgcctacacgaacaaacataataactcaacacaacatatacacacacacactaccacataactattcatacaaagaacgtccaacatactaacctacattataacaacactacaacaaacacaaacgcaacatataactaatctcaacagcaaaatcatcacaacaaccacacgacaccaacagcaacacaatagtcaactcctttccttacagcacacaaaactacatgtcaagaaagcaacatcactatccatccaccacaccatagacagtaacacactcaacaccagaacaatcagcaccctcaaacaacctacaaacaaacctaccgaacaatacgactcgcagctacgccacaactcatagctaccaaacacaccagatacacacacacctcttaatctaactacctatacaaactcacagcacacacactacaccccatcacacaatcacacaacacaccaacaataatcagcaaaaaaagagtacaataacatatcgatcatataacaatcaaatctcactcagacaccaaatacacatctaccaccctacacacatcactaaatccatcacacgacatcatcaacatcagactaacgaacaatcaacgtcatgaacaataacagaaccaacaaatcagaacatgacgagacaatgacagaactcacaccttataatcacgccaaaacgaacaatatacaacacacacacaacaaccc

SEQ ID NO: 556365 - DNA, 200 bp, Homo sapiens
gagagctattggtaggccagtttataaggtatgtgaaacagaattaagttattggtcctgaaggtgacctaaaggcatttaggctctatcaagggcctaaaatttgggtattatgagtttggtaatccgaatttgtggcagtggcacattatttgagttaaacttaagtgtaattcacatatgcactacgcacagtattt

SEQ ID NO: 556366 - DNA, 629 bp, Homo sapiens
  misc_feature (629)..(629): n is a, c, g, or t
gccagaggctgaccaggcttactgagtggcccacctgcgtggaaggctgccaccgcggcctgatcatgccctctgagcccacacaggatctatgagcggaccctgatgttcctgcaggacactgctggcgtgctgactgctcggatcgaaagtgtggagacaggtctgaagctgggcctgtgtggaacgctgctgtaccacctgatcggacaggagaccatggctgactacctgctgaacaccctcaacaaacaccaacgctatgagtacgtgcagcactacagcctgggcagtgcctgtgacaacgtgaagcgcgtgctgaagagcgagctgtgaagctgccgaagacacacaaggtgaacgtgcttacgagcacagctaacatgaacagtatttagactaactatgctgcaggctatcgtgactgtctgaagactttacgccgtgagctgctgtatatccgtgatagctgtacctagactgttcctgtgtggccactcagcatggctgtagactttcgccatgaaccttgtaccgacttggcgtcacggaggcatgtaggccctcccaggaccttacttgacctcgggtggattgatgccttaagacaggttcaccgttccaggtgn

SEQ ID NO: 556367 - DNA, 298 bp, Homo sapiens
  misc_feature (270)..(270): n is a, c, g, or t
gttacagagtagtctagagcggccgggggccattgattctcaccgggggttaccaattaaggtcaaccattcagtcctaaagtgagtcgtattaaatttagacattttatacttttggtcttttaatgcggtggcgtcgccaaagaaccaatgtaaaattgtgaaggggcttctgtgaggggaagggctctttctagtatgcctgggtcttggacactttaagctgtgcgtgaacgtggtgtctcccttgttatttccttgtggaacaanagaccgaggtctctttgtcttcatttgg

SEQ ID NO: 556368 - DNA, 797 bp, Homo sapiens
gaggcgcgtcgggaggcgagcgtcctcctttggtgcgagcgccggggctcggcttctcgaaggaggaagaaactgaggcctggaattgtgattaactcattcagggttacccagtgtgatagagcgggacaacggaccagaatcaccagcactggctgaaggtcaccttaaccaatgggggaatctccttacaagtttggacatgcacagacctttgagccagggcgcaaatttttttccttgattttcggaacaatgcccaagcttaacaagagtcctgaagacaggcgaccttttattaactcagggtggacctgcgtacggtatttccaacaggattgcaggacgggcactccttggggcggcgaccttgggcacgtccattaccagggacgggacggtctggcgccccaacggaaatacttacgggaggaggggcaattcccacaggccattcccaaggcaaggaattggaccgcacacggtttgggcacaggacggaaacggggccatgtgggcggtcggaccagttggctctccccaagtgtaagggtgtaggggccacaacttttaccagcggcacacactatcttttcaccggacaacattttgttctccaacgcaggggtttcacgacacagccagcccatttataaccgcaaggcgctccttcccgtgtgggacagccctttaacacagcatgttgacccccacaaattaattttcgtgccccaaaccacccagaggcacatttctcatagcaaaggcagaggaacggcagggggaccatcctgggg

SEQ ID NO: 556369 - DNA, 690 bp, Homo sapiens
accacactgggatacagctaccggcgcttggtggtttgtcctcgttaatacgtggtttgccttggatgactgactttgagacgtggcgagagggattaaacgatgctgagaaacttgaggtccctagaattagcaactgtgaaacggtcctcaggctacaagctacatgtcctgcaaggtggcgagaagatggtggtgttatgagtcgtaagcgatgcaggatgtctatgacagtcttgcctccacgaggggcactgtgccgagctcgggaaaccttcctgactgtatttcgcgccagctattgggtggatccagggtcacaggtatgtaagtaccacagtgcacataaaggacaccacccgtgccatcgaacaatggtgtttatatgttttatactagatcagtcgttgcaccagctaattaaagtctcgtgggtcgtctgttcgaggaaagcccttccatggtttaaggccttattaggttctataggtatttcacatagagatacccatcggcctatactggcgccagacggttcagcacttaatttcgctgagtctgcccggtgctgagggctacagggggataccttgtagacccgttagaaattgcctcacgtgcctgtgtggcaatccaagaatctttccaggtattccacttttacgtgtataccaggtctctcgggtctcc

SEQ ID NO: 556370 - DNA, 975 bp, Homo sapiens
ggcacagatcgagaacatcgaacaggagttccgggattggcctgaagctcatgctgctgctggaggtcatctcaggtgaacgcttggcacgccaaagcgaggcaagatgagagtgcacaagatctccaacgtcaacaaggccctggatttcatagccagcaaaggcgtcaacctggtgtccatcgttagccgaaacatcgtggatgggaatgtgaagatgaccctgggatgatctggaccatcatcctgcgctcaagccatccaggacatctccgatggaagagacttcagccacggaagggctgatcctgtgctgtcagagaaagacagcccttacaaaacatgtcaaccatccagaacttccacatacgctggccggatggcctcggcttctgttgctatgatccaacgacacccggcacgagctgcatcgactacggggacgccagaggaaggaatgatccaactccaccaacatctgactacaggcatcaagcacgtgcgcagaagaagttcctggacaaacccccaacatgctggattgccgacagacccacacggcggaaatgcccgaacgacctgaagacaagcatccatgaacttcacgtgtctcagccaataccaagccatcaactggacgcccacgaacgcggaaaacagcagccactcgacatctgcacaggtgggcgacaacacggaacgcgacagcatactgacagaatacgagaagcagcagtgaacggggcgagatcgccgacaaaccgggcgcggaaccggggcaacacacagaatccatgaccacagaggaacgaaaacggacagaccaggacaggagggaggcagcgaaaaaagccagacagtggaaacgagaagacaaagagagagaccacaaaggcacacggacaagagagaaacaggggagaaaaaagacgaacgaacagagaagcgaccaacaaaacgaccacaaggcgccga

SEQ ID NO: 556371 - DNA, 1004 bp, Homo sapiens
gggcctaaagggcccacgcggtgcagtggagcagctgggctggtgccgaggtgactccaacctggaggccttcctgcaggcctcccctcacttctgaaggtcccatccctgttgccctccgccaggccagggctgggcactctcttggagaccaaaagacccatctcaagaacgagtggcggtgagccaactttcccctttggaaaacggcaccttcaaaatcactgcccagggttcccacattgttccccaagggcccagagggccatccaatttgccgggcccccacacagtttcttggggttcccccggcctctagcttggaccctgtggcaggccacttttccaaagggttccgcagggaagggtttggcgggcgacacgctacgagggcctacaacttcctttggaacaccaggagtccctggtcttccccagaggatcctcccggggcggtttcattattatgtgcgccccaaaagagttcggaaaggaaggccggagaattggctcgcccacggtttcacccacgtgggttacacagaggccgttgacgagatacatggtacgtgcgaacctctggctccccagtgccccagggattgctcaattcccaaggaaattcggagcggaaccgactggaggcgacgcgtgcggagacaccatccggattgtcccgggaagttggggaaactccttccttttagggaaaggcaaatactagggtctcctggcgcccaatgaatttaggggtgaggccccagaacccggtatatctatgattgcattgcggaacccatctggagtggctgccccagggattcgcgcactgagaattggctgtggctgacacgcgtatacatcagttctgtcaagagcctggtgccggggccctggtaaaggccaagttttctgggccaagcccctgtgccacgtatcgagagactgccacaagtcgagcggcgaaatgccaccatcttccgtgtggggcgcgactccagcgg

SEQ ID NO: 556372 - DNA, 335 bp, Homo sapiens
  misc_feature (248)..(248): n is a, c, g, or t
tctctaaagcagtagccaaacccccctttgtaaaaggactcttccatcagggatgggaaaaccattggggaggactaggacacatatgggaatttttacctctcagggccgggaggaaagaatggatataatctgaatcctgttaaattttctcaaaactgtttcttagccgcactgtttagggaaaaaccaggaccagtttttttttgtggttttgggaaaaattatttttgttgggggaaattttntggggggggggttgagttgggaaaaatttctaattttttttgtacatttggaacagtgaaaaaaaatgggacccctttaaactgtca

SEQ ID NO: 556373 - DNA, 444 bp, Homo sapiens
  misc_feature (25)..(25): n is a, c, g, or t
caggtagtaaatattttaggctgtntgagtcatggtcttagagtctcttctcaactctgctattgtatgaaaacagccatcaacaatagaaatagaaaacagccatagacaatacctaaataaataggcacgactatgtttaataaaattttatttatgggctgggcgcagtggctcacgcctgtaatcccagcactttgggaggccgaggtgggcggatcacctgaggtcaggagttcgagaccagcctgcacaacatggtgaaaccccatctttactaaaaatacaaaaattagccaggtgtggtggccggcgcctgtaatcccagctactcgggaggctgaggcaggagaatcagttgaactcgggaggcagaggttgcagtgagctgagatcacgccatcacattccagcctgggggagaagagtgagatttcgtctcca

SEQ ID NO: 556374 - DNA, 210 bp, Homo sapiens
acaataagataaccctcacataagaagttctttcaaaatacaaaccgcacacatcagagaatagtgctgcattagcaaagcagacagtcgaaaattaaatacgcagaagtagacattcgtcataccaaggtaatgtaacgcaaacaagactgagagcaattcatgagaagcatcagaacttgaaccgaagattttcattttaatacctaa

SEQ ID NO: 556375 - DNA, 201 bp, Homo sapiens
tggatcccccatcgaaaccctatacaagtagaccactacagccaaataaccgcgttaattgtctgtagtggtctagtatagggtttgatgacaggttttcgatgacatcgaaaccctctccgaggacaatatattaaatggatttttggagcagggtttgatgagggttacgatgagggtttgatgaccagggtttgatga

SEQ ID NO: 556376 - DNA, 159 bp, Homo sapiens
aatgtacccctctcttgaagattgctgaagttgaattaaatagaactgcagatcgatgaaatctgcaaagaaatgatacagctcctgatttgatcttcgtgtcctgtggggactgtgggaggaggggatctgggatggggacgtaggacataaccgcgg

SEQ ID NO: 556377 - DNA, 1110 bp, Homo sapiens
ggggtgcgggtgcccgggtgaggggcggagctgggggcactggcgtccggagcggctcgctggctagtattggcacccgtctggtccggggctctccggagcgggcctagcttgaggaaacgatggcgatgtctccgccgcatggagcggctcaggccggagccatggttaccggtcgaggtctagttcgatcgttacccgacagacgagcgaccattatgtgcccataacgcgggtgaaagatgtccttcggccttctccgatgtgttctccattgtgatccccttttctctaatcgtctcgaggacaacgtcattcagccacagcacactgtgtggctggcgtcgtgacgttacgcagcgaacggtagactcattgtttggttccatgaggcatgatagatgatggatgacttgaacgaggctaaggacttgtgcactataccacttaacgcattggagcaaggcatacgcatagtggtcgagtacgcaatcgtggtccctgtcgtatggcaacgtgcatagcgcctgaggtgaagacatgcgattatgaggacaacatccggtgcgcgcaaaagcagatgccaatttgcaaatcgaaaatctcgcggccaccgacagtacgcggtaggcggcctcagaatggataagtaacccagttggtgtgaggatattctaagttgtttgcacatatggcacgcaccaggcgctagggtttgtctaggccactccgcttataggtttataggcgcgccaaaaggggcactcggggcaagattggccacaatatagatgccacactaggtattctcattccatgcaaagacattcccaaccgttgggccaaagaggcagctctttcccatgtggacagccatttatgccgccaagggggggattttcacaaacgacgtcgacgagtaaataggtattcacgattgcaccgaatggatacaccgttgcgagaggtgtaacacagttaacaccttgtggcggtagtaaacggcaccagatagagggacggtaagttattgaagacagaacggtacaaccaaagagttggaacaggaccccataaaacgtgtaggaattaggacgccgtgtgggagga

SEQ ID NO: 556378 - DNA, 272 bp, Homo sapiens
  misc_feature (184)..(184): n is a, c, g, or t
  misc_feature (259)..(259): n is a, c, g, or t
acggatccccacggacgcattcatagcagtacgaaatagatgtttgacaggtttgcatgagtgtctaagaatttatatccagctgtcattaaagaccggtaataacagacaaagtcgaagaaaaatataacggtcactgaattatacagaaagatgaaggtgcttaatagtggtatcttactgntcaaaagcacaagagcagaacatttaggcttagtttttagaaacagacagcccagacggcggtggctcacacctngttaatcccagca

SEQ ID NO: 556379 - DNA, 477 bp, Homo sapiens
ttgattattatctagaatccttctctaacagaaaatttcctatcattgtaatctgttaacctgggggatacagttatataggaaatgcagagtagatgcatgagtctttatccctatatactagtttaaaaattatgagttggtccacataatattccatatacttatttttacttcatacagacttatagatctatgcattaatcttatatatcttattaatgctcaaaatttttatcattgatgataatcgcctcttggggtggaccccctaagttctttggaaccctagtaggtattagagagttacctgtgcacatggtatggcaaaagtacacgggattaccttatataaagtttcttctccggacctgaagccagccatttctcccaggccctctgaatcctttcagtggattatagcatgtggtgaccactagctggaatgctagagccctagagcttaaagtatacttt

SEQ ID NO: 556380 - DNA, 328 bp, Homo sapiens
ctggcatacgtagtgcgtggacgtctggctccggcggatagagaagagcgagtcgtcgtgtagcgcggtcggcggttcccatgccatatggattctggtctactggtggagattggctgagtccctggagaagccgacaccagagagcctttagtgttctctattttcctgtctatgctctgtctcacttaacactacgttttctgctatggtctgtggttgatgacctcgatatgagtttcgagtgttaacgtgtttttgtttgggaagtaattttgtttgaaaatgctctcacatacaggaattagggcctagattgtaagctctt

SEQ ID NO: 556381 - DNA, 959 bp, Homo sapiens
gtgatgttcagatacattataggctcgaggtttaatacaaaaatctgatgtattccagtcacactgtaactgaaaaagatattctaagctcatgagcctatctctcatccaaataacagttgtctaagatcattaattgattgtcaatttttgatctatttgagtctaagaattccacaattttgaggaattctttgccaattattcacatattctgcagtttgaacagaggagtgtaaagcaattccagcaggcgcagcagtagctgtgactgcaataaggcccataatcactgcaatcaaagtaaaaatgaatcttttagatctagttagaactccttttaatacttaagatatgtacggatggagaagcctcccacggtcgatccatggacacagggatccacacgccttctcttgctcttacagagtaccattctgccaatcaaaagttgaatcaatgcaagtaaacaatctacaattttcactggttgtagtatgggaatctggtttaatagctatgtttcctacaactagcatataaggtggttttacacaacttgcaaaggaatttcagatgtaatttaggttaatagtataatatggcttatgatttctgtcccctacttgatttccagaccaaattctaatgtggtatgaggccacagtgagcttccattatcctgaggtgttcaggaccaactaagaggactaactaaccttggtccgggggatgaaattctcttttcaccccattttcatggatagggtgaatcttggcatttattagactggttagcctttatttaatattacttaggcggatagggccaaagattgagcgtaaaatttatggttggccacagcaaatatatggccagcgccacataatattacatagttatatcctgttcgacattcaaaatttggatgatgacagacagccaagacaaaagaaca

SEQ ID NO: 556382 - DNA, 485 bp, Homo sapiens
  misc_feature (42)..(42): n is a, c, g, or t
  misc_feature (57)..(57): n is a, c, g, or t
  misc_feature (76)..(76): n is a, c, g, or t
  misc_feature (94)..(94): n is a, c, g, or t
  misc_feature (116)..(116): n is a, c, g, or t
  misc_feature (134)..(134): n is a, c, g, or t
  misc_feature (147)..(147): n is a, c, g, or t
  misc_feature (186)..(186): n is a, c, g, or t
  misc_feature (205)..(205): n is a, c, g, or t
  misc_feature (296)..(296): n is a, c, g, or t
  misc_feature (312)..(312): n is a, c, g, or t
  misc_feature (348)..(348): n is a, c, g, or t
  misc_feature (365)..(365): n is a, c, g, or t
  misc_feature (380)..(380): n is a, c, g, or t
ggcccggtgagtcccggcctgatgtaaagcctgtgtttcccntggggaattcccgtngccatgcaaagaataaccntctgagttttcctgtgtnggagatgttcaacccccctccngtggagtggaaaggcccnagttgaatactgncataattagtgtggaaccccagaagggccacactctggnctaatcagcccctcaaagncctttctagcccaatcctaacaaaccttaaaaacaagtcttgaaaggatcaagctgccctacaagctgattacctgcctgctagacaaagnagagagcaaaatctancacatctacaacgttcagcatccgattaaaaaagtnctagatataggaaaagnaaatggtgctcattnccaggagaaaagtcagtcactgcaacagccccaaaataataaagatatttaaattaataaacaaggctttaaaaagtgattatataatgatatgaatgttaggga

SEQ ID NO: 556383 - DNA, 183 bp, Homo sapiens
caccccctagcgtcatcaataatgcatgtggaactataggtccaaggtctccagaggatgaaagctggcgtctgtcaatgtcctactgagaacagcacagctaacctagctagcaacattggtttctagtctagcacaatatctaccttatagaatacagtacaatgatacacaatctagaaa

SEQ ID NO: 556384 - DNA, 398 bp, Homo sapiens
aaaccatggagctgatacttccttctggtgccagagtgggtcatcgctccttgatgagatactacaaacagcgatttggcttgccaagagctgtgacagttgctaggaatcaaaaggctgtgggcagagttctccagcaataccgagccctggggtggatgggcagcacaggagcagctctcatgcgtgaacgggacatgcaatatgtgcagaggatgaaatcaaaatggatgctgaagataggaatgaagaacaacgccaccaagcagatgcacttcagggcccaagtgaggttctgagaggctgaaacagatgcatctcccgctgcacttccctccttgtctgaggacagggaagccagattgccgaatggttcctttgctgctacttcatttgtt

SEQ ID NO: 556385 - DNA, 386 bp, Homo sapiens
accatccttattctgcacccacagcagtctgggagacatgagcaagactccatctcagaacaacaacaaaaaaaaaaaaaaaacaaaaaagaacttctgtctaactacagggggtaggaatcatgtgctagcgtgtcctgactgtcagagccttcctgtatgtatgtgcagctactaggaattgaaaccaccagctcttggaaacttgtgccaggcttcagggtgggagaggcagttctagagccgcagccgccaagccaagccaaatggccccatcatctctcgcaagagcaggagaatacctgggggcagaggccatagttgtacctttctgggcaaagggtcagtgtctgtagtgtccatatagggctgtgggtggcagaatt

SEQ ID NO: 556386 - DNA, 727 bp, Homo sapiens
gcagatttacatgctgccagcgtcacctggcctctactggaagctgcttcccggagcaggctgcgcccccgggcgcaggtgaccccgtgggctggggtggctgtggcctggcgctggctggtgctgaccgcgtaacggtgctgctggccgcaaacctgacctggcagccacaagctgaagcctgctggtcattgtgtgcgtgtgccggacccggccagccatgcgccgacacaaccaggacaagttccctggcctcctaccgctacagccccgactgcctggctcagcctgccccgctgctgcgtgggcttggttctttgaggaattttgtcccaggcgtcaaacgctacctgcgccgaagctgctgcagcagaaggccgtgctgctggtggccacccgcctgcccaaggccagctgcagtatgccctgcctggacagctgagggatgccccgtgcggtgcaggccggagcccctcggtcccccgtgaggagcttgagaacaccgggatgggccgctgtgcgggggtgctgttccttgtcccaaaggcagcagtccgggccacatattcccgcacggtggagcaagggccgttgtggctgacttcagacagctgtgcaagcgcgagctgctggactgggctgtgtcctgcgccagcggtcccgttgacttcatgcccagttcatgctcaggacttgcctactgcttgactctcctgggactgttgcg

SEQ ID NO: 556387 - DNA, 1223 bp, Homo sapiens
tgggagacacaagaaaaaaaaatttttggggagagataattaaaaagggggggccccctctttgaaacccccccttagggtgggggccccccctttttctccaaagaggcgcccaaaagtggggagatagtttcttttcaccccccacacacccctctctgtgggaaaacacccttttttcacaccccccagtgtgtttttaaatctctccactcacaaattaaacactgtgtgtgtgatacacaccccctctattctttgtgatgagagagagtgtgtgtgttctctctctgtgtgcgggcgccagagaaacactctgtgatgacacagtgtgtgccctctgtggcggcgagcggtctctctccacacacacacagtgtctctctctctgtgtgtgtgcgtgtgacacgcgtgtgtggcgggagagtagtagtagagacatatatatatatacacgtgtgtgcgccaaagtgtgtagtacacacccgtgtgcgccacacagggcgcacgccgtgtggggcgtgtctctcatcaaagacgcgcaccctccgcgcacaggtgtgcccgctgtgtgtgtgagagacacgcctgtgtctccacccccacagcacacacagcagagagacacacacactactctgctgtgtgtgtgagaagagagagagagtaagagacagaggtagagagagagagtgtgtgtgagacgacactcgccccccctcagagagtatgtgtgtgagaacaccactctctctgtgtgtgcacacacaactcttttttcacccacagtgtgtctctctcttgtgtgtggacacacaaatatctgtcgggcgccctccctctcgcagggagtctctcataaagagacacacgtgtgtcgctctctatttctctctctctctgatacacacccctgtgtgtgtgcgcgccacaaaagagcgagagaaaaactctctatctcccatttgtgtgcgcgctttttcccccgccccgagagtgttcaaaaagtgtgagacacatctcgtgtgaagactactaagaggagacaaaacaccctctcgcgacaaaatactggcctaaaaaaatatgtggggagcaacagcagggagtagtggctcattataacaaaaatccccgcggggaataaacacaacaagggggggcagcaggagcgcaagagaggcccccccaaggtggtcaacaaccccgcagagaatctctca

SEQ ID NO: 556388 - DNA, 133 bp, Homo sapiens
ttgaatattttatctttccttggcttttcccctgcttccccttttgccaatctcaacacccaagttgaagactttttttttaaaatggtttgtcctgaagcttttgtctaattaaaaccctttcaaaacagga

SEQ ID NO: 556389 - DNA, 157 bp, Homo sapiens
  misc_feature (26)..(26): n is a, c, g, or t
  misc_feature (92)..(92): n is a, c, g, or t
  misc_feature (100)..(100): n is a, c, g, or t
  misc_feature (113)..(113): n is a, c, g, or t
  misc_feature (125)..(125): n is a, c, g, or t
  misc_feature (127)..(127): n is a, c, g, or t
  misc_feature (129)..(129): n is a, c, g, or t
gcttcaggggctgggtgctggggaanccacattcacttcggcgtccagaggcagaagcacaaccaacaagaaccacgggggaggcgcctttnctcctttnatgcctgtttggngccctctactgncnangcttttcccctttcttaaaacagccaac

SEQ ID NO: 556390 - DNA, 279 bp, Homo sapiens
atcggtgttacttcacattcggctatagtcctcatcctctatagcaagtgaacaggacttaaccctgtaatatatatctatacagagcctagcacagtgcctaggtgcagagtaagcacttagtggacactggctgaatagaccgatagacaattctgatttgtaaatggagaagaagggagatgttttcttcactgggcagacagcacagcagcaacaaaggaaaatgaaaagcaatggcgatgagttcctagtgagttagaaagcagcaggtcatcc

SEQ ID NO: 556391 - DNA, 494 bp, Homo sapiens
catcgggactaaccccgtataccttctgcgtattgaattgactagaaatactttgcaaggagagccgcaactaagacccccgaaaccagacgagctacctatgaacagctataatagcacacccgtctatgtcgcataatatgtgcgaagagtctatgggtggaggcgacaaccctactgagcctgcgttattcctagtctcttgtctgtgataatcttagttcaactttaaatttgcccacagaaccctctaaatccccttgtaaatttaactgttagtccaaagaggaacagctctttggacactaggaaaaaaccttgtagagagagtacaaaatttaacacccatagtaggcctaaaagcagccaccaattaagaaagcgttcgagctcaacacccactgcctaaaaaatcccaaacatataactgaactcctcacacccaattggaccaatctatcaccctatagaagaactaatgttagtataagtaa

SEQ ID NO: 556392 - DNA, 615 bp, Homo sapiens
  misc_feature (358)..(358): n is a, c, g, or t
  misc_feature (421)..(421): n is a, c, g, or t
  misc_feature (424)..(424): n is a, c, g, or t
  misc_feature (514)..(514): n is a, c, g, or t
  misc_feature (516)..(516): n is a, c, g, or t
gacacccaggcttacactttctctcggctggaggtgtgggattttggggggtcacaattctacgagacacagcgttgaccgttttcgtatttatccccctcacgaaggaaattcgcccccgagagaaaaatttcgcacgagggccaattttttttttgggaaaccaccctccccgttatggccacggtgtgggagttcccagaacactggacactccccaagcctccaagaaagatatccccctttggcgacggccggaaccccccaaggaaaaacccccggcgttattccagaaaaacaggggtgggcccccctttttaatttgaaggtttaccccccaccccggggcggggggggntttattccacaaaaaagctagcccgcccctttcccaattcggaatccttggcccccttcccanctnccaccccccaccctgtaaactagggcggctgcagcaagcagacctttgcatcaacacagcagacaccaaaaaccagtgagagccccgctntntaccgcccggccccagcactcgctagctttcctgacacctggaactgtgcacctggcaccaagcggaaaataaactccaagcagccagtaaaaaaaaaa

SEQ ID NO: 556393 - DNA, 902 bp, Homo sapiens
gcgagcgccacccatgtctggttcaggatgacatgatgtcttgtgactcgcatcttcgtctgccccgccctgctcgagtgtcgcccctgtggccgctcccacctacgggaatgctcccaccgaaaagcggtgctccaagtgtgggcgatactcttttgggggtgaagtacccgacgaaagagtgggctttatccgcttgttagggcgacctctaatcctttttggggcctgccccgcatataaatgttggggagaaatgttgaaaagagagctcttagagctctgccgcatagtggacccggggggacgcgtggccccacatttgccgagggaaaaccttggggtccaccaccagttgttgggaaaacccagggccgggggaacccctgtttgagggaacaaggggccaataactcttaggtgccaacttcatattggggcccccccgggtggcccctcgagtggtcctctcccccccgcggtatatttctgggcgcccgccactttgaccgccgagcacaataaaccttctgttccggccgtttgtagtttggagcactaaaaatggcacttttcacatgggggtgccccaaaaacggtaaccccttggggggggtgaggaacccctgtaaaaaagcgggggttaaactcaagagaccccttggttccaccccaaatgtgtacacaactcccgtaaatgccgcaccaaaaatgtgtgaggaagaaaactcctcgtggggcataccaccgagagtgagtttgttcccctggcccacgcgtttttttaacattttgtttgcctcaaccgttagggacggttctgttttccccggcttgtagggaaagttaaaaacccttttcaaaaacatttcgacattcgcaaatagataaacaccacaaga

SEQ ID NO: 556394 - DNA, 506 bp, Homo sapiens
atggcttatgtttaagaaagtccatggccgggtgctggtggctctcgcctgtaatcccagccttttgggaggccaaggtggatggatcacaaggtcaagagatagagaccatcctggccaacgttgtgaaaccccgtctctactaaaaatacaaaacttagctgggcatggtggcacacgcctgtaatcccagctacttgggaggctgaggcaagagaattgcttgaacccaggaggcgtagattgcagtgagccaagattgcaccactgcactccagcctgggcgacagtgcgagactctgtctcaaaaaaaaaaaaaaaaggtcctgaagaatgcagcagcctagaagggcagtagaccaaaggtggtgagaaataggagctccctgcacagaacaggagggctctcctgtctattaactatcaggcgggcagatctcgttagtaccacagagccatcatagaggaagccacagcgttgtctagttatgcaaaggaggctccta

SEQ ID NO: 556395 - DNA, 260 bp, Homo sapiens
  misc_feature (159)..(159): n is a, c, g, or t
  misc_feature (161)..(161): n is a, c, g, or t
tcgatgggcgacgggatcagcggagagtcacaggtaggtcgcggagcagtgtggcgtatagtgagtgcaccaccccccaccctgtaaactagggcggctgcagcaagcagacctttgcatcaacacagcagacaccaaaaaccagtgagagccccgctntntaccgcccggccccagcactcgctagctttcctgacacctggaactgtgcacctggcaccaagcggaaaataaactccaagcagccagtaaaaaaaaaa

SEQ ID NO: 556396 - DNA, 824 bp, Homo sapiens
gggctgaatctctttacggcattcctcagaccctgcctgcatcccatgtgaaataaaacagccttgtcgctcactacaaagcctgtaaggtggtcgcttcacacaaatcgtcgcatgaatatttggtgccatgactcggatcggggtacctcccttgtggagatcaatccccagttcctcgctgactcttagctccgtgagaataagatctatcctaggacctgcaggtcctcggattgaccagaacctaggaacatctcaccaagttctcaaacatctggagccccatctgaataaaatctggaagctgtgtccaaactcattctggtcataccactcccagagcccctggaacatctgggtccaagcctctctgattgacttccttccgcgagtatcttcgtcgagcgttgagcaggtgaagactgacactgcgccagagtcgccattgggaagccccctagaccatcacgggatgccgagcttcgagtaactctcacagtggagggaacgcgcatgaaaaaacaaacaaacaatagaaatttcttttggtagcgagaataaaataaaagaaaaaaaggactttttcttctggactgaactatatttaaatctcaaaggatggaccatctcacaaacttcctacagcaagtactgtgagaactcaaggggacaagaaaacgacgaccacttcttcaagaggaggaagaaatctgatctttccctacgtctgcttagtgggtaactttgggatgtccctagttgtgcttcccgggaaaattgctttccctggtttcccctttattatggggtctccttgaacc

SEQ ID NO: 556397 - DNA, 158 bp, Homo sapiens
ggaaaataaactccaagcagccagtgctggggccgggcggtagagagcggggctctcactggtttttggtgtctgcactcgctagctttcctgacacctggaactgtgcacctggcaccaagcggaaaataaactccaagcagccagtaaaaaaaaaa

SEQ ID NO: 556398 - DNA, 173 bp, Homo sapiens
actcatcttttacagtgggggtgaattcagtgtagtacaagagatagaaagaccagtccttgcttgaaagacaagtctagaatgctccactattttcaattctaccctccattcttcagataagtcaacttcaatgtacggatggtatgaaaccctagacacatcagcaattc

SEQ ID NO: 556399 - DNA, 231 bp, Homo sapiens
aacaaaccaaaacattttccccccacaaacttgcaacaaaataccccccatcccccccgacccccccttaccattttgcaaacaaaacagaaaaacaaaacaaaacagaacaaaataaagtggagacctccacacctggggcagtttagaaggaagccttccccaatttatagcatttttttttttttttttttttttttttttttttttaggcagcaacactggccttgg

SEQ ID NO: 556400 - DNA, 153 bp, Homo sapiens
ccacaggtaagaatggagaaaaatgtcggactcacgccctactgacccaggaatttcacttcttggtacctacccgtgagaaacacgtcatgcattgtgcacaagcgggttgtgttatgacgactgatcgcacagcaactgtttgtaactatc

SEQ ID NO: 556401 - DNA, 951 bp, Homo sapiens
agtgggggctcacgtctgtaatcctagcattctgggtgaggccaaggctagtgtagaccgcgaggtcatggagttcgatgaccagcctgactcaacgatggtgtaaaccaccatcgtcgtacttaaaaatacaaataattagaccagtgctatgggtgagctgctatgccttgtaagtccccagctacatcgtggatggctagaggccaggatgaatccgcttgaaaccctgggtacgatcggagagttggcaagtgatgcacgagagttgcagtctactgtattccaagacctagggtcgaccagagcaacgactccagtgccccaaaacattacaacctacgtaacatatagacacaataacacagatacaagagtcaagattaagtgaaaatactcacatccaagttgacgaagggcggaggcgcactaggtagtgtggacgcaagtaaattgggcagggacatgaggggaagtcaggaggtttcaagttggtatgaccattaggtgaaatctcgtccagtcagtttagtcattgactagctaaatacacaagcagagattgtatagtcttttaaagaactgaaaaacagcaagcgaaggacagtcaacaatgggcaaattcatcgttaattgtacttaaatcggggttagatccttatagaagtatctactcattacaggcccaagtggcgtggattgtcctggttaacttcgcccagcaagcatttgggaagggccacaggaacaggagggatccccctctgatggcccaagggaagtttccaagggccgaagcacttagggtaatcattagcaaaggaaccccattcttctttaaaaacaatagctgaaagtaccgtaccggccaaccaagccctcccgtgtactaccacccaatgtgtcggcacatcagccttgggctcaacgcttcttactagacctgatgtg

SEQ ID NO: 556402 - DNA, 278 bp, Homo sapiens
actgcagggtgggagaaagatcaaaacaccagggaactcatctatagtaccagagtctctctgatggaagtctataagaaattttgttgaaaaagtgaagggttgggcgaggtggttcacgcctgtaatcccagcactttgggagacctacgtgggtggatcacttgaggtcaggggtttgagaccagcctggccgacatggtgaaaccctgtctctgctgaagatacaaaagttagccgggcatggtggcaggcgcctataatcccagctactgggg

SEQ ID NO: 556403 - DNA, 409 bp, Homo sapiens
atctctgtctctctctgtgtttctatcattgtcactctacaattctctctgtcacgcgaactcaatctcgtggggacactgaacctaagactgccatttatttgagcccacagtaggctaatcgctcactatcatgactgttaatggactgcttcacgctgacactaccccctgatggacctactgctatctcttgcccgaacgataccgcatggagacgtcctagctcaagggctactacatacattactactaagaggcttatattgactgtcctgcgtcatgacagcacaagcacacctttgatcactccggtcatgatgacccttgcgcagaccatgagctctctgacactagcagagaccaggcgaaccagctgtgaccttgccttagtgtcagcgcgaactgc

SEQ ID NO: 556404 - DNA, 119 bp, Homo sapiens
agcagctcaagttactgtgtagaaaatggattctctgctgcccttagtaaaatcctctcccctccggtaaaaatctccaagtgttggtgccccccgccccactgctgggggtatcctct

SEQ ID NO: 556405 - DNA, 111 bp, Homo sapiens
  misc_feature (49)..(49): n is a, c, g, or t
  misc_feature (78)..(78): n is a, c, g, or t
  misc_feature (98)..(98): n is a, c, g, or t
atttgcatattaaaaaaattgtgcattccaataattaaaatcatttgancaaaaaaaaaaaatggcactctgattaanctgcattacagcctgcaggncaccttgggccag

SEQ ID NO: 556406 - DNA, 502 bp, Homo sapiens
  misc_feature (147)..(147): n is a, c, g, or t
atttttgcataggttaatgtcattagaaagtactatcagtattatacattggttaggtaaagcatatcacttgtcttaatgatgctatttgttttaatctagtttattcataactttaaattgtagtgtgactttgacaattacagnggagatacattattcatgttgcttgtaggtcattggtctcttcagcctggctacacattgagaattagcagaggagctttttaaaaagtaccagtgcttagtccccaacctggattgtttggcctattcctccttcagttttttgtggttcgataattatcttttaagttgacaataaacagctaaatttagaggggggattgctttttcattgttctagtttccaaatatttacttttgagatgcagcgtattaaaattttcaaagactggtttaaccattctcattagtaaatacaatgtattttcagtgtatccatagataataaaagttggataggtaagaattggaaggg

SEQ ID NO: 556407 - DNA, 460 bp, Homo sapiens
  misc_feature (376)..(376): n is a, c, g, or t
  misc_feature (425)..(425): n is a, c, g, or t
tctaaaattgatcacaaaattagaattaaaacactcctcagcaaatgcaaaataactgaaatcataacaatctctcagaccacagtgcaatcaaattagaactcaagattaagaaactcactcaaaaccacacaactacatggatattgaacaacgtgctcctgagtgacttctgggtaaataataaaattaaggcagaaatcaagaagctctttgaaaccaatgagaacaaagagacaatgtaccagaatctctgggaggcaactaaagcagtgttaagagtttctccacagacactacccaaagcagtgcttcactacagtgggcagacagacctggaaaattttcatctggaaggcaggcaggagtggaactngcagagggcaggttcacccaaccagtgtggggaggcttaaaagcggggnctcttttggggggtttccggggttgggagttgttt

SEQ ID NO: 556408 - DNA, 327 bp, Homo sapiens
  misc_feature (130)..(130): n is a, c, g, or t
cgctctaaggatcacgatgaggacataaaactgttacgtggagctactttctagttaggtacatatataaataaagctacaaatatctacttactcagctgatcaagactaaatgattccagggcttggngattttgggtggggcgaagcaaacttaaggattgttatactattgattcactgtctttcttaggaacacacactttcttttgagaagtattatacgaaagatgtgaatcctcattcaatctatgccaactttcaccttccagtttcttgataattcatccgtccatggaggtccgccaactccactgccagcatatg

SEQ ID NO: 556409 - DNA, 539 bp, Homo sapiens
gcacgaggcagaatcctggggaaatcaggaactgttatcagacgaagggggacaagaacacaaatccattctctttggtcagcctgcttcaaccatttaggaagaggtcaaggaaatgtatagacacagacacactgagggctgtaagaattcacatgtgacaaacgttaacggtgaaacaaacaggagaaaagcacaaccactcgggccacacccttcaccaaggatttcttctttcgcaaatgttctaggtgtttgttttctttctcactgtgatctcctaagtccagctcttgtcaatacacattccttaatctaataaaaatggtttattattaatagtagcagcatttatcaaacatccacaaaatgctaggcaagatgctgagatatttataaggattatctcatttttaaatttattttttatatttattttgagacagggtctcactctgtcgcccaggctggagtacagtggtgcaatcaagatgcactgcagcctcgaccaccgggctcaagcgatcctgtcacctcag

SEQ ID NO: 556410 - DNA, 137 bp, Homo sapiens
gcggccgcctactactactactactgctcgaattcaagcttctaacgatgtacggggacatgatttttgccctgcgtcccttctctttggggctcctttcccctctcatacataaaatcgctttcaaattaaaaaaa

SEQ ID NO: 556411 - DNA, 437 bp, Homo sapiens
cctataaaaaccctgagaccctagcaaggctcctccatcagctgagagctgcttccactcaatcacacttcgcactgattctccaagcccaggtgtgatccgatttttctggtacacccaggcaagaacccaggatacagacagccctctgtccttttgataactagagggtctcattgacctggttaacacaagctgcctacagacggcaaaactaaaagagcaccctggaacacacgcccactggggcttcagctgtaaacattcacccctagacacggctatggggttggagcctgcctgtctgtatgctcccctagaggtttgggcagcagggcactgaagaatcaagccacacccccatcgcacaccctgcgagggggacaagggaacctttctcttttcagttggttttaataaacactgagtaaatgaaa

SEQ ID NO: 556412 - DNA, 429 bp, Homo sapiens
ttacaatccccacgatcaccacccaatcaatgactaatcaaacgtaaacgtcaaaacaaatggatgaagcatacacaagactgaaaggacgaacctgatctcttatactagtatccttaaatcattgatattgccacaatctaacctcctcaggactccttgcctcactcgatttacaccaagccacccgcactatctataaatccttgccatggccatcccctatatgatgctgggcgcagtgattatacggctttgcgctctaaggattaaataatgcccgtagcccacttccttaccatcaaggcacaccgtacactcccttatccccggtactagttattatcagaaaccagtcagcacgactctattcaaaccaattagcccgtagcgcgtactgcctaaccggctaacgattacttgcaggcc

SEQ ID NO: 556413 - DNA, 336 bp, Homo sapiens
ctcctgcctcagctcctgagtagctgggataacaggcacacaccaccacgcccagctaatttaggtatattaagtagaggcggggttacaccatgctggtcaggatgttctccaactcctgacttcatgatccacccacctcggcctcccaaagtgctgagattacagacgtgagccactgcgtcctgcctaaaatgcatttcctagatgattgaataacagtagtcctttgatagaagataatgcacttggtttatggccttaatatactacttaattccttaagatgtttatcactagaatgataaatgtccagagtaacctataagcatgaca

SEQ ID NO: 556414 - DNA, 153 bp, Homo sapiens
atgacgttactaagtgcggaaccaggattcaaatgcagaacttaaggctcccaaatcttaaacactatacaacattgcctggctagttgctcaaggagagctgatgctataaaggcggcagtccccaaccttttcggcttaagggacccttgg

SEQ ID NO: 556415 - DNA, 367 bp, Homo sapiens
  misc_feature (21)..(21): n is a, c, g, or t
  misc_feature (150)..(150): n is a, c, g, or t
  misc_feature (152)..(152): n is a, c, g, or t
  misc_feature (203)..(203): n is a, c, g, or t
ccccccttttttatacctttnggggggggggggtttttgaggggtttaaaaaaaaaaagggtggggcccccctctccccccaagtgggggccctttttaaggggcggccctctttaaggccccttttttttaagaaaacccccccccctngnagaggattttcccccccccccccccagaaggaaaggccagtttggcccccnagggcccccgaaccctttttggggaaggaaaggaaaaggataaatttggagtggggggtctttaacccaattcgcctggattccctttttttctggggttttccaaccccctaacccccccccctggggggggatcaaagggaataaaaaaaacttttggctta

SEQ ID NO: 556416 - DNA, 132 bp, Homo sapiens
gtgggaaggcatggatcagtgaactccataaccatcaagatgattgttccccgctaagtgattgttccccgcataagtgattgttcccacgctacgatgattagttcccacgctacagtgacttgttcccac

SEQ ID NO: 556417 - DNA, 280 bp, Homo sapiens
ggtggaggccgcaggggaggcccatggacagcggctccaggagcacctccgtgagagccggggggctgagcagacctctcgagcagagctgcacagtgtcaccaggaagctgcaggaagccagtggtgtggctgatgctctccaggctcgcctggaccaggcctgtcaccgaatccacagcctggagcaggagctggcccaggctgagggtgcaaggcaggatgcggaggcccagctgggccggctgtgctccacgctccgccgtggcctggggctccag

SEQ ID NO: 556418 - DNA, 318 bp, Homo sapiens
  misc_feature (49)..(49): n is a, c, g, or t
  misc_feature (67)..(67): n is a, c, g, or t
  misc_feature (291)..(292): n is a, c, g, or t
  misc_feature (298)..(298): n is a, c, g, or t
gcacgaggacacctttaaaatatttaagttctcggccgggtgccccctncacgcctgtaatcccaanactttgggaggccgaggtgggcagctcacgaggtcaggagaccgagaccatccctgctaacgcggtgaaaccccatctctactaaaaatacaaaaaattagccaggcgtggtgatgggtgcctgtggtcccggctactcgggaggctgaggcgggaaaattgcatggacccgggaggcagagcttgcagtgagctgagatcgcaccactgcactccagcctggnnttgttnggtggggctccttctcaaaa

SEQ ID NO: 556419 - DNA, 262 bp, Homo sapiens
cgtaaatgatcatgaggctatctagtatagctcatatttccgggtggtaaggctcaacacacaggacttccactccaagagatatttggcccctcaatccctacaaagtgtagtctaaacaaacaaacgggtcataaaaaatggcaccggacgatataaaaagaactcaatagcaggcttctgactacctctggagaccacacactatcattattctgacggtcttaaatacaacaatccaatatgccccaagatggccatc

SEQ ID NO: 556420 - DNA, 155 bp, Homo sapiens
cgagcggtgtatgatctggacacggccactacctagattctgtatacacgaatgacaaggggttcagctacaccctgatttgctataacacacatatagcaagaaagcatttgtttggcccattctccctattgtataacgaaatacaatgcaac

SEQ ID NO: 556421 - DNA, 161 bp, Homo sapiens
  misc_feature (51)..(51): n is a, c, g, or t
  misc_feature (73)..(73): n is a, c, g, or t
  misc_feature (93)..(93): n is a, c, g, or t
agctctcacgtgctcaacgtggacctcgctagtatattactattaagtgtntatattcaaacaaatgcccatnactctctttggaggcacttncaatggcaatacaaccacctgtctgttagtttagaatttgtgagtattaatcattcgttgagaagctt

SEQ ID NO: 556422 - DNA, 368 bp, Homo sapiens
atactggtgtacacatacatgatcagtgtgtcaaacctagcgtggccaaacacaactgattccccacacacacccccaaacatgcttctccctaacctttcccgtctcagtgaacggcagcactgactgcccagtggcttaataaaaaaatctaggtgtactctcagttttgcttttcctcaccctcaagatccaatccaatctatcagcaagtcatgttgctttgaccttcgaaacacaccgcaaatccattcacttctctccagcccaactctttctgcagtcttttcttgcctgatggaattgactactgaaattccccctcctcacaccgcttccatttttgccccagtgcaatccattctatg

SEQ ID NO: 556423 - DNA, 173 bp, Homo sapiens
gacttggagcgcaccgtagctaatattaccattaccttccctctacactatatcatcttcacaattctaatctactgactatcctagaaatcgctgtcgccttaatccaagcctacgttttcacacttctagttaggtctacctggaggtctacctgggttaggtctacctgg

SEQ ID NO: 556424 - DNA, 124 bp, Homo sapiens
tggcaatggcactaatacgtactggtggtcatagagagttaaaagatcgttccctttcttctgtacttttccaaggttcttgaagagttctgtggttctagaaatacgtgtcagagcttcccag

SEQ ID NO: 556425 - DNA, 1383 bp, Homo sapiens
gtacaggtgtgagccactgccacctgcgtgaggttcttcagtctttacttacttcttacttttagtaacggtagtacaccttgctgaagttaaaggttctacattaactggatcagatgttggcttaaatattgagaggcagggcatcaaaggtggtagtgctaaaattctctggattatatactctattttggagacagtttcactctgtttcccaggcatggagtgccagtggtgcagtctcagcatcacgtgcaacacttggcctcccgggttcaagcaagttcgtgggttcaaggtacttccaagatagcgtggagactacaggcgcataccaaccaaacacgtggcataattatagagatatatgtagagatagaagcagtggagtttacaccattgttgtggccaggacgtggaatctcgaagcgtccacgaccgtccggtgaatggcgacccgaacaatcgaggactcccaaagagagtgctgcaaatatacaggggcgatgaagaccacacgagtccacagaccacatcgtggatcatatggaacattgcgtagacccgtatgaagaacttgagcaccagacaactagcagagacgcatccacaagaggtcgcgtgggggcactccaccacggacacagcgtgacggaccccgaacgtgtgaggccgtgcggcccataaagcccagtgaataaaattaaatcaacatacgggatgagcaataacatagggagcaaatgggactacgaataaaaatgtagacccacgtgagaaaaacagataaagacagtagcatgaggacatcggggacataaatcacccgcgtgataagcatcagtaacaccctaagagcgacgagacagattagcggagtagtaacagagaacacatcaatcaacacgaacttggcaacatctgaaaacggaccgccaagtatacatgacccaccgccgcaagggttgatctaaccaagaaaacagacgtacacgtggggagacggatggctggaatgacaaggagggaagacagggaatagatataatcagagaaacacacgcgttcaagagactaagccagacagtaatagagtgaccaaatacagagacatggggaaagatagccaaagacgagagcgacaacccacgggaggacctcaaccaacagaggccacgtcgcaacacgttcacacgggggataccacaaggatgagagacacaacccacaagacaggccagcgcaagggaataaccaccagagaaggcaacagagcagggagaaaatacaacacgggcgaagtgagagagaaacgacagcacaagagccaacgtggagcacaagcttaggtcggagcggaatcatgacaagaaagagaagact

SEQ ID NO: 556426 - DNA, 274 bp, Homo sapiens
catacatagcgtttttggtatgatacagtatttaatacatccactgttttctgttaaaaatgtttggtagaattcatcagtgaagccctctggtcctgggcttttctttattggcagactttttttttttttttttttttggggacggggttttctttttggtcccccggctggggggccggggctttttttttgttccccccaaccttcaacctttttggggggggggttcctttaagattcccctgggggcattcaagtttggacctggccc

SEQ ID NO: 556427 - DNA, 256 bp, Homo sapiens
cacgatccccagaattgtctacaggttgggatcgtgttatgatgcagtgaacaatcatgctatggacatgttcgaagttactatctcgattcatgtggtgctacaccctgggatatcaagccttccattatgtctgccagagatttggagtcggtcacattatcactgagcccaaagaataggctttaaccactaatgatgttattaaccagttattgcaccatcgtttggtgcgatttgcatgcaccaactcaat

SEQ ID NO: 556428 - DNA, 355 bp, Homo sapiens
tggagccctcaaggcctttggggccagggtttccgtgatcaactcaaccctggtgttcctttttttttggggtggggcctgggacccaaccccggcaacaaactcaaaaaatttaaggggctgggccccccctgggggccttttgtttttccaccaggagtgactgtttccagggcttttgggactcctgtttgggtgtggcctggtccctttgggccctggggtttttttttggccctttaggcaggtttggaaaggccgtttttgtttttatggagggggggtcaaagggggggggggcccccagcctgtagggttttttttttttttggcaataaaggggctttccccccca

SEQ ID NO: 556429 - DNA, 576 bp, Homo sapiens
aatgactcatggatgacttttaggggtcaaaactttagcagaggaattaactgcagatgtggtagaaatagtaagggagctaggactagaagtggagactgaagatgtgactgaattgctgcatctcaacagcactgcatgctgcagagaaatctttcatgaaaggaagagtcagcagatgcagcaaacctccttggtatctcattttatgaaaactgctattgtcaccccaatcttcagcaattgccactataaatcaatcacagccatcaacattgaggcaagaccctatgccagcgacaagattacatctcactggaggcttagataatcattagcatttttttttagccataaagcatttcttaattaaggtatatacattgtttttatttagacataatgttattggcacacaataaagtataatataaacataacttttatatgcatgaggaaaccaaaaactttgactcactttattgtagtggtctggaaccatacctgtaataactccagagtatgcctagattacatgagtattgaaatggtcgcaaatccggggtacgagctcga

SEQ ID NO: 556430 - DNA, 291 bp, Homo sapiens
tgtgctgtggccgggctgaaccacggacacgataaataagcagaactcgtaacctgcggacgaatcccaagcacaagtaactggtttttacactccaatcctccctaatccaagatctaacagcaactccttttctctctgtcactccctgcttttctttaagaaaatgagtaccttgccttaaactatatattggatgaaaatattaaacactttcacaaagtgcttctttggctgttgctggtatgccttgcatttggaagggtcagagatttgaagacttctgtgatc

SEQ ID NO: 556431 - DNA, 1412 bp, Homo sapiens
  misc_feature (842)..(842): n is a, c, g, or t
agaacgtaaaaatgataagagatacgacgagaagaagggaggatgtgctgtgcacgtctgcacgctcgagtccatgtagatgcatccagaatctgattcgtctttagagtaatgcgatatcgttgtctacgcggcactatgcgcgccctactaggttagctctcttcagtacgtgcattggccccgtcgacgttgtggattggctcacagctctgcttgactaggaagtggtgcctctcctcgacggaccagcagtgtattcttgcttgtttccccctccccacggatgtgtttctgcctccgcagcgctctgtctcgtgaagtatcggctccctcctgcttgttggagcaggggatgagcagagttgttgtgtgttgtagagtcggtcggcgtgtgacggcacgatttttctgcttggtcggccggcgccggggattggttgtgtttctcccgcggccgctgtttttgtgcgcggcgcatatacttgttgtagtgggtagagggtgcttggtgggtcgccgccaccgccccgccgtgggcaggcgtggttgtcggctgtcgttgtacgaagttgggacgccgcgctgtcggttgtgtggcaccccggcgtgtggtgttgtgtgtgtgcgcgccccccccccgtgtgttgtcccgccaatatttgggtggtaaattttgtggccccccgccggtttacaaccttttttttcgggggcacccaatacagttggataatcagttgcattagagttgttgtctgcttctgtcccccacaatcgcgcgacggatatgagctgtcgcttaattgctttagatgctctctctctctcgagaaagtttnggcgcgcacccgctacacactctctttaagtggtgcacccccccgggtgaggtacccatactgatgtgttttctcgcacgcactctgtggcgccccgttggtatcacacagagacgcgttgctttcttttatcttcttcgaggagcttttgttaccttatctgtgtttttgtcgtgcgcacagacacagaagatttgtcgtggggccgggaagaggtgttgtcccctccttataatgccgccagattgtctcctctctttgctttcgcagtataataccgccgcgggtgcccacccctccggccaccatggtctcccctcttgggttcccttgttgtgttcttctgcgcgggtattattcttgtgttgtgttgttgttctcggtctctgctcccgcgccgtttttgtattgttcgcccgccgcgcttttgcttcttcttttagtaacagccctagcgcagtaataaattttgtgtttaataaatggagtaagttaataaacccctttatctcgctcttattattatagaatcacaaatatcaacgagcgcgatcaataaacacagaaaac

SEQ ID NO: 556432 - DNA, 136 bp, Homo sapiens
gttggagtgacctggatttccgtgatgaaactgcccattcagataagaaacaccgagactcaaaatccctagaaggacgtcccatggtagaaaagaagagcaagaaacccaagaagaaagagaaaaaacacaaaga

SEQ ID NO: 556433 - DNA, 200 bp, Homo sapiens
tcttaagtaactcttgatggtaactgtgcacccatgttcagacttccagtgtatgtaatgaatgagtcaatgccaccaaagatcaccacgctgccactctggtcattggcgctgagtgtaaccacgacacatgtgcaccatgacacatgtgcaccactgacacatgtgcaccacagacacagatgcaccactgacacatg

SEQ ID NO: 556434 - DNA, 205 bp, Homo sapiens
cgcagtaccaccttgtaaatcgctacaccattggcattgacagagctggcccttaaactctgttgtggtttcctcacctgaaattgttactgcaaacccactagcagaggaggagccattctatgaatatacggattttggttaaaaaaaaaaaacggaatagggaaaaaaaaaaggtttgggggggggtccagctattaatttc

SEQ ID NO: 556435 - DNA, 269 bp, Homo sapiens
  misc_feature (201)..(201): n is a, c, g, or t
  misc_feature (209)..(209): n is a, c, g, or t
  misc_feature (236)..(236): n is a, c, g, or t
aatgtagcctttttttgaaatggtgttgttttcatgtaataaattttcataaatatgtaagtctgtttcttaaatgtgttttcagtttccttgatcagtttgtcctttcctgttaaaaaaaagtaagtttattcctaatattactttcccaggaagtgttctttttcactattttcatattttaaattaaatgctaatttncgtatttnatattaaatgctaatttaaaatacggnaaatggtccttttttcccgtttcaggctttttt

SEQ ID NO: 556436 - DNA, 118 bp, Homo sapiens
gcgtgaccctcagctcacatctggtttagacatcctacctcccgctagcctgggagcagccagaggataggctagtatcttgattctgtctcctctgggcctaagagcatgccgcgcg

SEQ ID NO: 556437 - DNA, 214 bp, Homo sapiens
agcagtggtagggtaagaataaagacagatttcactccctcaagaagctctattgggagaaacaccagaaatgaaccaggagttgacacctgggtcgtgggaactcagagaaggaattttccattgtaaaggcctatctacaccactgtcccttctactgttcccttctagtaacatggtttcatcaggcatatcgtgtaattctgctgaaatg

SEQ ID NO: 556438 - DNA, 435 bp, Homo sapiens
gattgcggtgctatttcagactttttaagcactattcactggtttgatacaaagtcagaatgcagtttgacacccactagccgggcccagagctgacagcctcctggggaggggtcagcccagccccacggcagccctggtgcacacccacagtgagacctgagttcatcttttacctgctttgctcctcacagttactcgggggtaggaattgtggccccgtgtgcccacgtcatagttgtgtaaaccggggcttagacagtgggtcgactttctggagctcaatacggatagtgcctgcatgtggaccccgcccagacagccgccctcttcccacctacccgttaacacccatgctgcatgcaaagccacccacccgcagaaacaggtggtgcagagagggggcggggggatgagaccaagggctgaggaaca

SEQ ID NO: 556439 - DNA, 466 bp, Homo sapiens
gcggtgcagctaggagtagtagggtgtctgattgtatgacaaatataccccactcggcttgtgtgatgaaattgcgcccacgaattttcgctctaccgcgtcagatgccgccattagtagaacgacatgatcgtttagatagttttgaaagtgagtttagccagtgaagaactgttcctgataagaagcagctagccggaattgagcactagctctgggtcatgagctgcctcaaatacttcctccctcacttctcccattctacgagtggcagagaagacctgggccattttagcaagggctgagatcaggactcacactcaggccagctgcctatgccccaggctggtgatgttgggagctcagggtcaacgagaggagagtggggattcttgaccaaaacaaagagggagccatttgagcagctcccatcttccttcagagttctgctgagatttctcccctc

SEQ ID NO: 556440 - DNA, 612 bp, Homo sapiens
  misc_feature (324)..(324): n is a, c, g, or t
  misc_feature (390)..(390): n is a, c, g, or t
taagtaaaccttatttttaataagacaggtggcataatgagactgtgtactcctgaccaaggacttgacatttgctaaattatagaatgaccaaaaatacagatcacttatctagaagtctgagttgcagaacaattgtcctaaagtttttaaaaatttttattactaagaaattcataccattgtgataattaacaagatttgctctacagttcaatgctcagggacatgtgatctgccaggctgtgaatgatgggtaaggtcacacttgcctggttgacccagtgcagaatgggtgctttagacccaacggttcagtgtgtncttttggaattaatacagtgacctgtatcattaacctggagatatcagatctcagatattctagtntatcagttaaacaccaaaaagcattaaaacaaagaaaaactaccctatttaatcgttcagtaaaaactaccatatttaatcattaagttttgtcatgatttagcaaaacaaacgcaaatgtgtgtgtgtctgtgtgtgtatgtgttttataaaacaggttcaggataaaatgtatccatatagcacattatgattattttaatacatttgggcgtacgggga

SEQ ID NO: 556441 - DNA, 463 bp, Homo sapiens
  misc_feature (76)..(76): n is a, c, g, or t
tggtgatgagtaactagagatgtgatcacttggacagtaagatgcaggacacgttccagccacagcacacactttntactctctgggcaaaggaaatcaggattcattgtgctgttgtgtttgtggtgttagcttgctgttttgttgagcagcctgttgtgcagggtttttacagtagcatcctggtaaaaatgaacactctatacagcatctccccagctgttacccactgtgaagtttaacgttaaattagaagagcaaggaaattgagatggaaaagctctgtatttggtttctgccaaggtgttgcagtgcatgctgagccacatgtgacactgcttccaaagacccttttaattaaaggcctcacccagtgaattggggatggaatttcaccctcaactctgacactgactgcatggccaaatggggggtggggggaggtacacatagaacaaaatta

SEQ ID NO: 556442 - DNA, 354 bp, Homo sapiens
  misc_feature (66)..(66): n is a, c, g, or t
  misc_feature (132)..(132): n is a, c, g, or t
acaagatattaaatagtaatactaacatacaatgtcatccttccaccccactcccatcagtgtgtncttttggaattaatacagtgacctgtatcattaacctggagatatcagatctcagatattctagtntatcagttaaacaccaaaaagcattaaaacaaagaaaaactaccctatttaatcgttcagtaaaaactaccatatttaatcattaagttttgtcatgatttagcaaaacaaacgcaaatgtgtgtgtgtctgtgtgtgtatgtgttttataaaacaggttcaggataaaatgtatccatatagcacattatgattattttaatacatttgggcgtacgggga

SEQ ID NO: 556443 - DNA, 177 bp, Homo sapiens
ctcagttctagaggatcccgagtgcactctgtgctctgaactggtgaccatgtggtttcttctttatgagaatctcaccctaagatcaagcctcatggcaaaggcctttgtgacctgtacccacgcaacacaagttgccgtatggcgctaattttgagacacaggtgaaaagcagcc

SEQ ID NO: 556444 - DNA, 190 bp, Homo sapiens
atcaagtaaggcccccgtgttgggcaccccccgtggtggcggggtccccgcctttgggccctgggtggaccccgccctgccccgctacaaaagccagattgggtcccgcggacgccagcaggggcagccccagcctagggtgggctccagcactggggggcttttttgcaataaagtcccgagggtttga

SEQ ID NO: 556445 - DNA, 465 bp, Homo sapiens
acaaaattcttaggtatcgtgatgtacagtcatctcttttttcctttcccctctccgtttttcaatcccctctgcaaggtctctagtaccccttcttacttcccccttaggttaaccaactttccaacctctctcttttgcctactcctactcatcccgaatctgtcttccctacccctttactcagtctgcagcccaacttctcctgaatcactaacaggtccctccatgtctactggctcaatggtgctagactaagtccaaagtccttcaaactcaattcagcacagggcaccttggcctcccagcactttgggaggccgagcctggagggatcacttgaggtcaggtattcgagaccagcctgggcaatgtggtaaaaccccgtctctactaaaaacacaaaaattagcccgggctggtggcgggcacctgtaatcccacctactcaggaagctgaggcag

SEQ ID NO: 556446 - DNA, 432 bp, Homo sapiens
cacgagggggtccggagagcgaatcctgacggagggttaccacaacgaggggccgacctgggctccgaacgggcgtgttttgatgttcttccgggagagccagggcgagaccggcggagcgcgaatctactcggtcgatctcaccggctacaacgagcgagtcgtgaacaccccttcgttcgggtcggaccctgcttggtcccccctcttaaactgatacagtgtttaaccggagcttaaccgggcgcgcgtattcttgcatctgcgcctctgcgtcagggtgaggcattaatctttgtaaatcaggggcttccatgcggcgtgcggcggccgtccagaggctcgaggagcaccaacaacggcgtggcattttcgcatcaacgaggggggaaaacagtgtcgcacgaccctcagttcttgatcaaatcatgc

SEQ ID NO: 556447 - DNA, 420 bp, Homo sapiens
gctggccgtgaacgcaccgatcgcgccattcggctggagcaacgcctgggtgacctgttgcccgccctgcagcccgcgctggcggacgtcaccgtcggccaggcgctggacatgaccggcggcctgcccgacgtgcgcgaaacgctcggcctgctcggcatctcgctgcacgccgtcagcgaggcgcagccggtgatgcagtttgtcgaggggttggaaagattgaactacgaagccggcagcgagatcgcctacagcaataccggctatcggctgctggaggccgcgctgcgcagcaaagggtatgatttcgaccaactggtgcaacagcacatcgcccggccgctgcagttgcagatgcgggcgccggaaagctggttcgacgtggtgccggggttggtgccgggttactggcgagcg

SEQ ID NO: 556448 - DNA, 148 bp, Homo sapiens
gattagtcacccaggcaccagtcaacatcatgcaccactaaggcattatcaagcgtgcattcaacagcagcacaccaggtttatcattcaatcaacagcactagcatcgtccaacacatgctcggagcattagcatcacacacagcac

SEQ ID NO: 556449 - DNA, 177 bp, Homo sapiens
acaattttttgaattttgaattgggtaataaattcaaaattaagtggcatcaagaattcagttggggccgggcgtagtagctcacgcctgtcatcctagcacttttgagaggccaaggcgggtggatcacctgaggtcaggagttccagaccagcctggccaacgtggtgaaacccc

SEQ ID NO: 556450 - DNA, 940 bp, Homo sapiens
catcatctctagcatcaccagtattagaggcaccgtgctgcccagttgagagcatgttataactggacgcggatagcctaaccgtgcacaaggtccagccgattaaatcacttgttccttaattagggacctgctatgagatggctccgacgagggttcagcggtatctaactgtgtaaccagtgaaattgaccgtgcccggtcaagaggcgggcatgaggacagcgaagacgagaagaaccgtatggagctttaattgattaatgctgacagtagccaacaaagccacaggtcctaatgtaccaaacctgcattaaacaattccggttggggcgacctcggagcagaagcgcaacctccgagctagtacatgctaagacttcaccagtcaaagcgaactactatactcgattgatccaataacttgactatcggaacgagttaccctagggataacagcgccagcctattgcctagagtccatatcaaccaatagggtttacgacctcgcatgttggctcaggacatcccaatggtgcagccgctattaaaggttcgctgggcaagattaagtcctactgtgatctgagtcaagaccggaagtaatccaggtgggtactatctagttcaaattcctccctgtcgaaaggagggagagaattagggctacttcacaaagagcttccccgtaatgatatcatctaactaggatataccaaccaccaagaacggttgttgccacccacgccactcaagtaaaactgggtggggtcggcctcacaacttccgaattcgtggcgggccaagatgaacgcgctaggccaggaaccgccgacgcggtctcaacaaacgccggcggggctcaaccagggcggtcggattcaggcagctaaacgccgaggggccacaagaaatcaacacgcacaccacaacaccgcca

SEQ ID NO: 556451 - DNA, 189 bp, Homo sapiens
caacgcctcctcctccatcgtttaaaatgtttctcttcccccatttgctgagatcctactaagtggtgtgttttcatcatctctgcttccttcatctctttcttttctctcttttgactacttctttttttcgttttccttcatccttcttattgttcatcctaatatccacccttctgtcgtcttctc

SEQ ID NO: 556452 - DNA, 372 bp, Homo sapiens
  misc_feature (19)..(19): n is a, c, g, or t
  misc_feature (34)..(34): n is a, c, g, or t
  misc_feature (40)..(40): n is a, c, g, or t
  misc_feature (43)..(43): n is a, c, g, or t
  misc_feature (52)..(52): n is a, c, g, or t
  misc_feature (101)..(101): n is a, c, g, or t
  misc_feature (116)..(116): n is a, c, g, or t
  misc_feature (173)..(173): n is a, c, g, or t
  misc_feature (219)..(219): n is a, c, g, or t
  misc_feature (248)..(248): n is a, c, g, or t
  misc_feature (265)..(266): n is a, c, g, or t
  misc_feature (270)..(270): n is a, c, g, or t
  misc_feature (281)..(281): n is a, c, g, or t
  misc_feature (312)..(312): n is a, c, g, or t
  misc_feature (324)..(324): n is a, c, g, or t
  misc_feature (334)..(335): n is a, c, g, or t
gattttaaaaagccacatnggagctctcttttanccactntanaatatccantttttacattttttgagggggagtgagttttaggggggaattaagattncagggagagctctgnggatagaacagggcgcagattccatctcttcccaaggccctttttagtgactaagtnaagggcccaacttcccttccccaccctacgctgagcttattcgagntcattcgtactaataatcccttctgcggnttcctcaatggtgctgnnttangccaccccagnttaaccatgattcctttccctctgtgtgagntttggttttgtnacttgcttanntgatgtgcgtatgtgttttggtggggtgggctgttct

SEQ ID NO: 556453 - DNA, 469 bp, Homo sapiens
agcggctggctgatcctctcccctgcccttggctccatgaatggcctcggcagtcctagcgggtgcgaaggggaccaaataaggcaaggtggcagaccgggcccccccaccctgccccggctgtccaactgacctgtcatcacgtctataaagcggcctcctgaccagcacccaagccgctgccgcggagccgagcgcgacccgccccgacgacgaaccccctgaagctgtgccaagatgtgtgacgacgaggagacaccgcctggtgtgcgacaacggctctgggctggtgaaggccggtttgcgggcgatgacgcgccccgctgctgtcttacccgtcccatacgtgggccgccgcgggaccaggaagtactggcgggtatgggtcagaaggaaatcctacgtaggtgatgaagccccaaagcaagagaggcctcactgaacccctaaggtataccatcgagcatgg

SEQ ID NO: 556454 - DNA, 232 bp, Homo sapiens
  misc_feature (157)..(157): n is a, c, g, or t
cgcgaggtctctgttatgtttgcagcaggaggccaacatagaacatactcgccagtactcggctgtgcaaaacaggcgctagcgctgaagtacaaatgggaaaacgtgattcttttgttttaaataaatacttagaacacgatcttggctcctacanagcatctggtactctgaggtctcagctacgtggagtgtctcaccctatgggccccacgcatgaacgcgccttaat

SEQ ID NO: 556455 - DNA, 878 bp, Homo sapiens
tttccctcctccccgccctcaggtccacggccaccatggcgtattaggggcagcagctgcctgcggcaggtcggccttatgcagcgtgggcagcgagcaggcaggctctgcgagtggtaaacccccagcgcgtttaggccagtggcgcttctcacggcattcagcagcagcgtggggtgttaaccgacaaggacaccttcgaattagggcagcattcctcgattccagcaaagcacccgaatattgacccgaaatgagcttcctgagcagcgaggtgtgggtgggggacttgatgtcccccctttcgaccaagtcgggttgggcggcttgaagaaagcctaggttctctttagaatgattacctggaggttggccaagcactttcaaacctcatgggtttctccaagcgacaagggctaaggcgggctcctccgaaataggctggcctgtggatgggttggtacagcccctccaacaacaggcaagggaggatgccttcccccgggacaaggattgctgtggacgaaccattggctttgaacggagtcgacgtcggatgccctggtggggtatagaatgacctgaaaaccattggccagatgaccgttctggaccacgtgtggaattgagcactttggtgattcctctttggcccccttagtcccagggaggactacattaggcaggcccccccaacgacggtgaaacccaaattggccattctcccaagagggttttaccagagccgcgaccagggttggccccgttacacttgttagaagcgtcattcccttttccccaggcggccgggcgcccccatcagagaacatcctttaggataacacatagcggcggacacgggatccacacacgacaac

SEQ ID NO: 556456 - DNA, 473 bp, Homo sapiens
ggagtccccaggttcccatcccagaagtccaagaacatctcttttgtcatcgccaagcctgatgtcttcaagagcccagcctcagacacttatgtggtctttggcgaggccaagattgaggacctgtcccagcaagtgcacaaagccgcagctgagaagtttaaggtgccctcagagccctcagccttggttccttagtcagcacccaggccccgggttaggctggagtgcaaggaaaaggaaaaggagggaggaggaaaaggtggaccaggcggggctggaactgcgtgacatttagctggtgatggcgcaggccaatgtgtccagggccaaggccgtgcgggcttttagagacaaccccagtgacattgtcaacgccctcatggaactggccatgtagcccctggccggaagctggagccatcctacgccttccctcagctttggtactcaattaatcggtgtcccttcca

SEQ ID NO: 556457 - DNA, 644 bp, Homo sapiens
gctccgggagctgccgacggacggagcgcccccgcccgcgtcccgggcgtactcgaccgtaaggcgcgcatgcccgttcatccaacagccacaacgcagctgaagctgcgcattcccggcccgaggaacggagttctcgccgtacgcttggatcgccacacaatcaaccatcatggacaacggtggctgacccccgcagctctggtacgctggtagctgtctcgtccaagtacccacgccgagtcggccttacaccggcttggacgacgtcatcccagcactacggtccgtgtgacccaactctctgagagcccaacactctgttaacaggtccagctcggaaccacgctcgagggcctcgcccgctagccagagcgcctcagaccagaatggaacggatcaccgttacgccgcacaacgatacgttcgccacaaccggcggaattccattcattctcaagaaccacccccccaacctcacaatgccctgactgcggcacccccacgacgacaccacccgatcgcccgcggccataaccgacaatcgcccgcccgaagagtgctggaggtacggcaaggccaagcccacgcagaatccccgggaccccacttacgcacaactgccacagctgggaaacgacaag

SEQ ID NO: 556458 - DNA, 480 bp, Homo sapiens
gtcgtgactggaaaaggtcagtgcagtcttgaatctacagcttgggctaagagctctgaaaatggaggtctgcacttacctccagtctacatgtgctactctcctgacaagatgcctacaccccagtggtgataaatgctgaagaggactccgctgtgcgccaccgtgccttccctgccctcccccatggccacgaggcatgccaactccctcaagccgcttcccggcgaagctgcccgtgccttgtgagtgcggactgagaacgggaagaacaagggaaatagatgaaagtggtggactttgaaattcccgttcatctcccaaagctatcaacccattcgacggcaaagaagtgacactttcttaatgcagcagaggggaagcttagggtaatgtcgaggattctgctcctggaattgtgtgagctcggaattggaggaggcgagacctttcaatggttacggctccatttctcatttt

SEQ ID NO: 556459 - DNA, 281 bp, Homo sapiens
ttcaagtctgacatatatcgattcaccttagtatatgacactctggttacgcatagtgcgcgcctcatgagctcaccatcatgatggatcctttcgtgcccattaatgatctttctcactttgcactagcttgtacttagccctcctcaggtgtaatacgatgtacacgcatagcgacccttggtcttatacttctccctctgtataaatcccgtcttgtcaatgctgatgacatccatgaatccagcagggtaggttatatcagttcggaccttgccatc

SEQ ID NO: 556460 - DNA, 299 bp, Homo sapiens
aaattacccactgtcaggcctctgagcccaagctaagccatcatatcccctgtgccctgcagttattacacccagatggcctgaagcaactgaagatccacaaaagaagtgaaaatagccagttcctgccttaactgatgacattccaccattgtgatttgttcctgccccaccctaactgatcaattgaccttgtggacaatacaccttccccacccttgaggaaggtgctttgttaatatttttccccacccaccccaggcccgcacccccggcaccctttaggagggtatttttgt

SEQ ID NO: 556461 - DNA, 151 bp, Homo sapiens
actaaggagcgtatttgggaggagctcactaagctgtcaagcaagttactactcctgagtgtgccctctgatggatggtgagagtataacttttagatgaagcctcacccacactccctgtacaaaaacgcttctcacgtcaagtgtctct

SEQ ID NO: 556462 - DNA, 149 bp, Homo sapiens
tagcaatgaaatcgccagaatatgtaccggtggaaagcacggcgagcagtatcaggtggtggaaaactattttaatcaactgttagaacatggcaacatcatgagtgatgtgcaggttgagcaggtgaatctgttagatgtactagctc

SEQ ID NO: 556463 - DNA, 432 bp, Homo sapiens
  misc_feature (100)..(100): n is a, c, g, or t
gaagtggtttaaaaaaaagctggaagcttaagagtcctcaaggtttaaaaaaactcctcagggtggaaactggttttggcatttgatgactccccaggantcttgttttatttaaattttggcttcttgggatattttcttttcatgccagctcagcaacatgtttaaaaatgttttagctgggcacggtggctcacatctgtaatcccaacactttgggaggctgagataggcgaatcacttgagcctaggagtttgagaccagcctgggcaacatggcaagacccggtctctacaaaaattacagaaattagccaggcatggtggtgcatgctgcggtcccagctacttgggaagctgaagtgggaggattgcttgagcccaggaggttaaggctgcagtgagtagtgatcatgccactgcactccagcc

SEQ ID NO: 556464 - DNA, 162 bp, Homo sapiens
taagaccgtattacgatgacgtattacgatactattagtgatacgtattaggatgacgtatgaggatgacgtatgtaggatgacgtattaggatgacgtattagcgtgacgtatgtaggatgacgtatggaggtgacgtatgaggatgacgtacttaggatg

SEQ ID NO: 556465 - DNA, 176 bp, Homo sapiens
  misc_feature (68)..(68): n is a, c, g, or t
ggaagtaaagaagatttgcatgcagcggttcattaaaatcgatggcaaggttcgaacttatataaccnaccctgctggattcatgggatgttcatcagcatttacaaggacgggggggaatttccgctctgatctatgacaaccaggggtcgttttgctgtaaaacgtattgtaca

SEQ ID NO: 556466 - DNA, 186 bp, Homo sapiens
gggtctgcctggatctatcaggactaattggttgttccctcttctcctgggaatctctcttgagagaagagcaggattctgagaacggcgatgctggaaacaacgctcctttgattcctcaagctactgattttctcactattcttctgtagattttcaggtctatccctggagtatgtagcctca

SEQ ID NO: 556467 - DNA, 269 bp, Homo sapiens
  misc_feature (199)..(199): n is a, c, g, or t
ttggttgcctcaattccttgtggtccccggcacttttggggggctgagactgatggatcacttggggtcgggagtttgagaccggcctggtcaacatggtggagccctgtctctgctggaagtgcaagggttggccgggtgtggtggcgcatgcttactcgggaggctgaggcacgagagtcgcttgggcccgggaggnggaggttgtagtgggccgggattgtgctattgcgctccagcctgggcgacagagggaggctctgtcttta

SEQ ID NO: 556468 - DNA, 196 bp, Homo sapiens
aaagggtaaagaacaaagccacaaggtcatctcaatagatgcaagcaactgacaaaatccaacactcatttacagttaaaaactttcaacaggagttcccgttgtggctcagtggttaacgaatctgaccaggaaccatgaggttgcgggttcgatccctggcctcactcaatgggttaaggatccggcgttgctg

SEQ ID NO: 556469 - DNA, 284 bp, Homo sapiens
gcctttttttttttactttttgtggtagttgggctaaggtggtctgggaagtaagggggagggggttgggggctaggttaagcctgcaaaataaaaagggaggggctcttgtcccctttctggggggcagggcccatcttccaatatggctgttaagtgtattccactgctgtcagcgggaaatataaagggaggaggaggacttctctaaatcccttaacgggtggattcatataactccccccctttggaaatcctagtggccttacaggctcgtggggaaa

SEQ ID NO: 556470 - DNA, 949 bp, Homo sapiens
  misc_feature (1)..(1): n is a, c, g, or t
  misc_feature (259)..(259): n is a, c, g, or t
  misc_feature (266)..(266): n is a, c, g, or t
  misc_feature (319)..(319): n is a, c, g, or t
  misc_feature (325)..(326): n is a, c, g, or t
  misc_feature (329)..(329): n is a, c, g, or t
  misc_feature (338)..(338): n is a, c, g, or t
  misc_feature (341)..(341): n is a, c, g, or t
  misc_feature (345)..(345): n is a, c, g, or t
  misc_feature (357)..(359): n is a, c, g, or t
  misc_feature (363)..(363): n is a, c, g, or t
  misc_feature (365)..(365): n is a, c, g, or t
  misc_feature (371)..(373): n is a, c, g, or t
  misc_feature (377)..(377): n is a, c, g, or t
  misc_feature (384)..(384): n is a, c, g, or t
  misc_feature (390)..(391): n is a, c, g, or t
  misc_feature (394)..(394): n is a, c, g, or t
  misc_feature (396)..(396): n is a, c, g, or t
  misc_feature (398)..(400): n is a, c, g, or t
  misc_feature (402)..(402): n is a, c, g, or t
  misc_feature (405)..(405): n is a, c, g, or t
  misc_feature (409)..(409): n is a, c, g, or t
  misc_feature (417)..(417): n is a, c, g, or t
  misc_feature (419)..(419): n is a, c, g, or t
  misc_feature (424)..(424): n is a, c, g, or t
  misc_feature (426)..(427): n is a, c, g, or t
  misc_feature (429)..(429): n is a, c, g, or t
  misc_feature (436)..(436): n is a, c, g, or t
  misc_feature (442)..(442): n is a, c, g, or t
  misc_feature (444)..(444): n is a, c, g, or t
  misc_feature (448)..(448): n is a, c, g, or t
  misc_feature (455)..(455): n is a, c, g, or t
  misc_feature (472)..(472): n is a, c, g, or t
  misc_feature (474)..(474): n is a, c, g, or t
  misc_feature (478)..(479): n is a, c, g, or t
  misc_feature (483)..(483): n is a, c, g, or t
  misc_feature (509)..(509): n is a, c, g, or t
  misc_feature (511)..(513): n is a, c, g, or t
  misc_feature (521)..(521): n is a, c, g, or t
  misc_feature (523)..(523): n is a, c, g, or t
  misc_feature (528)..(528): n is a, c, g, or t
  misc_feature (535)..(535): n is a, c, g, or t
  misc_feature (553)..(553): n is a, c, g, or t
  misc_feature (558)..(558): n is a, c, g, or t
  misc_feature (561)..(561): n is a, c, g, or t
  misc_feature (726)..(726): n is a, c, g, or t
  misc_feature (728)..(728): n is a, c, g, or t
  misc_feature (746)..(746): n is a, c, g, or t
  misc_feature (771)..(771): n is a, c, g, or t
  misc_feature (795)..(795): n is a, c, g, or t
  misc_feature (802)..(802): n is a, c, g, or t
  misc_feature (824)..(824): n is a, c, g, or t
  misc_feature (914)..(914): n is a, c, g, or t
natgcattttaataccttgctgataaaatagtaacattccgtctttgcaatctgatacggaatacaggaagatactggtaaaggctttgatgtgcatatctatcataaccaggtaatgagaacacacacgaaaccacctactttagtgttacaccataccaacttctcagaaaggtcagcttcaagctctactgggtagcatagagtaaatagcgtccaatgtttaaagactggggaagcggggagaaagatgaaaggngtaagcngcacacacttcaaagcccacttttaagcacacgacattatgaatattaaaaantatttnnatnctaacaaanaangcanttcagcattttnnnaaanancttttnnntatnttcaatncataannacncncnnntnccnctcntccattcntnctcancnncntaaagtntttccngncatngtctagnggcagcacacgtctccnantacnnagcnaccgatctgtcatgaccaccatctcntnnntatttgangntaagntgtcgangagagcagtgaagttggnattcntanctttcatgctctggaaggaagcggccaatttactgcagctcagcttgaactgtttgatgatgttagctgatcttctcaaaccggtggacgtacgcgctgctctttgcactggtagtgggaaataaccaagaatgtagctctttcgaacagcagaacttcatcggncncaatgatttgggcaaaantcctgaggttcatctccagctgctnaacgttgggaatcagctggtagangatgctngaccaggctttgtagagcgtcncatcccagatggacgttcgaaaacaagcacactccagcgggcgagacagacgcctcaggtcttcctctcgctctttaaaaatcaggtcangctgatcctcctgaaccagatccattttgtgcaca

SEQ ID NO: 556471 - DNA, 1021 bp, Homo sapiens
  misc_feature (334)..(334): n is a, c, g, or t
  misc_feature (619)..(619): n is a, c, g, or t
  misc_feature (742)..(742): n is a, c, g, or t
  misc_feature (748)..(748): n is a, c, g, or t
aataatagttccagacttctacacaggagtctatatatctgatcggagaccggcgccctcatgatgctggtgggcttcctgggcttgcatggggggctgtgacaggagtcccagttgcagtgcgtgggcactgtgtcttcggtctgcctcattggttgatattcgctcgattgaaatagtctgcggccagtctggggatattcctcacaaggtatgaggtgattaagggaagtccaggagttttacaaggacacctacaacaagctgaaaaccaaggatgagccccagcgggaaacgctgaaagccatccactatgcgttgaactgctgtggtntggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttctgttngtgcgttggtttgtttgtgttcgtcgttgttttttgtgccactaattttagtattcattctgcattggctagataaaagctgaagttactttatgttagtcttttaatgcttcattcaatatngacatntgtagttgagcggggggttcggttgcttggtttatatctcctcagtgtccgttccgctcgttcatatctaagcagaaatcctgcaatgaaaggtactatcattcgctagacctctagaccaagatatcgtacactcaacagaattcctctcgtctttaacatagatacaaatgtctatcaacttcaatccaagtgtcacttatattgcacgacaattgctcacataactgacaacttatgaccatgtctggttcagccacaccccccctcccg

SEQ ID NO: 556472 - DNA, 455 bp, Homo sapiens
ggaaattcggccattatggccgagggggaagaaatttaagccattaaagggagtcaaatccgtaacggaagctgaaaggttccaggggaggccttgaaaggaggccaaaattcttaaggaccagttggttttccaggggtcattacaaggaataattattaggtcccaagtgaggggaaatccatattctagttaaggcattggggtttagttacacacggttaccaaggttacttagttataaaggtaggattttaaaggagccttaagttagggaaacctttaagggactaagttaatttggaatcttttaacttaggaagattttgaaggggatttttttccataggaggataccatttggcggttgaacatggtaccagtaagggcagaaagttgtagggataacctctttcttaaaggagttaactggcttaatccagcagaagttatct

SEQ ID NO: 556473 - DNA, 479 bp, Homo sapiens
gcgctgtgctgctcgtgcgcgctccttgatcagcagccacagtgagctcaagtgcgacatcatgcgctgagatccagcagcgacagggaggagctggacgccatgacgctggcgctgcatgtgagcaggatagtgcctttggcagtcgtgttcgatgtcgcagatgcacgcggccgtcggccatactgggccgcgcgcgtgccgagaccgaggagctgatccgcgagcgcgtgcgccaggtggtagctcacgtgcgggctcaggagcgcgaagctgctggaggctgtgagacgcgcggtaccagacgcgagctaacgaggacgactggccagtcggactgaggccgtcctgcgatgctgtgtctgtcagcgcaatccgcagcagggctagctgtgctggttgctgacggttgaacgtgctagcggcctctgagtagccagtgagggttgcttggtactgagtcgcggttttcctggcgc

SEQ ID NO: 556474 - DNA, 268 bp, Homo sapiens
ctaacctgatacgcacatgcagtgcatgctttaggtgctaagcatgtttattgtacatgtatactgttaggtccttgcatctgtggtgctaggtgaggatgacaagatgtcgagtgctggaccatgaccgccgcctagagaatagggctgtttgtaggcgttctaaatatgcttattttgtgtgtccctcactacctattacacaccgttgctttgtgggcttgttttgtatgagcgtgtgccatacagtagttaactttccatgcag

SEQ ID NO: 556475 - DNA, 631 bp, Homo sapiens
tggaaacagtcttgctgtattgcccaggctggagtgtggtggcacaatcacagctcattgcttcctcaatcacccaggcctaagcaactccttcccacctttgtagctgggactacagctcacagcacaccgtggctaaaatttttttttggttgagacggattctctatttttgcccaggcgggtctcaggccccgtgggctcagatggctcctccgtgcctcagttctccaaaggcacaggccaagtttgtagctttgtgctccctttgccatcagtgcccaacaagaggttctatcccttttaaagtgaatgtgacttttcataaagtgggttatgtgggggggcaagttcttaaagcgggaattggtaaatccctccgtgaaagtgtttttccagtgcagttcccagtgacctaattactacaataaaggagggctctgggggtgtccaaaacaaacaaacaaaaaaataaaaacaatacaaaacaaaaaaacatacacaccaaacactatacacataccaaacaaaacaacactccagagattatactatcggtccggcacacaaaagatcatacatcataacacacataataaacattttcacccacacccattttttaaacata

SEQ ID NO: 556476 - DNA, 219 bp, Homo sapiens
cccccccccgcccttgggggtttagggggggggtccccccccccccttaaggggcccccccattttttggggcctttttcggggtttgggggctttttggggcccccaggggtttttccctgggaagttttttggggggggccccccggggggttggccccaaaaccccttaaaaagggggggtctttttttgggtttttttaaaggggttttccccca

SEQ ID NO: 556477 - DNA, 531 bp, Homo sapiens
  misc_feature (70)..(70): n is a, c, g, or t
  misc_feature (89)..(89): n is a, c, g, or t
  misc_feature (123)..(123): n is a, c, g, or t
  misc_feature (282)..(282): n is a, c, g, or t
  misc_feature (311)..(311): n is a, c, g, or t
  misc_feature (318)..(318): n is a, c, g, or t
  misc_feature (323)..(323): n is a, c, g, or t
  misc_feature (326)..(326): n is a, c, g, or t
  misc_feature (328)..(328): n is a, c, g, or t
  misc_feature (330)..(330): n is a, c, g, or t
  misc_feature (332)..(332): n is a, c, g, or t
  misc_feature (341)..(341): n is a, c, g, or t
  misc_feature (345)..(345): n is a, c, g, or t
  misc_feature (352)..(352): n is a, c, g, or t
  misc_feature (359)..(359): n is a, c, g, or t
  misc_feature (362)..(362): n is a, c, g, or t
  misc_feature (364)..(365): n is a, c, g, or t
  misc_feature (373)..(373): n is a, c, g, or t
  misc_feature (389)..(389): n is a, c, g, or t
  misc_feature (400)..(400): n is a, c, g, or t
  misc_feature (414)..(414): n is a, c, g, or t
  misc_feature (456)..(456): n is a, c, g, or t
  misc_feature (469)..(469): n is a, c, g, or t
  misc_feature (510)..(510): n is a, c, g, or t
  misc_feature (519)..(519): n is a, c, g, or t
acctcctccctgtttgagcaggtgaaagaccagtttaatgggggtcccggctggcaaacccacgcaaggngaaacccagtactattttngggtccccccgggggcttcccccacttttgaatnggaggttccttccggggtcactgagggggtggggaagctttttgactttgatcccctccctggggggggccctggagaagtttccaggaagacccctaaatttatggagcccgtggcggagaaagcgctgccggaatccccccaaaagccccggggggngtgaaatgtggatgttgcttttgcccccncgggggnatttnagncngncncccccccanattnggtgcgnccccccnaananngttttgcnggtccccaagtaaccnggccccccccnccgggcccccaacnccgcccccccccccccccctttgggtcccgccctttaccccncgactttgcggcncatgggaagaccaaattgcccccgcccgcccctaattccanaaaactgtnttgggggctgga

SEQ ID NO: 556478 - DNA, 1174 bp, Homo sapiens
gctatttcctccttggcctgtctgaagatagatcgccatcatgaacgacaccgtaactatccgcactagaaagttcatgaccaagcgactacttcagaggaaacaaatggtcattgatgtccttcaccccggaaaggcgacagtgcctaagacagaaattcgggaaaaattagccaaactgtacaaagacacaccggatgtcatcttggtcatctggcattcagaactcatttgggtgcgtggccacgcaaactggcttgggccatgcattccatgcattcccctggcatctatgcaaagcacacatatgaacgcaaacatagcacttggcaaggacatggcccttcgtattgagaaggaccaaagcactacaagaacagcaactgaacgggcacaccgcaaagacacagaacttgccgcaacgtccagggcggacctgccaaacgggccacatgcatagcctgcctgtgctaacaccagtgccgcacggcagttccaccgcgttgcctcgcactgtgattgttcacgcttgctggccacgttgcgcgccattcacatagccatacaaccgcttcaataacaatctgaaatactcatatatactcactcttcttctatatctcacaaatcacaaacctttttcttgatcacacgacacctaagagccactatgcgcagaaaagaacaaatctttatctaaacgaccactctacttatcttatatagaatgagaacacccacgacagcatacccctcctcccagctcaccataatggcgcaccacacctactggtaccccacagaccagagaatcaccgctgctaaacagagccaacacaccgctcgcgacgtgcgcaccactccacacccatacttatagaaaaaaaacagtctctgcggacacacaacaaaccagacaaccgtatgccataacaaaaaaataaccacaaccaaggatagcattcttacacgtgccacacacaaggtagcagcccactaaaaaacacgacgagccgtgcacacgcagaagctacataatcaaaagcaccgcatacacactgataggagcaacacacactaccagcacgcctactcaccccaggcccaccacccacccaccacctgccacccgccaccgccccatcgcaacccccatcaccatcacacccgtccc

SEQ ID NO: 556479 - DNA, 357 bp, Homo sapiens
ataggtatgtgatagagctcctagggtatgcggatgggaggaagggttgatcataaggtatgtgacagagctcctagggtatgcggatgggaagaagggttgatcatagaggtatgtgatagaactctttggagtgagagaaatgttttgtgttttggttgtagagatgctcacctgactccatgtgcttatcaaaacccacagaactttatgctaaaaaagtaaattttactgtatatcaattctacttcaacaaacttgacttaacaaagaaaccttcggtatttctagcgtgtttgaaatgggatgcaacgtcttattatggtttgtaaggctctgtctgacatctggcctgtc

SEQ ID NO: 556480 - DNA, 127 bp, Homo sapiens
cctctttcttatccatcttcctccttctcattcttttattcttccttctcctttcttcatatcctttcatattccttcctattattcctcctctcccccttctgtcgtactatctcgcagccgtata

SEQ ID NO: 556481 - DNA, 329 bp, Homo sapiens
  misc_feature (18)..(18): n is a, c, g, or t
  misc_feature (307)..(307): n is a, c, g, or t
  misc_feature (316)..(316): n is a, c, g, or t
aagacgggaatgaaagtnacctccggtcatcctcactgctcattatacgctagttataatgcattgacatgctaagagacactcccaccagcatcatgacagtttacaaatgccataacaacatcaggaagttaccctatatggtctaaaaaggggaggaaccctcagttctgagaatttccttgaaaattcatgaataatccaccccttgtttagcatatgatcaagaaataatcattaaaaaatagccaaccagcagctcatgctgctggtcttgcctatggggtagccatcctttctttattancctgctttnactttatggactc

SEQ ID NO: 556482 - DNA, 1230 bp, Homo sapiens
cagccgcggcgttgtgtgtcatgctatgtcatggttcgcttctcctcctcctgtctcgctgtgtccttccgggggctgtttgtttgtgtgtcgttgctgtgtggggcgcccttttctcgggggtcctgccacccctgtttttgagtttttgaacttggcactttggtggtgagcttcctgcgggggcaacttcttttggccctctgtgccttagccaactttctggaattagtgaggggaacgctcacagattacttaatggaattggaataatttgggggtaaaaattccaattttggtaaatagccgcaacttttttgtgtggaaatttacagcgattggggcaccataaaattgggccctctctgacttttaaaagaaaacgggtgcacgcccatgccaccccagccttatactgtttccaaaagattgacttcgggcatggcctgtcattcctctaaatttttaaaaccctcacccaaagttgggtggtaaaatttggaaaaaggtgaaggtcacccctcagagttctaaatgggtaatcgtgaacccgcaaatttggtaataaagacttttttccggtggtaaaagaacgcttgaatttttgtgaaaaggcatttgttttatccagaaccaccatgtctgaatcctctttctcctctaagtatattttgtggccactttagagcgcccaatttgtgtaagaccagcttggaaattaatgtctggtttagactcgttaagagtgggccctttttccacggtgccacgagtgcctctggctcgttttccctcgttgtttctcccccgagcttggctccctggtgtaaaagatgccctctgtcgcggccacgaaaccacaaatggggctgttcccgctttatttataaaatgcctcgagaccaactgcacacttccacgttcaacgccgggccttgcactatataatataccggaggcactaccagtgaggcaccattctaagctgagtgagtaaatacaccctcttttttgccctcttgccccctataaaaatggtaaatctgatcactatctaccactgtatgaaacttaaccactgggaaatgttaaggagagccaatggttgtaaactttgtaagtaacttataacacctggtgtatctttttgcttatgaatatttctgtattataacccttgtttctgtagtttaattaaaacattttttctcggctgttagcttttttcca

SEQ ID NO: 556483 - DNA, 522 bp, Homo sapiens
  misc_feature (71)..(71): n is a, c, g, or t
ggatcccgatgggggccaatgttccaactcactttggctccaggcacgattaaatttcacttgggacacgntgctatgtggggaccaatgaatgtctacgggactcagctcaacatgttccagcccttaaagaccgtggccattttgggcagtgtaacgtttttggctggcaatcggatgttggcccaccagccagtcaaaaaaccagcccattagttccaaaagaaaaatggaaattttgaaacctgaatgtcaaaaaaaggagtcaagacccattcccagtttgagaagaaaaatggaaaaaaaaacctttttttaaaaaagaaaaaagcccagattggggttaaacttttgcttgtttttcagtttcccccacccccagcaaaaacctggggagcccaaaaagtttctttttttgcccctgggtaaaaagctgtgaaaattcctaacttccccaaatgttgcttttgaaaagttaaaatgggtaatttttttgaaaaaaaaagggtaccaataggacca

SEQ ID NO: 556484 - DNA, 129 bp, Homo sapiens
atatcagaggttgaggcataggatcacttgagtcaggtaggtcaggctgcagtgagctgtgattgtgccactgcactcaagcctgcgtgacagagcacgaccctgtctcaaaaaaagggtaccgagctc

SEQ ID NO: 556485 - DNA, 494 bp, Homo sapiens
aggtgcgagcgtggggcctgtgcactatgaggtcagagtactcctacatgccctggggcccctgagagcttcatcctcccctgctcactgccacgggctctgctcccgctcagctgcccatccggcttcctgctcacagccttgcatcttgtgtccttctctcgcaggccaacactgcacctttatctttacctatcctattcctctctcacgttaatgtcaactaggacccctagctgctatctcatactcatccccactaaaccaatacctcctgggaaaatctcctgtctccagggtagtctgtgcaccatagtgcaatgatttttcttcttgggtctgctcttgtgactcctggaacccttcgcggacccaacagctgcaaacaaaatacctcaacttataatcacagagtgctaaataacagtcatgggaaatgtctagtttagggatggtgtgtgtcctggtatctttgcgtaaatattcggaaggac

SEQ ID NO: 556486 - DNA, 564 bp, Homo sapiens
cctaacagtctgagccatatagtgttatggtcctcatactcctcatactcggtttctattattcaaaactgttttgctcctccaatgtccttggctatattccatagacaattgaaaatccgagcgtcgagtacaggccaaggctgctgaaatcttggctgagactgcactaaatgctgctggccattatcgcattgagccttctgaccctgtgtctgtaggtggcccagctgtctttgagttggatattgagtttctctcagcagagccttgtagcttttagtatgtagatcttacactgtgtttggttaaatgtattcctaagcacatcatacttttcatgtattataaacagtatggtttttaaatttcatcttccagttgttcgtgggaaataatgcggaaatacttgattttttggtgcattgaccttgttaaatgtatgaattctactcacttttgggactattaggcttgtctgcacatgtggtcacgtccatgtgtgagtcaagacagtttttcttctcgcgttctgagccgtgcagctttgttaactggaaagcc

SEQ ID NO: 556487 - DNA, 699 bp, Homo sapiens
agcaccacaaacgcggtttccgacacattttaattaacagattaacaatcaactgctacatattattatattttaaaaagagttaagttgtatttagataattcacaaactatcatgcaaataacgagtaagtagacaagaataaagtggtttgagatgaaaagaacctaacattatttacagtagatgtggttttaatacaattacgtgccctcaaaatgtctctggcaatgtacagaaatattgtatatacttacatcatgtaattgttgtaagcagttataatacacaaatacatgcgtgcatactatctcacattaagtagcactcaacatgaaacagttcaagtccacttattaacttttcagttaggtttgcaatgagaaagagtggaaatttgtatttaggaatagcttatagaattacagacatgttgaggaagtgtagagctttatttgcttgttcatagaggcagaaagtaggaaccagatagagatgaaaaggggccactgaaacgtgaattgatagctcagccatttaagcatgatctacattattcagatagctcttataagctttctataaatatatgcattggtgtgtgtcagtaatagatgtaacgtttacactttgaaagggaactcttgattcaactgttattaataacagcttgctaatataagtagtgatgctaccttg

SEQ ID NO: 556488 - DNA, 385 bp, Homo sapiens
  misc_feature (122)..(122): n is a, c, g, or t
tttgggcccttgggggccccccccccctggggaagagacccgcccgttttctcccttccccccgggggggccggggggggtttttcccccgtggggggtcccccaaggggggccgggggggntttttcccccccggggggtatttttcccagaaaaaaccccccccccccccgggtttggggggggggggcccccttttttgggaaaaaccccgggcccccgggggggccccccccccccccccggggggggggggggggttttttttaaaaaggggagggggggggggaaaaaatttttttttttgttttttttgggggggggtttttttcccccccccccccccctttttgggaaatttcggtttttttttttttttccccca

SEQ ID NO: 556489 - DNA, 867 bp, Homo sapiens
cggccgcatctagaacaccctagtcactgacagagggaacagcagagaacctatgtttggtattcatgcatgtgattgtgatactatgatgaattcaagatgtgcaccgatatgtatataacgagcaactaggatagaaaatagtcgtgcagtggttcctttccattcctattttacgatgggagtcctggcatccagtgacccctcgtctccgacgttggtagcttgtcctaaggtcagactacggcttcacaacgaggaaagcagtgaggctgaaagggggggctatggaagagcggtagggagtccaggggagaagatgcagtgaatgcttgcatgctttccacaccgtgttgtcgtagtcgcgcgagctgagttccactccgtgttctggcggttgctgtcgcgttggatggctaggccgtgctactgggcgttgtgtgtagcagtcgatatgggccagcggagtttcttattcttcgctagtcgccctaatggccggctctctggggggagtagcgaggggcgcggtgggtcgcttgggtggctggtgaatgggcgcgtcgcccttgtgcccgcctgggccgcaagcggttttacccccgcctatacccgtggttatggccatgtgtgtgctctgtcgttggggatctttgttcccgctaactcagtgtgggccaaacgactaaagtggaagcaattacctggtagcctttaacccaatctacccccctttccaagaatccaaggacgccccggaacgatgggtttcttacgcattcctggggcaccattttacactccattttgccctcccgaattaaaattttgtccacttaatgccagcaggctggtcacgcgcaaacc

SEQ ID NO: 556490 - DNA, 109 bp, Homo sapiens
aggtaagagcgcagtaggaggaaggcgaaatgaaaatttggtcatcactggcaacaaccagcctattgtttttcagcaagggacaacaaagctcagtgtagaaattgaa

SEQ ID NO: 556491 - DNA, 226 bp, Homo sapiens
  misc_feature (33)..(33): n is a, c, g, or t
  misc_feature (44)..(45): n is a, c, g, or t
  misc_feature (91)..(92): n is a, c, g, or t
acatggtgagtggaagcccggcagatcgacaanccagattacannggcacttggatccacccagaaattgaaaccccgagtattctccgannccagtatctatgcctatgataactttggcgtgctgggcctggacctctggcaggtcaagtctggcaccatctttgacaacttcctcatcaccaacgatgaggcatacgctgaggggtaccagctcgattgtatt

SEQ ID NO: 556492 - DNA, 236 bp, Homo sapiens
  misc_feature (24)..(25): n is a, c, g, or t
  misc_feature (29)..(29): n is a, c, g, or t
  misc_feature (136)..(136): n is a, c, g, or t
  misc_feature (139)..(139): n is a, c, g, or t
  misc_feature (157)..(157): n is a, c, g, or t
  misc_feature (161)..(161): n is a, c, g, or t
  misc_feature (163)..(165): n is a, c, g, or t
  misc_feature (168)..(168): n is a, c, g, or t
  misc_feature (170)..(170): n is a, c, g, or t
gagagcagaggccatgaggatgannttancacaccaagcatgagatctctgagatgaaccggatgatccagaggctgagagccgagattgacaatgtcaagaaacagtgcgccaatctgcagaacgccattgcggnatngcgagcagtgtggggagntggncnnnaananatgccagggaacaaagctggcgcgagctaggaggagagccctgcagaaaggccaagcagagacatg

SEQ ID NO: 556493 - DNA, 796 bp, Homo sapiens
  misc_feature (539)..(539): n is a, c, g, or t
aattcggcactgagggacgagagagtgagttctcccgtgtgttgcccaagctggtctggaactcctgggctcaagcaatcctcccacctcccagtgttgagattataggtatgtctagaggtcagtttggacagggacaggaacctctagacatgtttttctgggtgaacgagataagcggagaaatcacctaccccccgcagaaggcagatgcacctgctgtttctcctgagagcccacaaaagaagcccccatttcagcccaggagtgtgcaggaggctccttgcagtccccagggcccgcctgcacagaggcctgcccttgcacctccatctaagccttctctgaaagactcaggctcaagaaacccctgcccatctgcacccacctgggccaggccaaagccggaggagtgaggagcccccaccgttctcagcaatccctgtcaccatctcatcaccaggagtgactctgcccatactcggacccctgggaccagcccttcagccaccggtctcgacctctcctctcagcccttntgcaccctgggccttcacctgcaagctgaacaatgtccttactgggaataactggttttccttttgaatcttaagaaaatttgtctggctacactctttaagcaccttcctgagccacccgtggccaggctctgctggccgcatctgcctggccccatctaccttccctggaagcacaggactcaccccaggggtctcacaggaacatgcccagtgctttcaaacccagtaaaattttacttagattttgacaaaaa

SEQ ID NO: 556494 - DNA, 628 bp, Homo sapiens
agcgggcggccgggacggcggcgccgatctgcggggtggaaccgccgcgcgctcccgggctcgggagctgagcccgagagaacttcgctgccttcgggtcgccgcttcccgcttgtccactgctggaatgtgcagctatgggatacgagagaaaccaagggttctggggagacggtcctccgtggacgacttttcgtctctgcaaggtctccataggttgaagcacattctgaggccgactggacattccacagaagtcctgggagcttaagccttaacaacgctcgtgttgcatttaagcgggcgccggtggggcagtcgactgcgacacatcgcttacttgtgggcttgttagcattaagaagagaagggcggaacgagaacgatgtcggtacggtgaccttacctagactgctgttacagtgtgctcctggggctgtgaagtggtgttaatttcatgcaagtgggcggctcctaaaaacttcaacaaggcaaagctccaggtaacggcaggccttggcaaggagactctgcgtcagggtcacccagcagagatcagcaatccttggctcactgaggaggtccggattggcctcacagggcactgccaccacttgaacagaggcat

SEQ ID NO: 556495 - DNA, 1306 bp, Homo sapiens
  misc_feature (543)..(543): n is a, c, g, or t
tttttacttaaaaatgctttatgggaattatttggataaaagcaaatatcttgtttttaaaacaaattatgtgagaaatataaaagctttctcttatctttgaagtgtgccccctatatattttctcgggcatttttctcccccaatataagggtgacaggcgtgcctcccccgggatatatattccgggaaagttgtgttagttctctttagggatatatgtgcccacgccacccgcgggcgagaacaatatattgtggtgctcaagacaaattctcacatatatgcacaaggagagaggagaacaccgacggctgtgtgggttctctccaccctctctctctcacacggcctgtgagaggggtgtcaaggtgtgtgacagagagatatctcaagtgtgtgctatacaggcgcatgtgacacagggcccatatcacaaagggtatattctctctccacgtgagaggcggagagatatatctcccaaacactctatatagacacactctctctccctctcgacagatattatagtgtgccganaaaaactctctctgtgtgtgagagagagtgggcccatatgtgtgatccgcggtgagcagcgtgggagactatttcccgcggagaaggatctcgacgaagacatctcttttataccctcctcacaaagcggtgatattattaccgcagcggagggcgacaaatataaaaaagcggtccttcttttatcaaccaaacgcatctcgcagaagcgttagatgcatctaatctgagaacattcttcctcagcacacaagaggggcgcccccattgatgtggggagcgccccccgctcttatatgtccgccgcaaagtattctcgcccacgacgatgggcaccacggagagaaagctctatatgtgggtctccgagcgtgttctccccaaggaacgccgaagacgaggagaacccaccaccgccaatagcacaaatcactctcccacacaggtgttgttggttaggacgccaacaaaacggaaggacgcagcaagcatgttgtcagaacagcagcgccaccacaacagaactcttgagcgggacgcacccattggtgggcggagggaaggataccccccggcagccgcacaccttacttcatagtatcccttacatgattaaaatcaccccccccacaaagataaggcgtccagtaagctggcgcggcgcgcgctgcacgcaaggaagccattgtagtatgggtagcgcccccccggccccgccccacgaccgcccaggggcggcattatttacacgtgatagcaggtg

SEQ ID NO: 556496 - DNA, 402 bp, Homo sapiens
tggggagtacggaatggggagtgactgctgcatgggttgggtctcttggggcagcaaaaatgctctaaaattagtggtgatggttgcacaactctgtgaatatactagaaaccattgaattaggccaggctcagtggcttatgcctgtagtcccagcactttgggaggccaaggtgggtggctcacttgagcccaggagttcaagaccagcttgggcaacatggcaaaactttatctctacaaaaaatacaaaaattacctgggcatggtggcatgagtctgtagtcccagctactcaggaggctgaggtgggaggatcacctgagcctgggaggtggagactgcagtgagatgtgatcgcgccactgtacttcagcctgggtgccagagtaagactgtctc

SEQ ID NO: 556497 - DNA, 444 bp, Homo sapiens
tccgcgggggacgaaagggatgaacttcgttgatttctttgagaaagaagtggaaggcaatccggagaagcgaaagtgggtaatgcatcaacttcgagagttgatgtggcataaaaatgtacaaaccacgatgaaatacattgactatcgcagaaatcttcacatgctcaaaagcgcggaagagggctggggaactcaccttatcaagctgctttcagcaagagaagagaaatgaccttcgcagcccagcagctacaaggactggtcaaggtcagctttccattagacgacctgccggatttgatctcaccgtctaggcttgtgctcgagttgcaggggacaaggcgcactcatatttgggcgtggtgctatcggaaccagggatacctcaaacaagcatcccagaaattggatattgatcctgcttctcgctgtgagaagcga

SEQ ID NO: 556498 - DNA, 155 bp, Homo sapiens
ctagagatccttgccttacccgggagccttacctatggcttaacccccgggagccttaccctccggtatgccttaccctgtgctgagtgcagtggcgcgatcacagttaactacagcctcaatctcctaagctcaagcgatgcttccactttcag

SEQ ID NO: 556499 - DNA, 400 bp, Homo sapiens
  misc_feature (71)..(71): n is a, c, g, or t
tttcactttaattatatatgtttgtctgctttattcatattcattcataagcacagaagccttgctaatanagagcaaggaatacaactgaaattggggatacaagtagggtgaggaagagactgatttaggagcttgtttaagaaggctattctagaagatggccacaaaatgtggagagagttaaaatagtataaaaatgctaatagttccttaatcgagcatgtgactagaggattatttacatttgttgtctctgcctcatccttttatttttctacttcatcagagaggaaaggggaggcaacattggcctacagacagtttacggtttaaacacactaccgactgactaaagccaacttaaaatttccctagttcctggctaatgttcctgatc

SEQ ID NO: 556500 - DNA, 207 bp, Homo sapiens
ctagaggtccccacagaggctgccagaacgcagttaacagagccacggtgtccaactgtttaaaattgatcagagaccatgaaaagaaacttgtgcttcaccgaagaacaatatctaaacatcgaacaacttaaatattatggaaaaaaaacatagcaaaatataaaataaatataaaaaaggaaaggaaactttgaaccttatgta

SEQ ID NO: 556501 - DNA, 112 bp, Homo sapiens
cctctacatttatatgctgtctacctccattctgaagagggaggtttaggtgtcccttggtcctctgggaatagaagatccattatgtctttgtgtagagcaagcacgtttt

SEQ ID NO: 556502 - DNA, 117 bp, Homo sapiens
tacagagaataacgagatggagctttaatttattactgcaaacagtactaacaaacccacaggtctaaactaccaaacctgcattaataaattaacagctccatagggtcatctcgt

SEQ ID NO: 556503 - DNA, 1034 bp, Homo sapiens
ggtaataactgaccacagtttaggcagtctgagggctcagggatagtactgattgatactcggctcaccagggtcactatgcctcaccaatctatgcccctacaaaggtccaatatgtaccccatacgtcgtctctttatagctgagtcgcatcaacgtgcaagaccacacctgctctcgtactcatggtagggtgcctatcgccttacgtagtatgtgggggctgcgaaggagggcgtgggtggtaggtcatatgttagtcatctagagttgtgacagtcacaagtattggtcgtaaggagatatagtacataattctaaatgtactgcgaatgggtaaggctagtagaccaaacagttataggagtgagcgactgacatgagtttgaagagcaaagtatggattgaagcaatggaatgggtaccaaaggctagttatagaggatcaatcccgtctagtgattttgggaagccacaatcaacaaataaccgatgggatgctgttcacctctaggcgtttgaactcctgaactgcctaagagagcaaccctactctgaatgactagactggtactgactacctacccctcaaatgcattggaatagactgactgagagttcactgcagtgaagcactattcagggaaagaagacactgctactctgtatactggtctccctgacagatctcctgaattataacaatttgacaggcagcagaaactaatcatacttttatgatcgggcgtcgaaatcaggattatcgccacttggttatgatcacccgatgaggacaggcagaaggcggaacgcgggaatattgctatgctaaacctaagtaggtccttcccctactcatcggtatgttgactccaaaagcctaaggtacataaacattcaaataatccttcatggcagaaattaaattctgaccaacattatagagagcttccaagggttatagacagaccttagggcactagatactaagcgagtaaagcccttggcaaatgggcgacctacaagggggtaac

SEQ ID NO: 556504 - DNA, 1149 bp, Homo sapiens
cggccagagacgtcggcgcccttgagccagtgcccctgaccctgcgctccagctgggcagaccccaatccagcatgagcgccgcacccactcgcccatgatgcaggtggcgtccggcaacggtgaccgcgaccctttgcccccctggatgggagatcaagatcgaccctgcagacctggctgggccttcttcgtggaccaccaacagaccgcaccactacgtgggaacgaccacgctgctgttgccctcatgagtggccccaaggagactccatcctcgtgccaatgtgcccttccctgggagggctctagtgctgcctgcctgctaggtgaatggccaccctgtgtacaccccagactccgaccaggctacatttcccattccgtgtgctccattgaaggcgctgagaaccgggcatggtgcaaccgctttccatgtctatccccagcctgggatgcaggcgagttccgaactgaggcggagctagcggctcctcagaggtcccagtcacctctgcggggcatgccagaaagcactcagccagataaacaggtgtggacaggtggcagaggcggaggcagccacaggccccaggctcaccagcggacctgaggcgagcccagtctcgagctgacatctgactgcatcaatcactcatccatcctcggacagctgcacatacctaccgggcaggagcaagctgggaggaaacagtgtcccgcggagaggtacgatctacataccggtgatacacgaagagaagttacacggcaaaaagccaaacatcactaccagcaagccaaagagcagaacaaaggaaaaggggaagtaaaaagcacaagctggtacacaagaccagggacgatactgggcgccccgcccgttcggcgcgaacccggcacgacaaagtacaaggggacatgagccccggaggaacacaaggcagggagagagcgcaaaccaaccgcggcaaggtgtaaaaggaggaaccaggcctcagaccgagcacaaaagcatgagcgaagaaaaaaggagagacagccatggcacaaaaccggacaaacacgacgagggcagcagcagagccacaagaggagagacacgacagagcaccgcaaagagaggacacgagacaacaggaagaaacag

SEQ ID NO: 556505 - DNA, 322 bp, Homo sapiens
  misc_feature (108)..(109): n is a, c, g, or t
  misc_feature (122)..(122): n is a, c, g, or t
  misc_feature (144)..(144): n is a, c, g, or t
  misc_feature (146)..(146): n is a, c, g, or t
  misc_feature (165)..(165): n is a, c, g, or t
  misc_feature (208)..(208): n is a, c, g, or t
aggccaagtgcacaagctgtgcatgcactgcaaggtcagactcatagacggatccaccagtcacagcccaacaaggacgatcacaagacatgagggcaaggcaagccnntgtgatccccacngctcacaggtagaggctgctcntncctctcctagcactgaagnagccttgtccttgggaccggacactatggctttggccctgtgnagggagaaatggtgccacaggagttgtcttaagaggacaaggcatgcacggtctgagatcagaggttgtcatgccacccatgagccagtcttgtggtaacgggccgagctatat

SEQ ID NO: 556506 - DNA, 403 bp, Homo sapiens
tctttcaacacttgaactgcattttttatagttttctttgaaacaaaaaaagtacttctgaaatgaacctttctgcctgcatagaaatattacaagtatttaaggtattaaagaaatttgtcacagcatggtggttcgcgcctgtgggtgcagcgctttgggaggccggggtgggtggatcgcttgaggtcgggggttcggggccagcctggtcagcatgctgaaacctggtgtctgctgggaatgcagacattggctgggtgtggtggcgggtgcctgtggtcccggctgctcgggaggctgaggcgggggggtcgcttgagcccgggaggcggagcttgcggtgggccgggattgctagcgcgctccagcctgggagacagagcgggactctgtcgtaaaa

SEQ ID NO: 556507 - DNA, 300 bp, Homo sapiens
ataacaattatactgtataaatggtacagcatataacaatttcttaaaccataaagctagcatctcctgacaagactagccaggtactcaaaacaaaacaaaagtaagacatcttctctgccatggagtacaaagaaaaattgtattaattctcactggagggggttgctcacagccccaaggggctacaacttactcggaacacagaaagaaggcaatggtgttttatgaaactaacaatgaaggaaccctattatatcctttatttctcctattacttgcctatattaatcaaccact

SEQ ID NO: 556508 - DNA, 987 bp, Homo sapiens
  misc_feature (252)..(252): n is a, c, g, or t
  misc_feature (254)..(254): n is a, c, g, or t
  misc_feature (293)..(293): n is a, c, g, or t
  misc_feature (435)..(435): n is a, c, g, or t
  misc_feature (455)..(455): n is a, c, g, or t
  misc_feature (479)..(479): n is a, c, g, or t
  misc_feature (490)..(490): n is a, c, g, or t
  misc_feature (649)..(652): n is a, c, g, or t
  misc_feature (657)..(657): n is a, c, g, or t
  misc_feature (662)..(662): n is a, c, g, or t
  misc_feature (664)..(664): n is a, c, g, or t
  misc_feature (666)..(666): n is a, c, g, or t
  misc_feature (670)..(671): n is a, c, g, or t
  misc_feature (674)..(674): n is a, c, g, or t
  misc_feature (680)..(680): n is a, c, g, or t
attcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattcttggccactggagtcaatttggctatgagcactggtnanggctggtaacctttaacttattgggttgatgtggaaaantgggtgatgtaccactggtttctagatttttttcatggccttttaatcctggatattaggttaatcactttggaagctatagttatgctggtaacattttagcatggtttcacaccaagttagtgtagccaatgaggaaaangttaccataatgacagcagntggtccgagaagtgacagcggtantactcagagcntttacttcttacacctagaatattacaatataacaccaggggcgaaactgtgacagtctatttccagttgcacatattgtccttatatataacggttcgacagttcaatctctcgggctggcaactaaagaacacttacgtatcagtaatggaactctnnnngattnaaacnantntgcnnaanttgctntgcccagatgctgggcatatatacgacgattgggggtgcctgtcggtcttgggaaaagtcattaagtaatctttctaaaacttcttctgtgtggatcccagtgacgttgacggccttagaccccgggacttgagtaccttcctgcccagtagcgggtgtttctgccgcaccattacggaagcgatgtctacgcctttcttttcaagttagtccagggcctaaagcaccgggttttgatcaccagcacctgtgtaagacccgcgttaagagtgtgttggcgacagcgagccccatgtgtttgtcgaaa

SEQ ID NO: 556509 - DNA, 330 bp, Homo sapiens
aggagtactcagcactgtatcagctatgctctcacggaacggggtgtgagccttgtactgtcccaggaccctatgcactccttcagggactaagagactcttgttgatttctgcgccctccatgcgggtctgccggtcagcactggaagtgtccgcgcctcgctcattccctgccagatctaccaaagagaacttgccatgcacttctccctttagctcgaagaataatttggaagcacgcgtgggagcgggaggaattggagttggcaaatgtctgcccagaggtactgcaggcgctgcccatatcgatcatcttgatgacatcaccca

SEQ ID NO: 556510 - DNA, 375 bp, Homo sapiens
  misc_feature (207)..(207): n is a, c, g, or t
  misc_feature (228)..(228): n is a, c, g, or t
  misc_feature (294)..(294): n is a, c, g, or t
  misc_feature (325)..(325): n is a, c, g, or t
gcttcaagatcggtcgcgagcagatacacaccacttttgattgggaatgctgacatttgagaagagaaactggcttctgttttcgcaaaggaaaaaaaaaataggataggcttcccttgtgcagagggagaaagggtttggttttggtttggtttttaaatgggagcccgtgaggcatcagcttattatactgtgggactctacctnctcactcactatatgctaacnttaaagccattcaacaagagagtcaagatagatctggaaattaaattactcaacagaactcctccnttttttaagctgtatttttcaaggtacggtngtggtgaccggccccacggggtgtctattacaggccacttgggtagtggt

SEQ ID NO: 556511 - DNA, 470 bp, Homo sapiens
cgagggtcttcggaacgtagcgctggctgcggcccggccggcatacccagccggccgtccggcagccggatccgcgccgactcacgacgcatctgtcatggggccagaccaccatggcgggacgctccggatgcgccatgccccgcgcatttatcacatgacaggccgcttgttccccacagccagcgcacgcccgcacaagtcacccagatctcggccaacggagcatgcagcggcagggtgacctttccacgagaccacagagacggatgacaggatccattgcgatcccagacccgggagccaggactacacctggaacgcccgacaaagactcaggcgcatgggtggcaaggtccccggcccagccagacagacagacgaggacagacacggcttgcatagtggctgcatagatggtcatgcggagtaggccagaccgatgagggacaggagagacaggatggaga

SEQ ID NO: 556512 - DNA, 133 bp, Homo sapiens
cagatgctcttacatggtcatagctcttctcgcgtgcctacttttcaggttgaattaatctttataacttctaaaagtatgtttttatcttctaattaccctatcttctctattcttttcttcgccttcccgt

SEQ ID NO: 556513 - DNA, 940 bp, Homo sapiens
tgcgtcacagaccattgcagttaacttccgtccgtgactcacccttcccgatgcagtctccctgatgccaggctcccctcctgatcgccctgggcttgcttctcggcggccctgcgcaagcccacctgaaaaagccatcccagctcagtagcttgttccgtggagataacttgtgatgaaggggaaggaccctgtcgggtgatcatgaagcctgattctggagcctgacccatcgtcgttcctggaaatgtgatcctcagtgtcgtgggcaggaccagtgtccccctgagtgctcctctgaaggtggattctaggttacggagaaggaggtggctgggctctgggatcaacgatcccatgcagacgactacattgggagatgtcacctttgagcactgcttgtgatgtgcttgacatgttaattcctactggggagccctgcccagagcccctgcgtacctatgggctttccttgccactgtcccttcaagagaaggaacctactcactgcccaaaggagcgaattcgttgtgcctgacctggagctggccagttggtctcaccaccgggagctaccgcatagagagcgtcctgagcaggagtgggaagcgtctgggctgcatcaagatcgctgctctctagagggcatataacatggcctctgcacaggatgaatggagcgagtgacggaggaccctcactctggctgtgtcgcaggcagatatccactctatgcgcccttaatcccttgacagtagtccaacctacgaaatggggccatacgttaagggggcagaccctgcaaggaatggtgcagctagagcgggcgggggacagacacggaagccgaagcgatacacgacgggacaggagccaaagagccaccatggaaacaagaaagccccaagcaggaccaacaagagggcggccccgacagccg

SEQ ID NO: 556514 - DNA, 271 bp, Homo sapiens
  misc_feature (144)..(144): n is a, c, g, or t
tcaaaacagactctgacttcatcaccaagatggactaccccaagcagactcaggtctaggtccttcctgaagggcggtgagaccccactcttcaagcagttcttcaagaactggcgggacccagaccagacagatgggctgggnttttcctaccttttccagccatatcgtcaacgtggagcgggtgccctccgacggtcgcaccctagcacaccttcactgccatggccgcccagcacggccatgggatgatcggtggcacaggccagat

SEQ ID NO: 556515 - DNA, 389 bp, Homo sapiens
ctcacgcctcagcatcatattcagtcctgacatcttctgttcctgaggtactaaagaacatgcactcaagggtgttccttaccttaagcactcgaccactgaaacggggacttcagagacatgaagtgtgacataccaaccaacctcagctccttcaacctctttttcttcaacctctttacagatgcttcacctagtgttagtacagttctagaaactgaaatatacgagcataatcttgaggaacgttttccttaggatcccatgaagatgtccggaagctcttaaggcctctgtatttctgaaatcgaattcgagcagccacatcacggggcgtgtccacttcatctggaaacatctcttccagtctttcttgtctatatttctcc

SEQ ID NO: 556516 - DNA, 1421 bp, Homo sapiens
ggttgcccgaccgctttccggtgagactggagtcgaaggccgtgcagtcagccataatggccaggtgaacgaaattaatgaacgactatccagtagaacattcacgagctattcgtcagcgtttgagaattccattggccgctgtggcatgacgactgctgacagaccatgcatgtctgtaacctagcaacatgagtctgttgacagaagcttggactccacattgaacaagtcaaacacgctgcgcactccgcgcttctctgcatacaccattaacacttcaactgctccaagggctctcacttctggtcaacccaaagggcagctctcaattccttacacggcaaccatacccagctaccaccaccaggcacacttgggcccacagcacctacagaagtacttattactgcacacaagcagctccaaggcacacatacaccacgaccaaagacaaacacggcctggcaaagccctcgcgcaccaacgcacgggttgccacggcatctacaacaggcatactcggtacacgccacctcttgccgccttcctaggcagcaacacccaacacacctccggacacacaacatggccctttcacacaccgcttggcccccaatacacacgcgcaaaacaacggtcaacaacggtcaacaaccctatacacagggccactccacggacatggttaacacacgaaattaatttccccaaccaccagggtacaaacatcaatatccacacacacacagaaccagcagcagcacaccagtacacgcaccaccccgcaccccaccacacatccgccgcaccgcacccgccgcatcgacgccacataacaagcaagcaccggacgccccacccccacctccgccccacaccaccacaattacatacaaataccacaataaatgaacatattacaacaccgctatataatacaagacaaatcactcatactatagatgaccaaataattgacaaaacaacaaaatgaactatactacgatcataaacacgcagatataaatacaaatagaaaacaaccacaccacttcgaaccacgaatataacaacaacgtgacatcagcaaacaaataatacaataatagatgagaagaaagcacgcgagacgacaagaagacacagagaggggacgaacgatgccaggcagaacgacggccgaacaaacagaaaacgcacagccagcagccgacaggacggcaacgccacgcgcagatatggagcaagccagcgagaggggagaactcaaccaaaagagcaccaatcggagtcagattaggatcacacaatacagctcgagtcagagcatcacggaagggagaacgagaccgaaggagagcagacgaacgcacacgccaacactgacaggacggacggtgactgcagcacgcacgacc

SEQ ID NO: 556517 - DNA, 917 bp, Homo sapiens
ttacaccctgcgtgcggaatccctgacagcaccgccgtgatgcccaggaagacagcgcgaactggaaagtccaactacttccttaagatcatccaactatggatgattatccgatatgttatcattggtgggagcagacaatgtgggctccaagcagatgcagtagatccgcatgtcccttcgcgggaaggctgtggtgctgatgggcgaagaacaccatgatgcgcaaggccgatccgagggctagctggaaaacaatccagctctgtagaaacgtggctgcctctatatcctgggggaatgtgggctttgtgttccaccaaggaggaccttcgactgagatctagggacatgttgcttggccaataaggtggcctagctgctgcccgtgctggtgccgattgccccatgtgaagtcacctgtgccagcccagaacactggtctcgggcccagagaagacctccgtttttccaggctttaggtatcaccgagctaagaatctccaggggcaccattgaaatcctgagtgatgtgcagctgatcaagactggagacaaagtgggagccagggaagccacgctgttgaacatgctcaagatctcccccttctccttgggctggtcatccagcgggtgttcgacaaatgtgctgcatcttactaccctgaacgtgcttgatatcacaggaggaagactctgattctcgcttccgtggaggggtgtcacgcaactgttgccagtgtctgtcttgcagaattgggtacccaactgttggattggtaccccattccatcatcaagggtacaaacgaagtctgggcttgttggggggaaacgattaaccctttcccacttggtgaaaagccaggctcctgggggagacacaatgcttggggggtgcccttgggttgcccaaag

SEQ ID NO: 556518 - DNA, 272 bp, Homo sapiens
ggtgcagcagctcaggcccaggttctagtctgggcccagcgtactgtgttccaccggtgtgagaggtagagttggaccctcatttgttgaggcaaattccagttaggcttggaatttggggatgtgtaataagggctccttcggctcccggcaaccactggcatcattagtttgctctacgtgtctgtgagcgcagtcgcatcgaggttcattttagcatttgtcttctgatgtgcgctaagatattggacagaaaaatctagcagctaacc

SEQ ID NO: 556519 - DNA, 300 bp, Homo sapiens
ccccgtctccccagacacttatttaactggcctaatacgaaatttgtacctgtttactgacatttccccattttgccacctccccgagtctctgtcaactatcattctattttctgtttctatgagtttgacttttaaaattttcacaagcaagtgagattatgcagtatttgtctttctatgccctgcccagccactccagctccagctgtgacaaaaaggggccaatgtacagctaaggctgttgcttcagaagatgcaggtcccaagccttggcagcttccacatggtgttgttgta

SEQ ID NO: 556520 - DNA, 745 bp, Homo sapiens
gacatggaaaatgtttagaaaaataaagatcctcccctgccctgaggccactgaagtcaggtttgggtgtgttggtacagtgcgggaaggattgttcgggctgagaaatttattttctcgaaaaaaagccgtccctcgaaaaacttgaatttctttgaacaaccctggaaaacaatttgggaaaccaagcttgggggaaccccttttcccaagggggcgttctcaacaaggccccttcttacagtttgtttgtctaaaaagtgaaaggaccgcccaaaaaccaaaagcgcaccaaaaaccaaaattggcgccccttccccaagggggggttattgggattatccccttaaggggtaacccgaattttaacgttggtcccccgatttgatttgcctactatggggcggttttagtagcgggaggaccccccccatagttttgggggaggttataccaagcgccccaaaagtgcgcctggggaggacccaccaaaaaatgggacgtgccccgatatagcatcataggggcgggcacacgctcaatagagaagtctccgtaataaaaaacatgccggggagaatttttctctaggggggcggcccccaaaaatagcgatgcagatgggggcgtacctaataataataataccttgtggcgggaaaaccattttttcttcccccgatttttttggggggggcgaaaaacacgagttttttttctctttgtgggggcacaccacataatg

SEQ ID NO: 556521 - DNA, 104 bp, Homo sapiens
gtagtaaatggctgttacctaaatggctggtccctaaatggcaactcgtgatcgccatatccagcagccatttaggtagcagcatttaggtacagccatttagg

SEQ ID NO: 556522 - DNA, 217 bp, Homo sapiens
tgtgtcccattacaactttacttacaaacgcagactgtgtcagacctggtccatgcatggtagtttgccacaccctgttttagaaagctcaggtttatgatgtgatggagaatgcctacaagagctcttgttttaaatggtagagtgaatatacactggaattctatcctgcttgacccaagctcttgatagcgaaaggtagaaaagatagatagta

SEQ ID NO: 556523 - DNA, 961 bp, Homo sapiens
  misc_feature (344)..(344): n is a, c, g, or t
actattcgagaaggatggcaggagtcctgcactccatgttccaccatgactaagttaagtgataggtatcactcactgatacttgaagtgcgactctgggctcggggtaagtgcacagatcgctccacaaataccagtgctgatgtgtatgagccctacccgatactgttacttgggaacaagtccccatattggttctataggacactcgttacaggtaggatttcgcccagattgcagccgatgtttctgtggtggattgcgttcgaatcagtcgaggagatagctagtgaatgccccgcccatagctagccatggtacggtggtgttgttcgggctagttntcagcactaccgttccccctagtaaacagcaagactgcataacctgtagtaacagatatatgtttcaaatccactaagtccgtgtgagacgagtgcatgtcatagccgtagatagtaagctctgctgatccaagtccacacgtgcggcgagcacgttcgctggtgtggcgtgggaatcctctgatggtcaacgttaacagcgcttttgtgtcactcgtgcgtggttcaaaggctcacatgtcctcctgggctggcatcaacgtgccacaacatcatcctagcgagcacgtaaacaattctgtgatgccacgcttatggtctcgcctctaaaagcttggtggttgaaccccagtagtgattaccgggaattatgtgggctttttatttgaaccccagggcatgaggttggtcgaagtcatgcatggacggggtcacctgcaattccctcgttccaattctttcctcctcttcaaagaaaggcagagggtctacggaatagaatccccttggcgtgctgaacgcttaccaaaggagtcgttgtgttataactagtgcgttcacattgtttggtttgggcgaaccatccagcccttttgtaacatgctatgatcattacg

SEQ ID NO: 556524 - DNA, 128 bp, Homo sapiens
tagtaccccgctgccaatgcaatggcagggtgtatgttgtacgcatagtttgtacattttggcccaggacacacaaaggcgattggctgctgaaaggggagagcgtcaagttccacattgtgtgtcct

SEQ ID NO: 556525 - DNA, 452 bp, Homo sapiens
cagcggacccttgcttggtcaggcaataaggaagagaaagaaataatgatatcaaatcaggaagagaggaagtcagatgtctctgtttgcagatgacactgatcatatatttagaaaatccatcatctcagcccaaaatctccttaagctgataagcaacttcagcaaagtctcaggatacaaaatcaatgtgcgaaaatcacaagcattcctatacaccaataatagagaagcaaatcacgagtgaactgccattcacaattgctacaacaagaataaaatacctaggaatccaacttacaagggatctgaaagacctcttcaaggagaactagaaaccattgctcaggaaatgagaggacacaaataatatgaaaaaacattccatggtcatggataggaagaatcagtatggtgaaaacggtcataatgaccagagcttgtgtaccgag

SEQ ID NO: 556526 - DNA, 912 bp, Homo sapiens
cttcgtaaagcctgtgggcctaacgcggggggctagacaaggtcgggtggtctccttggcagccctggtggatgtttggcgccttgggttcagagagggtgctgctacaacatgagggggttttctggattccaaagggcgcaatttcctgagctggagttgtgcccccccggggtattttgctgcgcgctgtgaggagcccaaacacgtgtttgtggtgccgccgctttctgcgtgtggtcaaccccgccaagttttcggacagcggggttttatccaagtctgggcacccaacttcgggggaggcctccaaacagggcagccaaaacgacgccagagttttcttctcgcgaaaacatcaaacgctctccgttagcatggcaccgctgggccccctgggaacccagcgacccccggaaaaggggcgccccaacggggggcaacttcatccctgatatcgggcgatgtccccccgatcgccaaaaaaaggggaaccttcgtcgtgtcacaccagacctcgccccagcaccctccttgtttgggacgctgataggataggcatggaacacatgtgtgttggtactccccgccgcgtgatcaacacagggggcacacgcaagtcgagtccggcccccacgagcagcacaatgagctgggccatccagtgcgaccacgcacccgggaccctttgggggaagcacccacacggggggcgaacgccactggtggggaacaacccccaagacgcccggaggaccccacagatgaggccacaaagagggagaaacacccctgttgaggcgttctctgaaaagaccgagggaagttacaggacggaaaaatggtgcatgtctcggaacaaaaccccccatcattggcaacccaagcaccgaaaatttgcccaaaaaaaca

SEQ ID NO: 556527 - DNA, 188 bp, Homo sapiens
agttcctggtgtcgcttatctcctgatgggatgaagaggagcttcatgacaaaagtcagtgtttcagactggtcacgggaggtgaaagaacgaggctgatggtttcaggactattgtttaactgcaagacagaggacccccgccagagggcaaaatacaaagcaagtgcctggtgaggggaacgaagc

SEQ ID NO: 556528 - DNA, 375 bp, Homo sapiens
actctagacggatccccttgcactgttcggatggggacagtgctctcatggccacagcagtcactcgggactgcgctgccacccagtgctggcttctgctctgtggtccacgttccatttcttgccgtggtcccagcagcgtcgctgtgggtctggcctgggttgcgtgtgtttcgtatgtgggccgtgctccctgcttggttcccttttcctggaacgtgtcactgcctccctgtctcgctccgtggacatttctgggaggtcaggccgtggccacctggccccctgttcaggtctgaggctctcacctgcttaggttcgggaagctcaggagagaggccatgccctcctcaggacatcccatccgaagcagtg

SEQ ID NO: 556529 - DNA, 927 bp, Homo sapiens
tcccagaaacactgctccttattatgtgtcgcccatccgcaatgtgccatccccggaatctcaacctgggaagaagaaataaacactttccacaaagaaacttgcttcccgcgatgtagcccgaacccctgtctcttattggcaagaaaacatctaacaaaacacttttaatgcggcccttataagcttctaaggccgaaccacactgggcccaccacttgtaattaaacccctctggaccctccgtatacgtgtaattatcaccaccccctcctatgccaagataaagaatttctgaggcgttaatatattatcgatcgccacggtaatagtggggttataacaataagccaagaccagttcttaaatttttgttccctcaatttcccacaggaacaatttctcttggcgtccaaaacataaccatccacctacccgtccccgccacgcaattgtttaattgcccccgcacggaatttctcccccgcaattttcaataagagtgtgtaaccaaaaccaatattcctccagacagcagcgcccaccttcaagatattttgctcccaccgcaagtcggttgtggttcaaaagaactccccatccttgattaccccctgcgctccgaagaactttttttccacgccccctccttgcgcgccctccgtgaatcctcgccaaaaagagtaacattctttctcctcccccaatattatttcttgatattcatacatagcaatattattcccccaaaagtttttttagcacaattagctctatcacatgccatctctcataaatgtgtgtagggatgttatgtgtgttttataaaaccacctgagaacccaaattttctgtaatttttaacacatataaagtgtcgtttttaaaacctggaaaaaaccatttgaaacctcggcccacataaca

SEQ ID NO: 556530 - DNA, 354 bp, Homo sapiens
cggccagccccccggcaaggccaaaattcccgcgcctgttagcagcgtttgctcccaaaccaacggcgccttgggccccacgcccaggaccgccccgcccgccccggagcccgcggcgctcagggcccaccccgtggtccagctggaatgcaagccctgggggcccggccacgaacctgtgggaccctaaccaggcgcccccccctttaagggtcctttggccccacggacagcaggacccggaccccctgtgggacctggcctcaaactccccaaatcgctcatggtttttaaaactctaatggggagggtgtcggggaccccggggcaaaacaaaaaagtcctatttttcca

SEQ ID NO: 556531 - DNA, 898 bp, Homo sapiens
  misc_feature (406)..(406): n is a, c, g, or t
aattcatataatatgaacatgatctcctactagaagtaacgtcagcaaggttttcatggcacatgatgatgtaaatgtctctcaatgttttagaatagatgaagttctaatagagagatctctcgtgaaagtattcgctgaaaaaatgtctagtaggtaatatgggttagatcagtgttttagaaataaagtggtagatattgtaaacaagagctatttgtaaatttgacagcaagggtttatactagaagcagatattgatatgaccatgagctgtagggcgtaacgttgactgtggtatttaatttagcgatacactatacccatctgtgtttgtgttgagtaaggagatgtgtgaccgacatgtattttcaatgttgtcgattaaaactttgtaggttttatnctttgttaaaaaaatagaagaagtatatcgtggtttttaatcagcacgacgcttgtgtaactaggattgtgtccattctgtaggaaaggggtgtatatcgtggttttagtgggtggaattaaatatagtagttgaatatgccgcctgtatttttaaggcccaaagatgtaaggttgagattcaagagaaagaaatatatatctttagtatgttgtgcgattgtgccttattttacatttttggaacgtgtcggaatacataggtgactagtgggagagattatttaggacatgaagttgtattgagaggggaacttttgtgcacaatccacatagatagacaagaagtagtagattaagagcggttgctagttgaattgaaccatgaatgtttggttgaacatatgttgaggtttaggctaactttaattttagttgccaggtataaattggagttaatttcggaacctgtttgaataaaagaaatggttgc

SEQ ID NO: 556532 - DNA, 203 bp, Homo sapiens
gtaatgcattcttccatgatcgacagaggttgatcttaagccttgaatttctcgagtgtgtgtcactgggcgtccaccatcgagtgtgtatggtcttaccagtcaggtcttcacgaagatctgcatcccacctctgagacggagcaccaggtgcggtgtagactctttctggatgttgtagtcagacaggtgcagcgtataat

SEQ ID NO: 556533 - DNA, 124 bp, Homo sapiens
ggatctcatatgttctcgatccgttagaacgtctgagattataaagactgataatggtagatggtggggaagatgtggtgcaactggaatgcttatccatagctggaggtaaacaagctgactt

SEQ ID NO: 556534 - DNA, 401 bp, Homo sapiens
  misc_feature (388)..(388): n is a, c, g, or t
cctcgattgctgtgccgttggtcctgttgcggctcacttagccaagatgcctgaggaaacgcagtacccaagacctaacgcgtctggaggagcgaggaggttgagacgttcgccttacagggcggaaattgcccagcttgatgtcattgactcatcaattactgtctatctccaacatagagatctttcctgagagtagctctatttcaacattcatcagtatgcattggacaaacatccggctatgaaaggcttgacatgatcccattttaattacgactctgggaaaagagctgtcatattcactcctgtatacccgaactaaacaattatcgacactcgtctactattgctcggatactgcgatattggaattgacctatacgcntgatccttgatca

SEQ ID NO: 556535 - DNA, 900 bp, Homo sapiens
tctgtgaagtcaagaatcacttgccggccgggtgtggtggctcacgcctgtaattctagcacttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaagggaaaaataaaaaagaatcacttgccgatttaatttggtcctcccaaaaccaagagttatacctggatgtacccagtgggaggaacttgagctgctggggtaaataacccagaagaaaggtgatgagagtaggcctgtgagataatttaggaagatctgatggcacacgtgttggcaagaaaatccgggtgtccctagagaatggttcccacaagaacactgatttgggttcaattcgggatcaaggcagcagatgattatcaaagccttacatggggctcggtagcatcaaagcctggagcacggcaggcagatttttggacctagaagattcggggccaaagaatccagtaagcattgtaggaacaactggttggcgcctgctattccagttcaggtagaacccactcgaaacgtggatttccgggaggggttgtacacactacccctgagatgcccaatgtcacgcgcgacggtaaacatcggcaccgttgggtgatcagggcgcgcaaaggttaaggccctcaggttggaacaacaggcgcagcggaggagaaagcgtccggggaataaggggtatg

SEQ ID NO: 556536 - DNA, 405 bp, Homo sapiens
tgatcgagtacgaattttcttaaggaatctatactaacagatcagctaccacttatcattgtgttgtgatcgatttgactttgttccatgatttggtgctctctttatctgaaataatcttcaaaagtatatcgagatatatgtacagaaggtgaatccaagtcgacttcctgtagttcttggaggattacttgatgtttactgttctgaagatgtcataaaaaacttgattcttgttgtaagaggtcaattctctactgatcatcttgttgctgaggttgaaaaaagaaacagattgaaactgcttctgccttggctagaggccagaattcatgagggctgtgaggagcctgctactcacaatgccttagccaaaatctacatagacagtaataacaacccgga

SEQ ID NO: 556537 - DNA, 263 bp, Homo sapiens
  misc_feature (22)..(23): n is a, c, g, or t
  misc_feature (46)..(46): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (64)..(64): n is a, c, g, or t
  misc_feature (77)..(77): n is a, c, g, or t
  misc_feature (80)..(80): n is a, c, g, or t
  misc_feature (113)..(113): n is a, c, g, or t
  misc_feature (143)..(143): n is a, c, g, or t
  misc_feature (145)..(145): n is a, c, g, or t
  misc_feature (149)..(149): n is a, c, g, or t
  misc_feature (155)..(155): n is a, c, g, or t
  misc_feature (157)..(157): n is a, c, g, or t
  misc_feature (178)..(178): n is a, c, g, or t
  misc_feature (180)..(180): n is a, c, g, or t
  misc_feature (205)..(205): n is a, c, g, or t
  misc_feature (241)..(241): n is a, c, g, or t
  misc_feature (245)..(245): n is a, c, g, or t
  misc_feature (258)..(258): n is a, c, g, or t
  misc_feature (260)..(260): n is a, c, g, or t
ttagagaatagactttgtttcnnaaaggctataaatcacatagtanatttagcntngancgtgnatatgataggcgnatnattaaaatgatttaaaataaactcatcccttcnattatttctttccaagtaccattgcacccncnttcntctagncnaagagaggaagttatctaccncngttacattctgatatttctcctccntctagaacacttctccgggagaggagagtatggccnaacngttggtggtgtancntaa

SEQ ID NO: 556538 - DNA, 915 bp, Homo sapiens
  misc_feature (915)..(915): n is a, c, g, or t
tcgggttaaaaaataccttaaaatttaggtaaataaagtctcagggagggggggcggccatcggggtgggtcagccctttgggccccccgggcctgtcagtgttcgccccgagggcctttgaaaagcagctcattcaaggcggcccaccagggccctagggtcgtcaacaagtccagcagcaatcagggggtcctcgtatatctgatccaccagcagttgagccaggccaggctcgctggcgcgcagtgatacagcttctggatgagcgcgtgccgggggtggatctccaggcgtgggctgcaggagcggtgcgcgctcctccggggtctgggccagctgctgcatgcgcaggaagtggggggcgagcccccatctccgagcggggtgcaccagggcggggttgggtgtccagtcgggagggtcaccttcacgtgggtgcacacgcgaccccgagcaaaatttctcatccgaggccatgagctcctccgctctccttctctgataggcactcgggggtggggggacctgtcctcaaatttctcctccttgttggtgatccacgattatgtccgtctccaagagatcagttcttcgggtcaaactcacgagggtgcggcagggtgaggctaagatggccgaagggaagagaggcagggaaagagggtgctccgggccccgttgtcgtgaaagcacgggggggtaacaaggggtggatcccccgtctgaaagggctaaattgggtgtgggcggatcccggcaagaacccaccgtgtgggagtggcccgaataaggtgggggagaacccccaaaggggggaggcgctggaaccatcccgctggcgcaattcactggattggccctgcaagaaaaaaaatggcgcgaagggggcgcaacatcctgaactgaaaagggtn

SEQ ID NO: 556539 - DNA, 356 bp, Homo sapiens
tgtgtgatgatctagccctccggttagtggttgagggtaggcttatccggcacgctatcgtttccaccgtggatactgcgcttgagaaggccacgacctcctccttggtggaggtccttaggatctcagcttggagtcgagtgggtggcgaccttttaaaggaatgggacccacccggagttcttctttctcctgtctctctctctctctctctctctctctctctctctctctctctctctctctctctctctctctctctccctctctctgtctctctctctctttctctctctctctctctctctctctctctctcccctctctctctctctctctctctccccccccccaca

SEQ ID NO: 556540 - DNA, 102 bp, Homo sapiens
tgtagatcatcgcctctggagtatggcagaggtacgggaagtgtcctgatcccgtgctacactacttcactcctccatccatccttccctcccttttcctct

SEQ ID NO: 556541 - DNA, 805 bp, Homo sapiens
ggacatgcaaaatgagaagaaatacagaaggaagtgaccgtggcattggtaactggaggctttgaaggtgtccaggactgtgtgtgaagcccagcactgccactagctagctgtgcagtattggacaagtcatttagccttgctgagatccttttagtacttgaagggcctccacaaagtggagactccacaaatggctactatgttcattaagtgcctgctaaatcttcttggcttaattctgtagcattcaccagccctgctgcccaccccttccagagctggggaatggatattgatctgaaagaggcctgaaaaaaaaaaaaaaaaaaaaaaaaaaaaaaaaaaaaaaaaaaaaaaaaaaaaaaaaaaaaaaaaaaaaaaaaggggggggggggaaagcaatactctcacgagggagggccacaacgtgataacacagcccgccagacgatcgttgcagaaacagggggcggctacctacaagagtggaggattgataatatacacaaacgacggcggagcgcgcgggacgcgccataaaaaaccaccgggccgacaacgaggagcaaacaacacggcctatcggacgagagctctcttgacgaaagaaaccacacaaaatcggtgggggcaggcaaccacaggaggaccacacacaccatcccacgagacacatcacaagcccccagagcacaatataaccaacacaggaggttatcgctgtcccccaccacgagcataaggatagcgcgtcagaaacgtgctcgcgagatcgaattaccaaaaacctattgcacgggcc

SEQ ID NO: 556542 - DNA, 261 bp, Homo sapiens
  misc_feature (73)..(73): n is a, c, g, or t
ttgttctagaggatccgaacgaaaagcagtaagtcacactctttctcggcaggtcgattggggcccttatatngtgctgtgtagaggccaagaagggctggagttgggacttcagcctaagtgcccatggtgattgcacaaagttcttaggaagcagaatgtcatgcctgtaatcgcagcactttgggaggatgaggcgtgtggatcatgaggtcaggagttcgagaccagcctgaccaacatggtgaaaccccatctcta

SEQ ID NO: 556543 - DNA, 106 bp, Homo sapiens
ctcagcaccggtccgttccagactttccggccaactgatcggttgccgcaatttacgttgcagttcgtcgagccgcttgacggcccgacggtaggcgccgggcacc

SEQ ID NO: 556544 - DNA, 1122 bp, Homo sapiens
tttccctcccggggagtgggggccctgagaccgccccggaggacctggaatcctagacctgaatgcggcggtctttgagaagatgatcatctcagagctggatgcacaacaaactgcgggaggagacatgaagtcagcggactaagggcaccatcctacacgtcgcatgatgcctcccactgtgccatccgtgttgccatgtgtgtgtgctggggtgactgagagacagcaggcgtggtctgggcctcaggtgtagtgctttgaccatgggtccgagatttgacactttcgtctagtagatgggcgcacttgagaaggagctcgtcatgtcgtgcatgttcacctggggccccaagtactggatgcatgtacacagaagcagagtcttggactgagcgtcgcgagaagcatgacactggacgatagggagacagtggggccatctcaagagcaggagggccctatcgtacgcataccacgtatacacattgtgaaccggtgcggaagctcacacttcttaattgccccagggcccgtggtgtgcaaaaccacattagcatggggtgacactacgatcgctaataccacttacacccgaggataaattgacagaggcgcttgacgcggggtttcgcccccaggtttgtaaggggccccctgtgttttcaacaaccagtagcacctggctggcgagtacgcccccctcacaagccgcccggatagatccaaaccacgaggatacgggcaataaaactccaacgaatttaggttagacaccttattaaaaacgtaagcggagcggaacccatggctaagttgcaacattggaggcttcaccaaagagcaaggagagcttcacacggcatagatccgttcatagtcaacactttcatcaacaaaccaacggatcgaccaccattttggaaccccattggacgacggctgataaccgagaagagagtcgggcaatgtgacagcaaggcgcaccgacaccgcagcgaacgaaccccctataattcaatgccactattacacttaatcatgcacgttcggcaacacaagttacgctcaacgcaaagcccccaccaagagcggccacagagacaatgccccaaacacctg

SEQ ID NO: 556545 - DNA, 478 bp, Homo sapiens
  misc_feature (34)..(34): n is a, c, g, or t
ttccctccccccccccgaggggttttcccccaanaatatagggggggcgggggttatgggtttttttttctttttccaaaaagagggcccccccccccccgttttttttaaaaaaaaccccccaaaaagaaaggggggcgcggggggtttttttcccggggccccccccccccttttttaaggggtttttcccccccaaaggggggaccccttgggggggggggggccccccttggggttttttccccccccggggggggggggcggggggggataatttttctccccgttttatttttttttcccggttttttttcccccccgtttttgggaaacccccccccccctttttttttgggttttggggaaaatttttttttttgggggaaattttttggggggggggggggggggggggggtttttttttttttttttttcttttgggcccggcccccttttttggcccccccttttta

SEQ ID NO: 556546 - DNA, 448 bp, Homo sapiens
gacccccagcacgcatagatattaccggcatactaaatcggaaaagaagaagtcaatttttctctgttttcagagaacatgctcttatatgtacagcaacctaaaaactccatcaaaaaattctgagatgaggccgggtgtggtggctcacgcctgtaatcccagcactttgggaggccgaggtgggcggatcacctgaggtcaggagttcaagaccaacatggacaacatggggaatccttgtctctactaaataatacacaaattagtcgggcatggtggtgggcatctgtaatcccagctactttgtgaggctgaggcagggagaattgctttaaccccagaggtggaggttaaagtgagccaagattgtgccacagcactccagcctaggagacagagtgagcctctgtctcaaaaaataatatttaaaaaaaaaatttttagg

SEQ ID NO: 556547 - DNA, 244 bp, Homo sapiens
  misc_feature (54)..(54): n is a, c, g, or t
aggctctgctcctagtggcaggtcccccctctcaggagggggtatgggtaggcncatccaagaaagggcagaagacaagggcagtcggggtctagaaaggcgggcgctggcccttctgagcgcttcggagcccccactgtatcccactcagctttgtgctcagatcccaggtcccaaggagtgacaggggcttcctcccaccttctgtccttgtccaggtcatgtcccactggtgcggccggga

SEQ ID NO: 556548 - DNA, 432 bp, Homo sapiens
tgtacagcatacaaaaagtgtcgacatgggtgtcagccctgatgatacaaaatgtaaagacacgacacatatagtctattaaaacatcacatatatacgtatagatcaatgaaacacaaaatgtaacttggtgccacaaacacacattagagctccctaatgaccaaagacaaggcagaagtgattgagtctaagatgaatatggacgtggtggaaggcagagaccccaataatgatgcatactacccccagaacataagaagcttgggatctatctatatacccctctacagtcagaagtagatagactctgtacattgagataaggaacaacataacagatgctatatcacgtattcctgacataagataaaaaagaagactataggaacttccaaaacgcccttccaagggtagagacatgtatttagc

SEQ ID NO: 556549 - DNA, 613 bp, Homo sapiens
  misc_feature (560)..(560): n is a, c, g, or t
tgtgatggttcgcggctgtagttccagcactttgggagcctgaggtgggaggatcgcttgagcccaggagttcaagaccagcctgggcaacatggcgaaaccttgtctctactaaaaataaaaataaaaaaaaaatcagtcgggcgtggcggctcacacctgtaatctcagcactttgggagggtgaggccagtggatcacctgaggtcaggagttcaagaccagcctggccaacatgactaaaccctgtctctactaaaaatacaaaaattagccaggcatggtggctcatgcctgtaatcccagctactaggggggctgaggcaggaagatcgcttgaacctgggaggcggaggttgtagtgagctgagatcgcaccactgcactccagcctgggcaacagagcgagactccctctcaaaaaaaaaatcagccaggtgtggtggcacacaccagtagtcccagctacacaagaggcttaagagggaggatcatctgagccagggagatggagattttgtcagaggcgttagaatcagaacaacttcatcttgactgangggtaggcctttaaatgtttatggttaaaggaacgatgatcatgtttactgag

SEQ ID NO: 556550 - DNA, 258 bp, Homo sapiens
tgcgtcagcatcccgagtagctgagactacaggcacccgtaccacgcctgggtaaatattttgtattatgagctagagatagggatttcaccatgttggccagagatggtctcgatctccttaccttgtggcgctgcatctcgtttacccaaagtgctgggattacaggtgtgaacccttgcatctggcctggagccacgtaaactttttattgtctccatggttatggccttttccggaaagtcccgttgaagccgt

SEQ ID NO: 556551 - DNA, 1190 bp, Homo sapiens
gcattccacccacggagcccgacatcagcccgcggccaaccgtgctgccccagcccctgtctggcctgcgccctgaggcccagctgccagcgaggcccgttccccgggaggacattggactccatggcccctgggaaagctgccgaggcgatacactataagacgcgcggacgttgggctcccgatcttcacgcgggaaccatgaaggctgcgacagacactcatcttgtgccctcggggcccactgcagcagggggagaatacccacgtgaagccgggaaccccaccggaaggccaatttacaccacgcacaggtacttgggacacgcggagatcccagaaggtcaccgggccaaaggggaatgtgaacaccaatgcccaccgtgtaggtgcccgggtcaccaacaaagacccggggagcaagaatctccgaaaccctggctgtacgaagcccaccatggaaacactgcgcgtacggcaacaacacctgtgtacagtacacaggccccgcggcgatcgaccggcaagtggaccaaacaaccggagtgcaggtgccacgcgggcaagcgcgtcagaaaagcgcaacacttcagcacgacaggaacccagccgcgcaacactagtacacagaggagaccgtcctgtgacacagcgacctcgacaaccacaccaccaacaggagaaaagagtacaacacaacagatcaagaacgaacccgcagtggaagagacaaaagcgaacacattgcagtcacctgtgggcacacaaactcgcgggtcagcaccccacagtgaacaacacgaaataaggcaccccggccagtcccactatcgaaccactgtcgcaagcgccacccacctgagcccagagcggaccaccaacaccatacctgtacgaagactgcgcaacccagatcccccgcaccacacccggcggaagcagcacaagctgacaacgcgctcgacagcgccacactccccacactgtcaccaagaatgcactccccacaaatcgtagcgaaaccaaccctccgtctaactgtagcagagctcaccacagactcaagcaccggcgacaacaactccgaacgggcgccagctccacatcagcactacgagccacaccacacggctgtgaagaacagacaccacacttcgttcatcaggcacaacacgccgccaacacgtccg

SEQ ID NO: 556552 - DNA, 299 bp, Homo sapiens
gctcgacaaaaatttcaatagcttttgggtacactgtggtttttggttacatggatgaattctatagtggtgaattctgagattttaatgcacccataacctgagtagtgtgtcgtagccaatatgtaggtttttattagttccagagtatatgtgtaggatgtgcattttgttacataggcaaacgtgtaccatggtggtttgctgtacctgtcaacccatcacctaggtattaagcccagcacgcattagctcttttccctaatgttctccccctggcccagcctcccccgtcgacg

SEQ ID NO: 556553 - DNA, 1191 bp, Homo sapiens
  misc_feature (1180)..(1180): n is a, c, g, or t
tgagaggcctaaggtatgggcctggggacgacaacctttttgaacgcccgaaacacagggtgagcaatgatctaacggatggcggtcaacccacggcccgaatacaacggggaacgcgtggaaatctcaagagaaggggacgaactctgcacgggggacaaaaccacgagatatctcacgtcccaaccgagccgacaaagaggccgccaacccaggttcccccggggcagggatttacggagagcccctaccaccgtggagtaacaccaggcgtggtaccctctccataaccagggcaggcttacgggaccaagagtctgcggcaggtggcttcaagcgtcgctgggccatgctccggcagcccgtcacccggatgcacctcaatgttccgtcatgggctgtcagatggaaaagggacgtacttaaccctggctcgcactgaatcacttggtgatgcaaaacgcgtccctgcaccacgcaacctgtttggctcccacatcgcgcaaaagtcattccacgaggcgattctgggatcatggaaggatcagatgaccacagtcaattccaacacggccacccagaagacagtcggacgggaccatcaacggaaggcccggcagagatggacggggtgcccaccagaacagtgcatcccagcctccactggggcatgcagaaagctcgtgaccaaagtcatcccagagctcaaagggaagctagactagggatcggcagttcctgggtacctaaccctctggatgtgtctgtcgtggaccatgacctagccgcatcgcccgagcctgccctccttagcttcacgccatacaaggaggctgtaaaagcagcagccaaggggacccatggactggcatccttgcgctacacacgaggactgaggtacgtctcgtactggacttgccgtacggtgatacacgacatacgtccatcattgcgatgtctaaggccggcatgtgcgctcaatgacaatcttagtgaagactcatgtgtcatggtacgacaagcgaatatcggtctatcagtcagcagggatggtcgacctcgctgccgctacatgtatcagccgaaacaagtgaaacgggaaggtcctttctttccttcctaggggaccggggcaggaaaagtgcctcccgttccagcatctggctgctacgggcggagngacacccaggg

SEQ ID NO: 556554 - DNA, 166 bp, Homo sapiens
cgcccttctacgctgtaactcccctcctgtctctgccccaaggtctactccctcctcaccccatcgctggaggcgcaggggatgtggagagcgctcctgatgtcttagtttccacagtaaggtttgcctgtgtacagacgtccgtccaataaattattggcatgaa

SEQ ID NO: 556555 - DNA, 450 bp, Homo sapiens
  misc_feature (171)..(171): n is a, c, g, or t
  misc_feature (179)..(179): n is a, c, g, or t
cttggatctatcaaatggtgcagtgactcggataccttccctagtggccataaagctccagacgaatctcagtgcaggacgccatcctcgcaatattcaagagtcacccttctaaggaggacccctagactgctcgctagtggaacacgacagaggcgaaatcctgccccngtctcccngtggacctggctggatatggtttttgccaatccacagagccatcctgccctgacagctagcaagaggccaagacccacacgaacaaccactacagcccctctgtcagcaggaagcagttaaagaagactgaccttcgtccattttcccaagataattggggtcttggactcttgagggggggaaatgttggagcaggtagctagtcagacatgagcagggcaggggagggcccccttcaccaggaatgtcagggcaccatcaggtgatggt

SEQ ID NO: 556556 - DNA, 342 bp, Homo sapiens
ttcctagatatgataaatataacatttatgaaaagcccccccccaaccttatacttcatggtgatagactgaaggctgaatgttttccccttaagattgggaagaagggcaaggatgttccctcgggccctacttttattcagcattggacttgaagttctagccccagcagttaggttaggaattcaaggtttgttcaacatttaaaaatcaaataagctaataaaaaaaagaggttttttctgcaaaaaaagtgaaactatatgtattccccgttgatacatagttggatatagaaaatgctaaagaatccctaaaaagtaataaatgggttccccagga

SEQ ID NO: 556557 - DNA, 324 bp, Homo sapiens
aagaatctttcctttttttggtggtttccaacccccaacttaaattttcaagtgggggtcaagatcaagttcaaaacgttaacacccttggccccaaaaaacccatcaggttttccttggcacacccgggctccaaattcacttccaaattcctttggcttcccattgcggtgtttcccttatttaatacttggcctcctcttttcctgaagggtgggggctgaaaagggccaatggttcaaacctgggcagaccttattataattgtccccaccagccttatacatttaaaaaacctgaggtccaaaaattttgcccaaggat

SEQ ID NO: 556558 - DNA, 116 bp, Homo sapiens
gtcatctaaggatccccatgggtgctcatccccccctacccatctcaggtgagttcaaatgttcctggatttgttttttgtttgcttgtttgttttttggggcagagtttcgcttt

SEQ ID NO: 556559 - DNA, 1246 bp, Homo sapiens
agcgggtaaaaaaaaaaaaaaaaaaaaaaaaaaaccctgatttattactatgtcttttttatcaaaccctgccctaaaattaaaagtggggcatgggcttttacaatttctaattgtgttaaaaacacgcctattttattattttgtcggacaaccaataaggtattattcatgggttcccactgggcccttaaataaatggggatccttctattaaacacacttcctatgatatcacccactggtttctaactggtgtacactgggctccctattaaaacgctggattgggcgtttttcattaaactctggcgagggaacattaaaattcctggaaagaaaagggagaaaaagaactctggacttgggtcacattggggatacaggggtgaacacgtctttggaaaaaatcaaaatcactgggacccaaaaaattgtgttgcaaaacaagaagaattccccgtgtatgtaaacaccgtgttttaccctataagggtggtgtgttctctataacaattcgcgtgtgggcgaagaacttctccaccagaagccgtgtgtgtctaatcacccacgggcgtgtgtgccaccagaatccccagcagaaatttttctctcgacaacaagaagggttataattttcttctcccagggctgagaaaactttctctctcaaattaccaccccaagctctctccccaggaggcgtggagcaaattctcacgacagacacaaacacaatttctccgtgaaagcagggtgggactcaccattcacagtgggaagctctcttcacacagacgctttttaagccctcttttttcccccactcttctgattgagaccactcccaggggcggagcaagggtgcgtcctaaccctgtgttcgttaaacacctcttctgtgtggcgcgccagggattctacttccagggcgagaagcacctgttgtaacacgacagtcttctctccaactaacccctacaagtttcttcacaccacaacactctttctgtggtcttcaacacacacgaacacccgtggggggtggcgacgttgttccaccaccttcccaacataatctgccggggggcgaaaaaagaaacaccccctcttttcctcttattgttggggggggggacccccccattgataggggcggaaccccccaaatttctttctctccaaaaaaaaagttgcgccgcgccatcattattcctctatccggcttcaagcaaagaacacactc

SEQ ID NO: 556560 - DNA, 1112 bp, Homo sapiens
tcgcgtgctatggttcttctcgtggtgctttctttctcgttgtttttctttgttgcgccgtgtgtgtgcttcttccgatgtacctctctctgcggtgttctggcttatctctgcttcccgggatgctcgcgttttatttctgggattcccggtttccccctgattgcgttggccttgtgtctgctgtttcccgctgggatgtcttccctgccttgttgtgctatgttgcgtgttgttgatcttgcatggcgaggtatgtcgttctttggtgttggttcttttggcccgcttttcttttcttgtggggttgatccggtcctttgctttctgttttcttggcttgtttcttctgcttttgtcccttctacgtctagttacttgtattctatagtcttgctccccaagtatgttatgtatggaagcctttattactgtaatagagacctaatataacttctgataatcagttaaggcaattctaccctttctgtgcctaagagatgtgatgcagatgctcctgatagatcagtgtactgttacccggactattcctattccgttcacaagttctggttcttcagtgctgcttactattttggtaactgggcctttcttggggtatttttgattggattaattgtatcctgttgtatatgggaaagtatatcggttattgaaggcagtagatgaagattcagacataagtgatgatgagccctgctgtctattctgcttgacagccttctgtcttaataggttttataatgctgactgaatatctgttatgcagttgtttaaagtattaaactgagcattagtagtttgctatactagcatttcatcgtgtataatgggagcatggatataagactactatatgtgtagttatatgttttctgaagtaacattgtatcatagattaacattttagattaccataatcatgctatgtaaatataagactacctggactttgtgatgggaatgttatgtgctaaattttttcctctaatgtataatagtgttttattgatttccatcttccagaagttatattcccttgtacgcgttggaacatatatcagaccggggcggggcgggggggggggggg

SEQ ID NO: 556561 - DNA, 112 bp, Homo sapiens
acttgtgtgcggaactcctcggaaccatggcgtccctttcccttgcacctgttaaacatctttaaaggcaaggaagctgatgaaagggagaagcagaagacaactcgtctta

SEQ ID NO: 556562 - DNA, 230 bp, Homo sapiens
tttactagagacggagtttcgctttgttgcctaggctgatcttaaactcctggactcaagcaattcacctgtggctcccagagcgttgcaattataggtgtggactgtctgccaggcgcggtggctcacacctgtaatcctagcactttgggaggccgaggcaggtggatcacaaggtcaggagatcgagaccatcctggctaacacagtgaaatcccatctctagtaag

SEQ ID NO: 556563 - DNA, 2795 bp, Homo sapiens
ttttttcgcacttaccctgatcagccgactctctctttatctcatctttgtacagcttctctcctgtccttaatttatccacatatttgtccgcacttcggtgtgccaactgtcacaccgttatttcccgctttctggccacgagtctatgttcctctcccttctcaccgcggttcatgtgtgattcccctaaatcgcttcctctggcttcatcgcgtcgcactcgccgtcgcgtctcgtcacccgcgtccacgccctgattgcccatctccgacgtgtcgtctcgtcgtttctttctcactcgcggtctctctgtaccgtaccccccgggtctcactcctgtccctgctccgtcggttgtgcgtcggcttcgctctgttcgtttcctctctccgtctcttctcctctctcggttctgtcttgagtctgtatcttgttgttgtgcctcgtgtgagttccatgggttgcggtgcatggtgtctgaagtggttctcctgctccctgtggttattcgctcgcagcactgtgttgcgcatcggatgtcctgtctttgctgcgtttcgccgtcgttgtttcccgggcacttggtctgccacccagtgtgtcgtgtccaacactgtgaacccaggttagttaggtaccatctagtcgtatacatacggtctgtagtacagaaccagtttattgatgtttgagtctttgcttgttcaatggctttgcaggctgcatgaattgtccgctctttggtttgtctgccgcccaggaagtctaatgcctacatttaaaggatggcctggcccccagtatacgccgattcctgctcgcggccttctacgcccattactgggagcagcagccatcagtgtagacgacgacgaaagtctcccatgtaggaaaacgtgtctctgctaactggaggcgccggctccacgctcggcttcatggtgctttgcaatacggctctgcgctttcatgtccatctccatccagtggctcacggagtcgcttgctggctttcgcctccgattcttgtccatgttgattttcatgcccttctgaaacttccgggcttgcagatttcctgacaaaggcccaggcctcatcctctgtggcaaacttcttaaatctggcagcaggaaaccggtccacctgtgctctgcactcattccaggtcagaaagaccccggtcttgcggcccctcctcacggcatagaacatcccgaacccgcgagagccgcggcggcagggcaaggcggccaaggcgactctgtgggccaggaacagaagccagctcatcgctcactcccggcaccgggaagcatttcgactcccggcccagcgtgggcgcgagccgccggcgctcaacaccgcacttccgtcaccggcgcgggaagatgacgcacgtctgggcggagtcctgatgagggccggggcctagggaggggcggtgtcgtagggcggagcccggagctcggcccctgacgagcccgaactcgtcaacttcctgtcggtacttgaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggcgagaggggaggccgtggaagccgcattcctccccttgccttgggcgcccacccccgaaggggcgcgtcccctccctgctccactgcacgtgggtgtttaaccaggggatatccagtgcctcaagcaccacgacccgggagaaaactgagttgagaaggtcttctaacaagccttttgcacacctgccatgtattttgtcaggccttggggatgaaggtgagaaattcgagaatccccggagataacacatcagcaaatagtgcgcaggcagaacaagctgttggaggtgagagacacagagcagagaagcacccgcacctggagagtcaggagggcctcacatcagaacgcctgagcaaatacagttttgaaggatactaattttttaaaaagttcattcacatgagttagacaaagagaaagaagcaggacattctaggaagaaggaacggcccaggcaaaagcgacgcgtacattggcgtgggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccggactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattagaaaaaaaaaataataaaagccaacatggcattcattactgccaaaaaaattaaaacacattgttaaaattga

SEQ ID NO: 556564 - DNA, 1559 bp, Homo sapiens
  misc_feature (374)..(374): n is a, c, g, or t
  misc_feature (787)..(787): n is a, c, g, or t
  misc_feature (956)..(956): n is a, c, g, or t
gccgcaaattccccacaggattggatcgattcgcgggctcatggtgtttgtattgtgttttattgtgccccgccttccctgcggggagatctctcctatgtaattcgccccccctcccctctcatgtggtgagtgatagaattttttgattgaaagagaaaattgttgcggggtggttggaagcaccctccctctctctcgtgtgcctgtaagagaccatcaaagatgtgtttccccaacaggggggagggcccgacagacagtgttctccacacatgtttgttttccttggggggtgtttaaagtggcatccacaactagtgtcgtctgtgtatccctcaagagccagctaactacttgttggggcgggttantttccgccccgttttctttggtgtggggaacccgctctctccaaataaggagcccggtacgaccgcctcttattttggaggcatgttggcctttcttataccccactgcccataatggctcagaatatggcccccacgcaccccccaggagggggcacaccaccacaccagcgggggtttcttctgtgcggcgggtttcataaaattagtttcgagaggggacatcgtctcgggtagaatagagggtaacccaccccctcccgctccacagcaacaaagtttgggggagaggctgcagctaaagatatatataataatttgggccaacaacatcttttttttcacaggggccaacaccacacaacatatggggttgggaacacacatctgaacacattagagttgtctccccnccaccccacgggagtgtgtgcaacacacagctcggtgcctcgttgccacggagatttccacactctcctcttctctctccacacattagagtgtggtcccgcacgcaacttgtggctcatcttctgggagttattataagagagagactactctacccctctgggagtnttgtttatagaggaagagagggtgagaagacacacacactgtgtgtttctctctctctctctgtgtcactctacacacttataagggagctctctctcacatgtgttctcttatagtttttatagagagagagagcggcccacacacatttgttttttttttgtgtcacaactctgtgtccggtgacacacacacagcgtgtgtgtgtgtgtgtgtgtgtgtgtgtgtgtgtgtgtgtgtgtgtgttataagaggtgtggctcttaaaaaatcttgtttatcgcgcatatgttctcttactcacacatgtgtcacacgagatgagctggcgcttttatactatattgtgagaaacacgtgtggtttgtgtgtgtatatcacaattcacataatatatcacatttaaagcacgtttgtagaggcacatacttttgcacataagaaaatataaaaaaatatctgaatttggggcacactgagggaaataatttgaccacacttatagttaatcttcacacgtttgttgcacaaactttgagatttttaatttcacatctgaacttgtttccaagatttatattaaatatttggcataaccagaga

SEQ ID NO: 556565 - DNA, 317 bp, Homo sapiens
caaaccttctaggagctcacagtttattggggaagagagaaaaccctggagaatatgtatagtgaagggaggggtcaatgaaaaacaaggagtatggggaaggagaagaggattgtgtaggttgtgtcaggaaaaaaaaaataaggaaacaatgattgagtcagatacctttaaaatgaccaagagagctgggcacgcagtggctcacaccttagggagtaatcccagcactcagggaggcagaagcaagaagatagcttgagcccagcagttcaagacctgcctgggcaacatagtgatacgcctattctgcgacg

SEQ ID NO: 556566 - DNA, 2964 bp, Homo sapiens
ttttttcgcacttaccctgatcagccgactctctctttatctcatctttgtacagcttctctcctgtccttaatttatccacatatttgtccgcacttcggtgtgccaactgtcacaccgttatttcccgctttctggccacgagtctatgttcctctcccttctcaccgcggttcatgtgtgattcccctaaatcgcttcctctggcttcatcgcgtcgcactcgccgtcgcgtctcgtcacccgcgtccacgccctgattgcccatctccgacgtgtcgtctcgtcgtttctttctcactcgcggtctctctgtaccgtaccccccgggtctcactcctgtccctgctccgtcggttgtgcgtcggcttcgctctgttcgtttcctctctccgtctcttctcctctctcggttctgtcttgagtctgtatcttgttgttgtgcctcgtgtgagttccatgggttgcggtgcatggtgtctgaagtggttctcctgctccctgtggttattcgctcgcagcactgtgttgcgcatcggatgtcctgtctttgctgcgtttcgccgtcgttgtttcccgggcacttggtctgccacccagtgtgtcgtgtccaacactgtgaacccaggttagttaggtaccatctagtcgtatacatacggtctgtagtacagaaccagtttattgatgtttgagtctttgcttgttcaatggctttgcaggctgcatgaattgtccgctctttggtttgtctgccgcccaggaagtctaatgcctacatttaaaggatggcctggcccccagtatacgccgattcctgctcgcggccttctacgcccattactgggagcagcagccatcagtgtagacgacgacgaaagtctcccatgtaggaaaacgtgtctctgctaactggaggcgccggctccacgctcggcttcatggtgctttgcaatacggctctgcgctttcatgtccatctccatccagtggctcacggagtcgcttgctggctttcgcctccgattcttgtccatgttgattttcatgcccttctgaaacttccgggcttgcagatttcctgacaaaggcccaggcctcatcctctgtggcaaacttcttaaatctggcagcaggaaaccggtccacctgtgctctgcactcattcctccaagggttgttacaaggatccaactgcaaatactggcttattagaatttgccttttttaaaagggaagattaggtactgagttccaatcccaatttagctggtacggaaagtcttctggtaacgggggttcgttctgattacgtgtcactttttgttgcactttaacaggtcagaaagaccccggtcttgcggcccctcctcacggcatagaacatcccgaacccgcgagagccgcggcggcagggcaaggcggccaaggcgactctgtgggccaggaacagaagccagctcatcgctcactcccggcaccgggaagcatttcgactcccggcccagcgtgggcgcgagccgccggcgctcaacaccgcacttccgtcaccggcgcgggaagatgacgcacgtctgggcggagtcctgatgagggccggggcctagggaggggcggtgtcgtagggcggagcccggagctcggcccctgacgagcccgaactcgtcaacttcctgtcggtacttgaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggcgagaggggaggccgtggaagccgcattcctccccttgccttgggcgcccacccccgaaggggcgcgtcccctccctgctccactgcacgtgggtgtttaaccaggggatatccagtgcctcaagcaccacgacccgggagaaaactgagttgagaaggtcttctaacaagccttttgcacacctgccatgtattttgtcaggccttggggatgaaggtgagaaattcgagaatccccggagataacacatcagcaaatagtgcgcaggcagaacaagctgttggaggtgagagacacagagcagagaagcacccgcacctggagagtcaggagggcctcacatcagaacgcctgagcaaatacagttttgaaggatactaattttttaaaaagttcattcacatgagttagacaaagagaaagaagcaggacattctaggaagaaggaacggcccaggcaaaagcgacgcgtacattggcgtgggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccggactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattagaaaaaaaaaataataaaagccaacatggcattcattactgccaaaaaaattaaaacacattgttaaaattga

SEQ ID NO: 556567 - DNA, 177 bp, Homo sapiens
  misc_feature (58)..(58): n is a, c, g, or t
  misc_feature (108)..(108): n is a, c, g, or t
  misc_feature (114)..(114): n is a, c, g, or t
  misc_feature (116)..(116): n is a, c, g, or t
  misc_feature (123)..(123): n is a, c, g, or t
  misc_feature (127)..(127): n is a, c, g, or t
  misc_feature (132)..(132): n is a, c, g, or t
  misc_feature (148)..(148): n is a, c, g, or t
  misc_feature (150)..(150): n is a, c, g, or t
  misc_feature (152)..(152): n is a, c, g, or t
  misc_feature (154)..(155): n is a, c, g, or t
  misc_feature (172)..(172): n is a, c, g, or t
gtattttattttaatactattcagatcaaatgaaacttttaccgaaactggagacctncattagggcggaagagtgggggattggacctcttcttacgactgcgttgncaatangnagcgatntganctttnacagcaattactgtangnanannccgcactagtttgttanaaaaa

SEQ ID NO: 556568 - DNA, 2474 bp, Homo sapiens
ttttttcgcacttaccctgatcagccgactctctctttatctcatctttgtacagcttctctcctgtccttaatttatccacatatttgtccgcacttcggtgtgccaactgtcacaccgttatttcccgctttctggccacgagtctatgttcctctcccttctcaccgcggttcatgtgtgattcccctaaatcgcttcctctggcttcatcgcgtcgcactcgccgtcgcgtctcgtcacccgcgtccacgccctgattgcccatctccgacgtgtcgtctcgtcgtttctttctcactcgcggtctctctgtaccgtaccccccgggtctcactcctgtccctgctccgtcggttgtgcgtcggcttcgctctgttcgtttcctctctccgtctcttctcctctctcggttctgtcttgagtctgtatcttgttgttgtgcctcgtgtgagttccatgggttgcggtgcatggtgtctgaagtggttctcctgctccctgtggttattcgctcgcagcactgtgttgcgcatcggatgtcctgtctttgctgcgtttcgccgtcgttgtttcccgggcacttggtctgccacccagtgtgtcgtgtccaacactgtgaacccaggttagttaggtaccatctagtcgtatacatacggtctgtagtacagaaccagtttattgatgtttgagtctttgcttgttcaatggctttgcaggctgcatgaattgtccgctctttggtttgtctgccgcccaggaagtctaatgcctacatttaaaggatggcaacttcttaaatctggcagcaggaaaccggtccacctgtgctctgcactcattccaggtcagaaagaccccggtcttgcggcccctcctcacggcatagaacatcccgaacccgcgagagccgcggcggcagggcaaggcggccaaggcgactctgtgggccaggaacagaagccagctcatcgctcactcccggcaccgggaagcatttcgactcccggcccagcgtgggcgcgagccgccggcgctcaacaccgcacttccgtcaccggcgcgggaagatgacgcacgtctgggcggagtcctgatgagggccggggcctagggaggggcggtgtcgtagggcggagcccggagctcggcccctgacgagcccgaactcgtcaacttcctgtcggtacttgaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggcgagaggggaggccgtggaagccgcattcctccccttgccttgggcgcccacccccgaaggggcgcgtcccctccctgctccactgcacgtgggtgtttaaccaggggatatccagtgcctcaagcaccacgacccgggagaaaactgagttgagaaggtcttctaacaagccttttgcacacctgccatgtattttgtcaggccttggggatgaaggtgagaaattcgagaatccccggagataacacatcagcaaatagtgcgcaggcagaacaagctgttggaggtgagagacacagagcagagaagcacccgcacctggagagtcaggagggcctcacatcagaacgcctgagcaaatacagttttgaaggatactaattttttaaaaagttcattcacatgagttagacaaagagaaagaagcaggacattctaggaagaaggaacggcccaggcaaaagcgacgcgtacattggcgtgggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccggactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattagaaaaaaaaaataataaaagccaacatggcattcattactgccaaaaaaattaaaacacattgttaaaattga

SEQ ID NO: 556569 - DNA, 471 bp, Homo sapiens
agactgtcgacaggttggagtgcaatggcactgatctcagctcactgcaacctctacctcctgggttcaagctattctcgtgcctcagcctcccgagtagtttggatcacaggcacctgccaccacgcctggctaattttttatttctagcagagattgggtttcaccatattggccaggctggtcttgaactcctgacctcaagtgatccgcctgccttggtctcccaaagcactgggattacaggcgtgagccactgcgcctagccatgctatttttttggcatcagttaattaattgtacctgaaatccaatgatggggagggagatgtagaaaacatggccttgatatgctcttatcctgcctcttgccactgacgcttatctttctgctgttgctaggactggctttgctaaattgtagacttccagaattaccgaataaaggattcccatcatgatccaattatg

SEQ ID NO: 556570 - DNA, 2751 bp, Homo sapiens
ttttttcgcacttaccctgatcagccgactctctctttatctcatctttgtacagcttctctcctgtccttaatttatccacatatttgtccgcacttcggtgtgccaactgtcacaccgttatttcccgctttctggccacgagtctatgttcctctcccttctcaccgcggttcatgtgtgattcccctaaatcgcttcctctggcttcatcgcgtcgcactcgccgtcgcgtctcgtcacccgcgtccacgccctgattgcccatctccgacgtgtcgtctcgtcgtttctttctcactcgcggtctctctgtaccgtaccccccgggtctcactcctgtccctgctccgtcggttgtgcgtcggcttcgctctgttcgtttcctctctccgtctcttctcctctctcggttctgtcttgagtctgtatcttgttgttgtgcctcgtgtgagttccatgggttgcggtgcatggtgtctgaagtggttctcctgctccctgtggttattcgctcgcagcactgtgttgcgcatcggatgtcctgtctttgctgcgtttcgccgtcgttgtttcccgggcacttggtctgccacccagtgtgtcgtgtccaacactgtgaacccaggttagttaggtaccatctagtcgtatacatacggtctgtagtacagaaccagtttattgatgtttgagtctttgcttgttcaatggctttgcaggctgcatgaattgtccgctctttggtttgtctgccgcccaggaagtctaatgcctacatttaaaggatggcctggcccccagtatacgccgattcctgctcgcggccttctacgcccattactgggagcagcagccatcagtgtagacgacgacgaaagtctcccatgtaggaaaacgtgtctctgctaactggaggcgccggctccacgctcggcttcatggtgctttgcaatacggctctgcgctttcatgtccatctccatccagtggctcacggagtcgcttgctggctttcgcctccgattcttgtccatgttgattttcatgcccttctgaaacttccgggcttgcagatttcctgacaaaggcccaggcctcatcctctgtggcaaacttcttaaatctggcagcaggaaaccggtccacctgtgctctgcactcattccaggtcagaaagaccccggtcttgcggcccctcctcacggcatagaacatcccgaacccgcgagagccgcggcggcagggcaaggcggccaaggcgactctgtgggccaggaacagaagccagctcatcgctcactcccggcaccgggaagcatttcgactcccggcccagcgtgggcgcgagccgccggcgctcaacaccgcacttccgtcaccggcgcgggaagatgacgcacgtctgggcggagtcctgatgagggccggggcctagggaggggcggtgtcgtagggcggagcccggagctcggcccctgacgagcccgaactcgtcaacttcctgtcggtacttgaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggcgagaggggaggccgtggaagccgcattcctccccttgccttgggcgcccacccccgaaggggcgcgtcccctccctgctccactgcacgtgggtgtttaaccaggggatatccagtgcctcaagcaccacgacccgggagaaaactgagttgagaaggccttggggatgaaggtgagaaattcgagaatccccggagataacacatcagcaaatagtgcgcaggcagaacaagctgttggaggtgagagacacagagcagagaagcacccgcacctggagagtcaggagggcctcacatcagaacgcctgagcaaatacagttttgaaggatactaattttttaaaaagttcattcacatgagttagacaaagagaaagaagcaggacattctaggaagaaggaacggcccaggcaaaagcgacgcgtacattggcgtgggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccggactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattagaaaaaaaaaataataaaagccaacatggcattcattactgccaaaaaaattaaaacacattgttaaaattga

SEQ ID NO: 556571 - DNA, 651 bp, Homo sapiens
  misc_feature (437)..(437): n is a, c, g, or t
agttatgcttgctacttatggaacgaaataagaggccataacgaccagtggtgtcaatgtcctgttaatctcaggcatctttgagacaggtcccgaggaccggcgctgggagtcacgaccgtccacggacctgtgaccaacactacgcccctgtgcgtaccatttctggctgacacacttccacggggctcttatactacaaccattagcagatcccattgacgccacgtgctggttgcgttgccgtatggcttgccatggtaatcgcaggcatgcatcgagagcagagcatgacggcccgagcaactcgcttgacaccctgggaggccagacgccctctgcacggtgcagccaacacagacttgcaccaacgtgtacctccatgcccatgggcacacaacacgcccacgacgcaccaatcccccaaaacaacaaancaacaacaaacgcaacaaaccacaaaacaaaagagaccaacacaccagggtcagagcgggacccgcaacgaaccgcacgaccacccacaatggacaggaggcaagacagggaactaagtccaaaaagcagcagacagacagcacaaccaacgaagaacaagacgagcagggcgggagaaccacaaaggtgcagcgcacaaaagaccagacagcg

SEQ ID NO: 556572 - DNA, 669 bp, Homo sapiens
  misc_feature (537)..(537): n is a, c, g, or t
  misc_feature (579)..(579): n is a, c, g, or t
  misc_feature (583)..(583): n is a, c, g, or t
cctcaacgcctgtaatcctagcacctttgggaggccaggtgggtggatcaacttgaagtcaggagtttgagaccagcctggcaaacatgttgaaaccccgtctctactaaaaatataaaaattaacttgacatggtagcatgcgcctgtaattccagctactcgggaggctgaggcatgagaattgcttgaacctgggaggcggaggttgcagtgagccaagattgcgccattgcactccagcctggggacaagagtaaaactcttgtctttaaaaaaaaaaaaaaaaaagcctgggtgcagtggctcactcctgtaatccgagcactttgggaggccgaggcaggcggatcatgaggtcaggagatcgagaccatcctggctaacacggtgaaaccccgtctctactaaaaatacaaaaaattagccgggcgaggtggcgggtgcctgcagtcccagctatgcaggaggctgaggcaggagaatggcgtgaaccccggggggcggagcctgcagtgagccaagatcgcgccactgnactccagcctgggaagggcgagactccggctttttaaaaaanaaangcttattcatgcggcccaattgagctaattggcaatcgcctatagggggggattaaataactgccggggtttaaaaagcgggctgg

SEQ ID NO: 556573 - DNA, 758 bp, Homo sapiens
  misc_feature (246)..(246): n is a, c, g, or t
  misc_feature (249)..(249): n is a, c, g, or t
  misc_feature (319)..(319): n is a, c, g, or t
  misc_feature (351)..(351): n is a, c, g, or t
  misc_feature (387)..(387): n is a, c, g, or t
  misc_feature (544)..(544): n is a, c, g, or t
  misc_feature (645)..(645): n is a, c, g, or t
  misc_feature (648)..(652): n is a, c, g, or t
  misc_feature (690)..(690): n is a, c, g, or t
  misc_feature (692)..(692): n is a, c, g, or t
  misc_feature (697)..(697): n is a, c, g, or t
  misc_feature (727)..(727): n is a, c, g, or t
cgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgccccnccnccaccacccccagggcggcgtgccaacgaccccccacacctctgcctatgcacagcagcaaagcccccgnctacaacagagagaaacccttgccaccgacgnctggacaaaggcttcaccctggtcgagagggacctnctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgcnacagagacacaattctttgcataggaagacaccagggcctgtcagaggcctagcacctcctccacccacctcggcctccccatctttactgagtaataggncannnnncccagcccgagaccctcccagtcggggagcagctcctncnccccnacacctgtgatccgaaatggtgccaggganggtcccctccccaccacatacggatgcatgg

SEQ ID NO: 556574 - DNA, 2468 bp, Homo sapiens
ttttttcgcacttaccctgatcagccgactctctctttatctcatctttgtacagcttctctcctgtccttaatttatccacatatttgtccgcacttcggtgtgccaactgtcacaccgttatttcccgctttctggccacgagtctatgttcctctcccttctcaccgcggttcatgtgtgattcccctaaatcgcttcctctggcttcatcgcgtcgcactcgccgtcgcgtctcgtcacccgcgtccacgccctgattgcccatctccgacgtgtcgtctcgtcgtttctttctcactcgcggtctctctgtaccgtaccccccgggtctcactcctgtccctgctccgtcggttgtgcgtcggcttcgctctgttcgtttcctctctccgtctcttctcctctctcggttctgtcttgagtctgtatcttgttgttgtgcctcgtgtgagttccatgggttgcggtgcatggtgtctgaagtggttctcctgctccctgtggttattcgctcgcagcactgtgttgcgcatcggatgtcctgtctttgctgcgtttcgccgtcgttgtttcccgggcacttggtctgccacccagtgtgtcgtgtccaacactgtgaacccaggttagttaggtaccatctagtcgtatacatacggtctgtagtacagaaccagtttattgatgtttgagtctttgcttgttcaatggctttgcaggctgcatgaattgtccgctctttggtttgtctgccgcccaggaagtctaatgcctacatttaaaggatggcctggcccccagtatacgccgattcctgctcgcggccttctacgcccattactgggagcagcagccatcagtgtagacgacgacgaaagtctcccatgtaggaaaacgtgtctctgctaactggaggcgccggctccacgctcggcttcatggtgctttgcaatacggctctgcgctttcatgtccatctccatccagtggctcacggagtcgcttgctggctttcgcctccgattcttgtccatgttgattttcatgcccttctgaaacttccgggcttgcagatttcctgacaaaggcccaggcctcatcctctgtggcaaacttcttaaatctggcagcaggaaaccggtccacctgtgctctgcactcattccaggtcagaaagaccccggtcttgcggcccctcctcacggcatagaacatcccgaacccgcgagagccgcggcggcagggcaaggcggccaaggcgactctgtgggccaggaacagaagccagctcatcgctcactcccggcaccgggaagcatttcgactcccggcccagcgtgggcgcgagccgccggcgctcaacaccgcacttccgtcaccggcgcgggaagatgacgcacgtctgggcggagtcctgatgagggccggggcctagggaggggcggtgtcgtagggcggagcccggagctcggcccctgacgagcccgaactcgtcaacttcctgtcggtacttgaagaagcggagccagggctgagatcccgaaggcgggcgaggtctgggatggggcggggcctatgggagcggggctgaagccctgggcccggcagaggaaggtcgagatggaccatgttgggccccttctctccccgcccccaggccgcagttcgggggccacgccccggcgtgctcgggtcaccgcgggaagcccttgaaccccctggcgcccggcacccacgtgcggtaaccgcggctcctcgagagctccagggatgcggatctacagtaagggctgtggccagatgaatgaatgcacattttttagtgggcagaaagatgttagaattcatgaattagaataagcacaaaggagggcgagaggggaggccgtggaagccgcattcctccccttgccttgggcgcccacccccgaaggggcgcgtcccctccctgctccactgcacgtgggtgtttaaccaggggatatccagtgcctcaagcaccacgacccgggagaaaactgagttgagagggtccattcaagaattgtgcccacaatataccaggcacttgtccagacctgcatcgtccaatgcccacctcgacctcccaaagtgttgggattagaggcgtgagccaccgcgccctgcctgcatgtggctattgagatgtgctgtatgatacacaccggactttgaagactcagtgtgaaaaataaaaagaattttaagaggggtgggggtcgaggggaggcagagcagtaggacaaatagctaatgcacgcagggcttaaaacctagacaacaggttgatgggtgcagcaaaccaccatgacacatgtttatctatatagcacctacatgttctgcacttgtatcctggaacttaaaattagaaaaaaaaaataataaaagccaacatggcattcattactgccaaaaaaattaaaacacattgttaaaattga

SEQ ID NO: 556575 - DNA, 141 bp, Homo sapiens
gtgacagtaatggtggtgggcaggtagtggtgacagtaatggtggtgggcaggtagtggtgacagtaatggtggtgggcgggtagtggtggcagcagtaatggtagtggtggtggtggcagtagtaacagtggtaggcggg

SEQ ID NO: 556576 - DNA, 175 bp, Homo sapiens
  misc_feature (124)..(124): n is a, c, g, or t
  misc_feature (132)..(132): n is a, c, g, or t
  misc_feature (171)..(171): n is a, c, g, or t
gagaactgacaatatagaaagcagaggtttaaaccttctcttgggatgcctcgttttgttgtgattgacaactgtattgcactgaagaaggttgcatcacggtcaagaaaaaaaggagagaaancattaaancaaagtagagaaatttcaaaagcaggggagtatgtacgngtaa

SEQ ID NO: 556577 - DNA, 186 bp, Homo sapiens
  misc_feature (24)..(24): n is a, c, g, or t
  misc_feature (55)..(55): n is a, c, g, or t
  misc_feature (83)..(83): n is a, c, g, or t
  misc_feature (102)..(102): n is a, c, g, or t
aaataattgttttaagttatgtcnaaagaggatgttggcatgcttttgaataggnaataagtgagtatattttgtaaaagtanatttataaaagaagttgcnctttagttaatactgagaaaagtaaaattgtgtgtgtgtgtgtgtgtgtgtgtgtaatgtgtttaatattgaaacataaatcct

SEQ ID NO: 556578 - DNA, 245 bp, Homo sapiens
aatccaactctaacactatgcttagggctatcacactctgttcgcagcagtctggccttagaaaaatgaatcaaaaaatcgtagcttgtccacttctagtcaactaggactcataatagttaccatcggcatcaagcaagcaccaactagcattactgcacctcttgtacccacgccttcttcaaagccatactactctatgtgctgccgggtgcatcatccacacccttaacaatgaacaagat

SEQ ID NO: 556579 - DNA, 164 bp, Homo sapiens
cctccgtagctgctccatatagtactcagaaatcatatgttctacctcttcatgaaaatacttttcaggagctccaggtaatgaggcggagcctgaattgtttagaacacaaatgatggatttagaatatggcaatgctagcgtcagacaaaccatggctttat

SEQ ID NO: 556580 - DNA, 152 bp, Homo sapiens
ggaagaaagaggaaaggtaaaaatgggatgcctttggaccccaaacctgagcctaagaagcataaagattccctgatatatgtggctctgtcctagaaaagaggtaatagcacacctaacgcaccacggcatctactccttctagtttgctg

SEQ ID NO: 556581 - DNA, 300 bp, Homo sapiens
ggacacagttatgacctgggcgtcgcttacactcagcgaaagagctaatctccgtacaaacatctcagacgcgcaggagatttacaccggctgaactattctgcccgccatcatcctaatcctcatcgccctcccatccctacgcatcctttacatcacagaggaggtcaatgatccctcccttaccatcaaatcaaaaagggcaccaaatggtactgaactctacgagatacaccgaactacggcggagtaatcttcaattcctacatactccccccattattcctagaaccaggcgga

SEQ ID NO: 556582 - DNA, 572 bp, Homo sapiens
atggggtatctttccatttatttatgtccttttttatctccttcatcaatgttttctagttttcagcgtacacatctcttacctccttaaatttcctaagtaattttttgatgcaattataaatgggatagttttcttgatttctttttcagataattagcatatagaaacattgtatgttaactttgtatcttctaattttctgaacttattaagtctaatagttttttggtgaagtctttagagtttttttgtttgtttgttttgttttgtttttgagatggagtctggctctgtcgccaggctggagtgcagtgctacagtcttggctcactgcaacctctgcctcccgggttcaagtgattctgctgcctcagcttcccgagtagctgggattacaggcgcccgtcactatgcctggctaatttctgtatttttagtagagacggcatttcaccatgttggtcaggttggtcttgaactcctgacctcaagtgatctgcccgcctcggcctcccaaagtgctttgattacaggcatgagccattgtacccggccattgttctttcatt

SEQ ID NO: 556583 - DNA, 353 bp, Homo sapiens
gtggttcttgtcttggttgtggagcagtggcacggcattctaagtggtgggagctgttgggcagggtgggtacccactggctgttcctcttggccttctgttccctgaggtaggtggggggctctgtgctgatggatgtacagtttgatgattactcgctggtctgcctggtcctccaggatgctgtccgtggggataggactcgatctgctgtctgatgtgcctgatgcgcatggatgccacaagcgtcagcgggttcaaatccatgatcgtcacagaggatttctgaaaatatctcaggcgtcatcaagtttctcattcatgttccaggttaaggcgtctcgagagaactg

SEQ ID NO: 556584 - DNA, 185 bp, Homo sapiens
aatctgatactggttgatgatagtagtagttgttcctgctctaactgtctttggaaggagcagaggatgaatctgtttcatcgctggtgtcgtacctctgcactcattcaggcatgtagctttgactctgtgcataatacatgtgacacaaatcctgtatctacattgaacgtttgggagagatg

SEQ ID NO: 556585 - DNA, 334 bp, Homo sapiens
tcaggcaccacctatgagaatgggaggtgattcacaatggcaggcatggggccgggcacagtggctcacatctgtaatcccaaccctttgggaggctgagacaggtggatcgcttgaggtcaggagctcgagagcagcctggccaacatggcgaaatggcatctctactaaaaaacaaaaattagctggcgtggtggcaggtgcctgtaatcccagcaactcgggaggctaaggtaggagaatcgcttgagtctgggaagcagaggttgcagtaagttgagatcgcgccactacactccagcctgggtaacagagactctgtctcaaaaaaaga

SEQ ID NO: 556586 - DNA, 469 bp, Homo sapiens
aggagaactccctacgctttttacttccgtcaattactactgctgagaccacctcacataggacttccagcttcacttgttcgatcaccaccaccaagaccacctcacacagtacttccatcttcacttcctcaataatcaccgagaccagctcacacagttctcccagcgtcacttctgcaatcaccaccaccgagaccacctcatgacagtactcccacgctacagcttcttcgatagccaccaacatgaacacctcaaagagtactcccagcttcacttcttctatcattaccacggagagcattccacggagtactcccagcttcagcttcttgtatcactagcaaagcaagaacattcacgcagtactcccagcttgacttccgtgatcacaaccaccaagaccacctcaaacagtattcaaggtttcactttttcaatcacccccaccgagaccacctcacac

SEQ ID NO: 556587 - DNA, 767 bp, Homo sapiens
caattctcggttccaggaatgcctcgtgctcggaagggcaatgcgctccgcaagggcggtcagcgccgtggaggaggtgccaggagcagtacccaggctgactctggctccagtgaggatgaagcggccagtgaggcccggagcaccaccagtgactgtcccagccttctcagcgccaccacagaggactgcctgggtggcgaagcggtggacgaacagagccagcaggaaaacctggaggagaagctgaaaggttatgtggactgccagaacccagaaagccaggtggccctgctccagagatggacaatctcatggatatgctggtcaacacccagggccgccgcatggacgaccagcgtgtaacagttaattccctgcctggcttccaacctatcggccccaaggtaggtgatgtccagattacctgtgagactccacatagctctctaaatctatgacctgtctctaggcaggaaaggagaggaccctatgaacacgtaaagtgctatgggcttaaggtcaggtggcaggactcatgctagtgcagaactatggcgtggaaattacagttcctgctccaacatctgtatatttggggccccgttcagccgatgaacaatggaaccaagggtgtgtcacccacatgaacccttttatccgcctcccagtgcaaagaaccgtcaaggaggccctggagaacctgggcctggcctggcttcccggctaaattcggaagtttttgttggaagcaagacctcaatctg

SEQ ID NO: 556588 - DNA, 304 bp, Homo sapiens
cttcccccaaattttgtaactcttgaccatgtcttaattgcctggtactatgctagaagtatagaaatcattaaactaggctgggcatggtagctcatcggtaatcccagcacgttgggaggctgaagcaagagattgcttgatcccaggagttgaaaaccatcctgggcaacatggtgagacccttatctctacaaaaataagaaattagcgaggcgtggtggtgcatgcctgtagtcccagttactcgggaggctgaggtgagaggaccacttgaacccagaagtttgatgttgcagcgatg

SEQ ID NO: 556589 - DNA, 142 bp, Homo sapiens
tggttcacactagaacaattgaatcttaagttcctctacattattctaattgtacagtccctggcttgagaaatactggcctacagtaagtgattctttaagatgttgtctccggtaccagcgagcaccagcaactatctgg

SEQ ID NO: 556590 - DNA, 1146 bp, Homo sapiens
  misc_feature (566)..(566): n is a, c, g, or t
ctgaagtacgccctgcccctggttggccaccgcaaaggtgtctaaacgagtgctaaagcgctacaccagtgcgccccctggctggtcgtctactacacgtgtggacttcaggctttgattacagagctgcaacatacacttttggcggagcctaattcctaaaggtggccaaggacttccctgagtacaccttctgtcctagttgtcggaacgaatgagtgactatgcttgccgtgacggtgaactgacctgtgggtctcatcagaggacgtggtggaggatcgtctagatgcccgccaatccatggacgtacgcagtcgtgtgaagcaacgtttccgtcctattggagccccatgcacggtacgttcttggactactgaacaaccctaccgatgaaagtttgtcaactagctattcatacaccacatacggtagagaacttgtaagcctagtccatcaaaattccccaagcacactgccacaacgcatagcaagcataagggggatctccagttacataagggtcgattggttggtgcaacaagcatcctttctggaaactccanttttgtcgacttgggaacccccaaagaagggaacgtcctttcgatcgatgtttctaactgcgccattagggtttgcaggtgtggctacctttgcgcacatgtctatgacctcaagtacgtcccccgattggttacctaaccgagggcgcccttggaccctaaaggaaacgcgttaaccaagaggggagccccaaatggaggggtggccccttgagattccagttcggttccccaaaaggtatttgggaaacctggccccaacctttgttcccaaatgcggaacctgtgtacgccccccagacatggagccccggccttaattacacaggggttcggggacagcggtcgccttttccacccaacatatcccaattacctaaaccttttccagcccacggccccctcaaggcttggcgtggctgaaccagaggataggaggaacaatcccccaaaggtctcacaagaattttcgtcgcaacgcgggcgcttgcagacaggaaacccctgtgaagacaattccgtaggggatggcccatttcttcgggaagtcccctggtttttgactcactggacaggcacc

SEQ ID NO: 556591 - DNA, 473 bp, Homo sapiens
ggttagaggcagagccaggtgcagagttgtgtgcttcacaagttggctctgtggtcgggaaggctcacggcgataagcacctggcttttgattcctgggaggacagcacttggacgggagtacgcattcaggcaatcactggtttccccacatgctttcttgtctcatggacagtttaacaaagctggcagagtcctgtaactaggatctgtacctttgggggtacaggcacgtaggaacagacatccaaacacaactgagtgctgggatataggcttgaccggacagatttcaggtgcctgggctttgtttgcatactgggcaccttctcagtctctttgtcagaactgacgcagcacctttcacatctaagtacaggccccaggctggatactggtagatgactggggcgggcatcagctcttccactggatgggtgaatatacttgcaggtcaattactaaagttgagcc

SEQ ID NO: 556592 - DNA, 418 bp, Homo sapiens
atgatcctaacaaaacctagaagtttacaggagtcagcaagctaccgagtatctgacgtggtttctaaggtgcagttgcatggggagcactctcccgtggcttctgagtgaaggcaacagtgatgtccaaaccaagcccgtccgcctctgaaccaccagttggcaggccagaatgactccagtctttagcaaagagctttccattctacctcccgaaatcccagaccagatggatgtctcctcccacctaggcgcagagggtagcacagtcttccaaaaggaaacaccttcattaaacgcagcagccagtcctatatgctgacccttgggtcaacccacagcttaagcgggggaacaagtggttctgatccatgcacagccagatctgctgaggactctggggttcccaggaaccaga

SEQ ID NO: 556593 - DNA, 483 bp, Homo sapiens
atcccccgtcgtgtgctggtgggtggatatgagtgtatattggggacggtagtggatgataataacttgctggtggttagggatagtgggatcagtggtaaagagaggagtcaagggatgacttcagttgatggcctgagcagttggatgcttttttctttgatgaggaacactgtgggaaaatgcaaattataaggagcacacgcagtcgcgtatgatggacgtatcgatccgcctgggcggaattctgactgagaggcgtacagtcaataatcccaaagatggtagcttcgcccaatgggttcctcagccaagcacatacaccaattgtctgaacctgcggtacctctcgtactgcgcaggattaccatggcaacaacacatcatcagaggggaacacctaacctgtctcacgagggtctaaacccaggatcacgtaccctattagtgggtgaacaatcctacgctgggtgaattctgatt

SEQ ID NO: 556594 - DNA, 985 bp, Homo sapiens
  misc_feature (1)..(1): n is a, c, g, or t
nactgcaaaatgtgtgaagaacgccgcgtggggcccgcgagaagccccccacgggggcagcgccgggcctagcgccacaggtgtggttcccggcccccccccgggcccattggccccccgggtcgcccccgggtgggtattcccaccggggccaccactgaaacaggtagaccgtcgccgggcgggtcaagaacacagcgacatgtcccccctcattggagacaaaccacggggaggcggtcccccaaaatttcatgaacagtcgccggtggcagggcccgccacacactgcggcaaagaagggggtgcctgtcgcggcaaccacacccacgtggttcgttgggaggcgtcatttttcacggcagtcactacacccggcgtgtgtggagccaccaagcaggtctctgggcgaatagttggaagccacgccccccagtcgcgccgggggtccgtcacccaactcagcacgacaaggcacgacacacagaaaggacgctcatgggcccctaaggcacacaggcgccaccacacaggtagtcggagcctcgcgctaggttcatcacaacagcgggtcacaggagacagttctaggccgccgctggatctcgcccgccccgccccgcctcaatacacacaaacgggcgggcaacataacccgctgctccccaagaaaccacgaatgtactcacaacgcgcgccctcttacaatgcagtgtgtggtcaaacatgtcgcggtgtacaggaaaaaaccgcacagcagtattgttttactcctcgtccggagacggggtaagcgcaatattcttttaggggccacccctcctgaggtttctctttatcggcgcgcggccagcagtcttcttgcgtgatatagtatgttttgtaatccacgcacgcatgtctcattttgtggggtaacacccgggccccgaacgttggtgtgcagcacgacacatttggcccccagaaatacagcccaaccaag

SEQ ID NO: 556595 - DNA, 288 bp, Homo sapiens
tgctcttttgggagttgggtaagtgcagcacttggtatgtgttaagcacctctgagtgctgttactgtcaccagcggcatcatccaggcagagctgcggacaaggtggcggcgggtgagggtggtggtttgagaacggctgaaataaaagaatactgatttattttatataaaaatatgcttttatatatgatgtataatatacgtatatcatggcatatgatacgtgtatatcatatagcacatatcatatatatagtcagcaaagaccccaaaaggggtaccgagc

SEQ ID NO: 556596 - DNA, 163 bp, Homo sapiens
tctaaggatccccgcgctagcgtgcattaagtgacggtctgcctatatccgagaaccgggggaattcgggggaacccccccatgacgaggggggaacctcaccctccgttcgtcaagtgcgggcggtgcacgaggcgggtgtggacgatgtagcctgttcact

SEQ ID NO: 556597 - DNA, 281 bp, Homo sapiens
atcgccgagaagaatgagcggttactggggtcctcaaggctcttcaaagagcttggaatgcttgtcaacacagggcagctgcccgcatgttcgccaagagaacatgcgggggccctaagagcagatagcccaaaacaatctcatatgaagtaacagtagcaatcataatactatcagtactcctaataaatggatcaatatactctaataaccctaatcacaacacaagagcaatttgaataatctaaaaatcctgaccactagccataatatgatttatc

SEQ ID NO: 556598 - DNA, 510 bp, Homo sapiens
gcaaggaactgtaaaactggataataaggtgattaaattctggtgatcattagcaagtgaataccataaattattttatattatctgagttcagttttatgagagcttcagtttcaaatgaaagtagccagagatggaaaagtgattatgaaatttcttttgagaatccttatgatccgccctatcctgcacttacacattaagttgaataatgtagagacctaaaaggttaatgaaactcccattgtatctaggtgaccagtctgaaataattttcctatggaaattgataacctatgtacatgtgataaattaattaaatgcttactctgatcacaatttttttcatgatacaattttcagaagttttctcactaccttacattacctaaaaaatgtaattctgtgtcttgtgtctttcccatttaaattgaaaaatactttagagttgaattctacaaagcatcaaaataaatattctaaataaatgtcctgtctgaaattaaaaaa

SEQ ID NO: 556599 - DNA, 112 bp, Homo sapiens
tgcttagaggtcgacgtgtattcaccagtgcgtgtggcttgcctctcgctgtacaagttccgtcgacaagtgagcaccgtgctgacctccaaatatcgttaagctggagcct

SEQ ID NO: 556600 - DNA, 173 bp, Homo sapiens
taagacaaggtcatgcatgaggtagtccaccgcgctagcctggggtctccgccagcagaggcggcgccccaggcgctgtgacctggatgtcataggtgtctacagtgattctagggagggcttccagctgcagcacggcgtaatccctcggatcacggctgcgctatggcggg

SEQ ID NO: 556601 - DNA, 303 bp, Homo sapiens
tgttgtgcagtcaagtcctcggcacattgtgaactttgggggatgtcgctccaacctgactgctgtcaccttcaccgtgccagtttttaaatcctgagtcaagccaaaacagataaaaaaaacccaaaccaataaaaaaaaaccaaattaagcctttgccattctctttttgtttccggcccattttgtcgagattgggggattcctctaagagtgccagcccgggcgggcttagagggctggggcatgggccgggtcggtttaacagcgtgtgggagctggggagaaaaaggcgtaggggcc

SEQ ID NO: 556602 - DNA, 426 bp, Homo sapiens
caggatcccggcacgagcgcccaagtttaagtacttattaacagaagtatcaggccagtgaacaggcgtcgggtatgacatgcgataattaatagagccctcttgcgatagatgatcggatgtgatccagatcatgtgctgggaggaccctccaggtaataatgtgctccctcccattgacagtgccttacgaggtaatgacatcacagctgaccatgaacagagtcagagcaaggctggagtgtgggagtgtgtcgtgaatgtctccctattgtgaatggcgcgggtgcccacaagaggcctgggcagtcaacagctttcttcttccataaaatcatgggaaaggagcttctaatgctaagtgtgaggggctggagttcatcccaccagcaaacaaacaaggactccatgtttttgcattgcaat

SEQ ID NO: 556603 - DNA, 368 bp, Homo sapiens
  misc_feature (368)..(368): n is a, c, g, or t
cgcggtggctcacgcctgtaatcccagcgctttgggaggccgaggtgggaggatcacctgaggtcaggagtttgagaccagcctaaccaccgtggagaaaccttgtctctactaaaaatgcagaattggctgggcgtggtggtgcatgcctgtggtcccagctactcaggagctgaggcaggaaaatcgcttaaacctgggaggcggaggttgcggtgggctgggatcgcaccattgcactccagcctgggcaacaagagcaaaactacatctcaaaaaataaaaaacaaaacaaaccgagccgggacactggcctgcatcaccctggctttctggaagaaggtgtgttgagggggctggacacgggn

SEQ ID NO: 556604 - DNA, 806 bp, Homo sapiens
gaggcaggagaattgcttgaacccgggaggcggaggttgcagtaagccgagaccatgcttattgccctccagtctgggcaacaaaaatgaaactccgtctcaaaaaaaaaaaaaaagtgggtcaatttcgtaacagttttattttgggacacaccctgtgaagccttgtggtttggaatttaagaaacgtgagtttccgggaattggacaaaccatttgtgttacccagctgtgtccggggctattggaagaagattcacattttccggcgcattccactttgttggcagtccaagttccttcttagttgcaaggcaattagaaattattaaagaatttattaatgcacggttgactacatttttatgggagggtgcctcaaggcaaagattagttgaattttattattgacggggtgtgaacggtattttccttaacctactaatagataggttaaggttaataacttggcattttaataatggagctttctcattctgtcaaatggctatggttttctttaaagttgtttccaatttctagatttatccaccttggtttttttttatgtggtttacaacccattaagtttgtaattatgggtgtaaagagtccagtcatgggctgggtcaatttacccttttggagagtccacagtggtacgtcagagtggttacggtcttcctctagtactaccagtttcataattgtttactctttatgtaattggtcctctagagggcagatcatcggttataggggttttgaaccagagttttgaaggtatttaaacatacgttatataa

SEQ ID NO: 556605 - DNA, 114 bp, Homo sapiens
cctggggggcctgttgcgggggcggggcgggcccgttgcctttggcggctcctggggggctgtggccatgcggtccccctcggttcgtgctgcaataagggccttcttctctta

SEQ ID NO: 556606 - DNA, 415 bp, Homo sapiens
gaatacacagacacatagacgccgcttgtcatagatagttctggtacaaagaaaactaacctgtgtgatagaattcctatcaatggctgccatctatcgtgagtgaaaggaactgtctgagcaggtttactagagaaccttctggggtgatggatatattcttaagcttgactggagttgtggttacatggtgtatctcaatttatcaaaactccactgaattgtactatttaatgtaggaacatcttattgtacattaattacaccctctattatgttcgttttaaaacatattagatacatcagctggaaatcacttggttttaacaaaaaattttctctgtgatcttatttattctagcacttatcttcttgtcttctatagcaatgcaatacttcactaatgttagagata

SEQ ID NO: 556607 - DNA, 379 bp, Homo sapiens
  misc_feature (89)..(89): n is a, c, g, or t
cccccccccccccgggcttcctgctccttagcaagggggcagctttttcctgttttgggtgttacccttggacactccagctcggggantgtgggggggtgagggggcaaattcccctgtgtggtcgaccctaaaaactgtggcttggaagtgatgctccatgggacgacgactttgctttttttccttttagggggggggggatttgtagatcccccccgcctatgtaatgtaaaaaatggccctttaatttattgctatgggagccccttgtatttgttaatggcccaacccaattttaaaaggttgcccaatgtatattttgttgcttaaatgggtttttgcagaaattgccaataaataacatattttgggtcca

SEQ ID NO: 556608 - DNA, 412 bp, Homo sapiens
  misc_feature (62)..(62): n is a, c, g, or t
  misc_feature (102)..(102): n is a, c, g, or t
  misc_feature (152)..(152): n is a, c, g, or t
  misc_feature (156)..(156): n is a, c, g, or t
  misc_feature (337)..(337): n is a, c, g, or t
agtcttacgtgaaatatcctttgaattgaagcagaggaagttagacacagacacaccatganctccggattcatcaactgcagtgagagtaatggtgggacnagtgagccagtgtctgtggacaaagtcgggaccttttttcgatatgcagnaccngataaaaatcatcttcctctacgattggcagcccagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacnccaatggaactaagactggatagcccatcagctccagacagtatgttttgattgtctagcatatagtaaatgctg

SEQ ID NO: 556609 - DNA, 266 bp, Homo sapiens
ctcacttatatgtcaggctaccaaattttgtgttgctttattgcactttacagatactatttattacacactgaaggttggtggcaaccctgtgtcgaggaagtcttgcagtgccgtctttctaacagcatatgctcacttcgtgtctctgtgttacatttcggtaacagtattttagatgttttcattattatcatatctgttatagcgatcagtgatctttgatgttactcttgtaattgcttacaacctcactgatagaagag

SEQ ID NO: 556610 - DNA, 358 bp, Homo sapiens
aattttaagtaggaaagtccccccaacccttttgctttcccttaagtgtttgggccgccatactgtaggaaccagccaggtcctggtactgtgatattttaaatatcccccgcactccctttttcccaatgatcctagtaaatgcctaaaaatatctttctcttacctgttatttatccatttttccccgcatttttatccggaaaaaattgtattgcaaacccttagtaccccggtgataaaaggcatttggtataattatggtgggtgattattttttaacccgtatgggcccaagctttacctctgtggaaaggccaccgttttaataaaagatttcccttcccccaaaaaaaaa

SEQ ID NO: 556611 - DNA, 93 bp, Homo sapiens
gatttggccctgaattactatggttcggggagtcctcatctacagggtgcttttgatgtctggggccaagggacaatggtcaccgtctcttca

SEQ ID NO: 556612 - DNA, 315 bp, Homo sapiens
agaggacccgcgtgtgtcttgcagatctgtgacgttacccccaaacctgtgctctctgaaacatgtgctgtgtcactcagggttaaatggattaagggtggtgcaagatgtgctttgttaaacagatgcttgaaggcagcatgctcgttaagagtcatcaccactccctaatctcaagtacccaggtacacaaacactgcggaaggcctcagggtcctctgcctaggaaaaccagagacctttgttcacttgtttatctgctgaccttccctccacatatgaccctgccaaatccctctctgcaaggaacccacg

SEQ ID NO: 556613 - DNA, 1090 bp, Homo sapiens
  misc_feature (582)..(582): n is a, c, g, or t
aatacatttcctgattttaaagtattctatttttaaatatatcttcacattcctgtagtaaaagactgcaaaaaaaaaaaaaaaaaaacaaaaaaaacggtgttaaaaaaatggaaaaacatgacccggtttggaattgggagtggggatgaaggaccggggacgggttcccggcccaataaaagtctggcccctttttaaagggtcccgttttggggctccttggttttttcccctttgattaccccaccgggtacaaactttgggtttgggtcacaccccggaaattttagtttcctccactgtgggaatcctggctttggaaagagataaatcccttcaatggtactcctggcattgttctaaccccatcctggggggtttaatctaatggcaagaccagactttcattctcctgggtggcatcctccttttcatggtgtcttcaattccgcaacctttttggttcaccttgggaacctcttctcggaattggtgcggctaaaataggatcacctgtggtgcaccctctttaggtacaaaggccttttgccacagacaacttggcacctctaccttctngcctctctatttgaaaacattcccgggaaagggatgctctccaacggggaagagtgaccctccttccctgggaaatctggagggtatttttcaccagacttcggcggaacttctggcgcgcttaaaaattcctccctctccttgtccttaccacaggcacatttcgcaacatgggcatcccccactctttgaagaaccggtcaaacctttaagaaatacggcttaatacctccttattatggctgttaaacccccataatgtttgttctgaaccttccttcacagatgtccagggcctgcaacacacctttctacactcgacacacacatcacaaacacaaagggggggcctgaatatcccgggccaatatactctcccctttgtaaagtcccatagcgcataaaacagccggccctacaccgatggaacacgcgtgtcaaccctctgcgcatcgaccccacactcagataatctcgtgccctgccgtcttatcatgtcacacctctc

SEQ ID NO: 556614 - DNA, 306 bp, Homo sapiens
  misc_feature (155)..(155): n is a, c, g, or t
  misc_feature (268)..(268): n is a, c, g, or t
  misc_feature (297)..(297): n is a, c, g, or t
ctacaggaccctttatgttataagtatgttgaaattaaaggtattgggctgggcctggtggctcatgcctgtaatcccagcactttgggaggctgacatggcaggattgcctgagcccagcagttcatgactaagcaacatatggcagattcttngtctatataaacaaagtaaacaaattaacgtgggtgtggacagtgcattacttctcagtcccaagtccactggcagaggctacggacagccacgtggcgaggctatggacagnccactgtgcgacggctaggacgggtactncgagctcga

SEQ ID NO: 556615 - DNA, 423 bp, Homo sapiens
aaaacaaagaaataaaaaaaaaggttaagcctttcttctggtacgggggaattccccagctagtctttccagtaattaatcctactttttctaattccccatctctgccatgggccatccagtggatgagggcttcctggtaattttaactagtacagcttaatatagcatttcccaatagtttgtccaccggtagaaataagtaatggcttttctgggactcatttgggataacctcatttccacagggagtgctggccataaaactaagcatatctattgggtagatagagcagagagggcaagcacagaggggaccctctctctctaacacccttcagaattatggggacgctccataatgggcggggaatctggcggagcaccagcaggggtcccgagctcgaaatccgaactcagggc

SEQ ID NO: 556616 - DNA, 165 bp, Homo sapiens
ctctcactacagtcttcggggtaaattttagtttatctgatataaggatggctacccctgctttcttttgaggaccatttgaatggtaaatggttctccaaccttttattttcaggctgtaggtgtccttctgtctaaaatgagtctcttgtagacagcaaatag

SEQ ID NO: 556617 - DNA, 779 bp, Homo sapiens
gggccctagcaggactctggcttagtgagagtctctgtttcccccttttctttctttccacccaataaaaccgggtcttactcatcattcaaatgtctgcgagcctgaattttgtggccgtgggacaaagaaccccgtctttaacggaactaaggaaaagccctgcaaacaatttgggcgcgcaacgtggggacttgagaagcgactcgctctgtcacccaggctgaagtgcaatggcacgatctcagctcactgcaaccttcaccacccgagttcaagggattctcccaccttagcctcaaagtaacctgagattccagatggcccattgttcattaactcaagggctctaaaagggccttggaaggtttagttaaaccaagttgaaccaccggtaacatacaacgcaaattagaagcagaaacgccgcgaccggcaagtgagtaccacaaaacgcccacaaaatgtgggggcccaaggggacccacgggaacggggacaaagggcaaataaacaaggtaagagagacatacacgcacgcggcaacaacactcataacgaagagaacgaggccccaccacgcgaacgggcacaacccaacacaatgggccacaatgggggacaaaacacagaagcacaaagaagacgtccccacaaaaacaggaacacacaaaacaaaacaaaggccgccgcccgcccacgagcacaacaatccaacgggcgggcgccgaaagcgacacgcacccgacacccaacgagccggacggaaacacaccaca

SEQ ID NO: 556618 - DNA, 233 bp, Homo sapiens
agaagctcccacctggcccggaccctcctccctcctccctcctctggcggggttaaaatctggattgaaaaagcaagtcggggtttgttggcctctcaaaaagtggagcataggccgggtgcggtggctcacgcctgtaacgccagcactttgggaggtcaaggtggcggatcacctgaggtcagaagtttgagaccagcctggccaacatggtgaaaccccatctccactaa

SEQ ID NO: 556619 - DNA, 195 bp, Homo sapiens
gacgtaatgtgtgcgtagtctgcatgcacataactaatgaaagcagaactatgccactggcttctgggtgagtaggggaaaggaactgcccttctttgctgagtactcatcaggtgctatgttcagtgccaggcatttcatgttcaacatctcatttactctgtgaagactcataactgtaaattctcctcaaca

SEQ ID NO: 556620 - DNA, 1277 bp, Homo sapiens
  misc_feature (615)..(615): n is a, c, g, or t
gtttgtattgtcggtagcgatgtatgtcgcgtcttcgcgttttcccggcgctgcccagcgtgttgtgtgtgcccgtccgtcctcttataagtgccgccccacctgtgtgtccgataggtccccccccccccctccgccggctgggggggctccccacatagtgtggtccctttcgctcgcccgccgcagggttagtacgttctggttggaagatcgctgttggcgacggcgctctagtttggggtatggttatatatcccggccgcctgctgcgcctgccggttcctagttggttcgttgcctggtactctccccccccgtgtgccccagtgagaccccccgtcttttgggtcctcttgctaccgcccgccctgtgtgcccccgtggggtgaacgttgaattccgcccctttattttgttagcccctattaagaatttttattaacaactcaacgaccgttcacacaacgtctttgccgccttttatctggcaccccatatacaccgcccggtagacgcgttttgaaatattcctcgcctttcccaatatcggcgaaataacactccgtgtcccaagattcgacaacgccccacaaatataggcccccccttctntgtgaatgtgtacacccaccccccattttcttccatacccctataacctcgcccctttggagaagcgtcttccaacccggcgcccaaagtcccattttctccataaagatttccgcccctccccggacattttacaatcctcccatatacattatatttctcgcgctttacgccaacatcccaaatctatctcgcaaacgccactcttcaccacttttcgccactcactaaatgccttcttctcacaggaaactctcccaaaacttttaactcccaccttaatagacttttttgtaatgaactcttctagccacagaccctcgcctataacctccccttatccccccacctatttaacacctatctgggagaaacttcttctgtgttatgtaaccaccgcttttcctgattcacaaatattcacctttcctaacttaccacggaactcacacacacatatctatgtcacacgccctatactccctttaacatatttaccacccaacacacacatggggctcaactcacccacccaccacttaccacacattaaacccctcacttcaccaccgagaaaaacacccctcaatgttcatacaccctatcccccattttcctcctatccctcaaccccgacaatcattaccgggttttcctcttta

SEQ ID NO: 556621 - DNA, 164 bp, Homo sapiens
accgctttcctgattccacttcctgcttcccccttaccacatggaaatgtgcacacccactcacactcactctctctcacactgatcagcaaagtattgacattcacactcagcactgattctcactccagatactccatttacaggggatcctctcagagtcg

SEQ ID NO: 556622 - DNA, 692 bp, Homo sapiens
  misc_feature (692)..(692): n is a, c, g, or t
agcggagcggcctgcttgtcccggaccgcgggctacgtgatcgtgagctccgtgtcttgggccgtcaccaacgaggtggacagaggagctggacagatgccatccactgaggaggcatatgcccagacgctgcatagaggattcagggcagacatctggcagacaaagcttttctccgagcatcatgcccacaaggaggacgcagcaccatgaggaccccgaggcgggcgccgcacacgggccaggcagaacccaccggaccacacaggagatgatactccgtacacggcgacgaggcgcaggccacagacggccaagatgcagacacccacgagggcaccataagaacatgtcgcagcctgtgcccacacgacacagcaatcccccatgagccacaactgcccaagacagtcaatgctgagtggatatagcaccttgggtccactaaaccaggttaggttcccgacaacccaacgcatatgcaacgcaaatacctaacacggaactattggccccaagtataatgccgtggacaaccattagcaacaatagccaccgtcgttcaatggttggattttgtggcccccacattttcacaacacccacagttacaggccacattggggaattattcacgatatttatcattcctaaacaagttgcaaaccagacacaacaggggaaacgcaacn

SEQ ID NO: 556623 - DNA, 949 bp, Homo sapiens
  misc_feature (50)..(50): n is a, c, g, or t
  misc_feature (76)..(76): n is a, c, g, or t
  misc_feature (78)..(78): n is a, c, g, or t
  misc_feature (93)..(93): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (188)..(188): n is a, c, g, or t
  misc_feature (200)..(200): n is a, c, g, or t
  misc_feature (246)..(246): n is a, c, g, or t
  misc_feature (293)..(293): n is a, c, g, or t
  misc_feature (297)..(297): n is a, c, g, or t
  misc_feature (301)..(302): n is a, c, g, or t
  misc_feature (304)..(304): n is a, c, g, or t
  misc_feature (307)..(307): n is a, c, g, or t
  misc_feature (314)..(314): n is a, c, g, or t
  misc_feature (320)..(320): n is a, c, g, or t
  misc_feature (333)..(333): n is a, c, g, or t
  misc_feature (335)..(336): n is a, c, g, or t
  misc_feature (352)..(352): n is a, c, g, or t
  misc_feature (393)..(393): n is a, c, g, or t
  misc_feature (406)..(406): n is a, c, g, or t
  misc_feature (419)..(419): n is a, c, g, or t
  misc_feature (424)..(424): n is a, c, g, or t
  misc_feature (431)..(431): n is a, c, g, or t
  misc_feature (433)..(433): n is a, c, g, or t
  misc_feature (439)..(439): n is a, c, g, or t
  misc_feature (441)..(441): n is a, c, g, or t
  misc_feature (454)..(455): n is a, c, g, or t
  misc_feature (460)..(460): n is a, c, g, or t
  misc_feature (466)..(466): n is a, c, g, or t
  misc_feature (472)..(472): n is a, c, g, or t
  misc_feature (480)..(481): n is a, c, g, or t
  misc_feature (484)..(484): n is a, c, g, or t
  misc_feature (487)..(487): n is a, c, g, or t
  misc_feature (510)..(511): n is a, c, g, or t
  misc_feature (513)..(513): n is a, c, g, or t
  misc_feature (516)..(516): n is a, c, g, or t
  misc_feature (536)..(536): n is a, c, g, or t
  misc_feature (540)..(540): n is a, c, g, or t
  misc_feature (551)..(551): n is a, c, g, or t
  misc_feature (554)..(555): n is a, c, g, or t
  misc_feature (557)..(558): n is a, c, g, or t
  misc_feature (560)..(563): n is a, c, g, or t
  misc_feature (582)..(582): n is a, c, g, or t
  misc_feature (618)..(619): n is a, c, g, or t
  misc_feature (638)..(638): n is a, c, g, or t
  misc_feature (687)..(687): n is a, c, g, or t
  misc_feature (704)..(705): n is a, c, g, or t
  misc_feature (708)..(708): n is a, c, g, or t
  misc_feature (711)..(711): n is a, c, g, or t
  misc_feature (717)..(717): n is a, c, g, or t
  misc_feature (719)..(719): n is a, c, g, or t
  misc_feature (721)..(722): n is a, c, g, or t
  misc_feature (728)..(728): n is a, c, g, or t
  misc_feature (731)..(731): n is a, c, g, or t
  misc_feature (738)..(738): n is a, c, g, or t
  misc_feature (753)..(753): n is a, c, g, or t
  misc_feature (793)..(793): n is a, c, g, or t
  misc_feature (818)..(818): n is a, c, g, or t
  misc_feature (821)..(821): n is a, c, g, or t
  misc_feature (833)..(833): n is a, c, g, or t
  misc_feature (835)..(835): n is a, c, g, or t
  misc_feature (839)..(839): n is a, c, g, or t
  misc_feature (845)..(845): n is a, c, g, or t
  misc_feature (871)..(873): n is a, c, g, or t
  misc_feature (879)..(880): n is a, c, g, or t
  misc_feature (931)..(931): n is a, c, g, or t
tttcagcaaagttattgcaacacgatgaaaatgcagacacactattacangctgtaaagtaacatatgagttttananaattaaaatattaanacatacttatgggatttgttgaatgactaacagacccataaaagcanattnantgctgagagcgaacatgccacgtattagcacctaacaatatnctcctcgatcangttgaaacttttgagatgggtttactctctcctaatgtatttttanaacctctctcccaaatacagcgctctcacaccccaaggctaaccggncggngtgnncngcnccgatcntagggncgtcccgccaaangnngagctacaaatatggnctcagacttgagagttttactgagaagtaacttactgtacntgagccaatcatnagatttctgtgcnctgantactgtntntgagancnttctgtgggtcannaggtntgcctnaggganagttaacnnttngtnatatacagtattattcctatccnntngcntctcatgagtcatatttatnacanaactataattnggnngnntnnnntgcctgcttattccatatngagggacacagcgggaacatttgtgtgtctgatggnntggcatccactttattgtncttactgatttttgtgatgaacaagcagcacgtatcatatctttccaanattcaaggttatggaannatnacntaaaantntnnataganatntatgganattgaattaaataangatttaattaggaataattgatataataaaaaaaataaanttataaatttttttttaaattagantangtttgggggtangnattnttgatnaagatattaagatttgagtaatggtnnnaaagtnnttatttgaaatatgggtggtgaaaaagaagaaaaagaaataaataaaaatnttatggggttaaaatttt

SEQ ID NO: 556624 - DNA, 348 bp, Homo sapiens
  misc_feature (43)..(43): n is a, c, g, or t
  misc_feature (78)..(78): n is a, c, g, or t
  misc_feature (107)..(107): n is a, c, g, or t
  misc_feature (143)..(143): n is a, c, g, or t
  misc_feature (233)..(233): n is a, c, g, or t
cttgggtctgctctttgaagacatgctgctgaatcaaaattanggatgcttggagggcctggcgtgattgtcacgccntgtaatccccagcacgctaggagagaggncggaagaattgcttaagcctaggagtttgaaaccancctgggcagtatagcaagccctgtctatacttaaacaaaaaatacagccaggcatcgtgcacatgcctgtagtcccaactactctggagnctgaggcaggaggaccactcgagcccagaagctcaaggcgtgcagtgagccatgatcacacgactgtacctccagattgggcaactgagtgggagacctgtctcaaaaaaaaaaa

SEQ ID NO: 556625 - DNA, 208 bp, Homo sapiens
ctaccccactcaggctgggcatggaggggcagcgtaggtctggcagcggttgtgtgcaggctaggtgcgtgaagatctcaggacatggtgtccacgagcatctccagcccaggttgctcggttatatccactgtgtagtcattcgccagctgcagggaggccagcattgacgcgacacacctcgaggccggctcgagccaccagtccg

SEQ ID NO: 556626 - DNA, 391 bp, Homo sapiens
tggtagggacaaattctccacttgataaccctttatggagcatttcctggagcttatggcaaaagcctgtgggcccctcccagcaacaaccactgggactttggactaaagaatttccacttgaagggcatttactgactcgcaatgaaacatttactgaagcccccccactgaaacctgaaataggcatgctgtttcagatgatgtcaaaggaacattttaatggggatggcagggcccagaagagttccatgacccaatggaaatggtttataaaggatcatgctactcaaggcatgcaaagaattttttttcccctaggactgactttggaactgtgtgagaaactgttggattttacagggccaaataaacaactttcccctgccca

SEQ ID NO: 556627 - DNA, 150 bp, Homo sapiens
tttgcacgtgggtgttgcacctcacgtgtctcgtgtcgcacaagcatgtgtaggtgtcctgctgagctctttggtgggcggcagtgatcctcgaggtcacgcatgtcttctgcgggcacagacacccacatgcagacacccacgtgcaga

SEQ ID NO: 556628 - DNA, 325 bp, Homo sapiens
ggtaagtacactaatgctcaggcggggcacgctgctcgagcctgtctccagattgtgggtcctggccacgatcgacagcctaaaagcgcagcacgtccaggtgcgctgagcacatcatccgcatcacggaaccccaggccgatacacggccgcccgtttctcccggggctgcgtctcttccacgaagcacaacatgaacagcaggtcctaggcatgccgttgcaccgccggccagcacgcgagctcccgggtcatgcaacgtatagccgtgcagagcgctgacgttccctttgctgatcccccctatcaggctggaggccacgaa

SEQ ID NO: 556629 - DNA, 1568 bp, Homo sapiens
  misc_feature (1518)..(1518): n is a, c, g, or t
  misc_feature (1568)..(1568): n is a, c, g, or t
gtgtcccaggtgattcggacattgtactgtactggaggtgatgggcagggctgtgggatttcatgaacactcgtaactggagaagaggaagagatgtgatagcaaagtattctaagtgagagttaagtcaggaacgagtggaaggttctgcatgaggggagtcataagggagattggagaaaggtactgtacgaggttagtgctgtttaattcaacgcatgtgatgcatataattctgccgtataattcgggcattaagagtagaattttggaaaagagcattgttctaatattgcaaattgttcatatcataagtgtctaaacttagagacactggtcctgggctaaagtccaccatttcaaaggcccttgttaagcaagtttcatgtccagtgagtcgcatatcgcacgacagtccactcccgcgaggggcacatcagaccctattcttaacacgtgttccatttggcagcaccgctaggcaaaacgcaaacggacgaaagacggggatacttgaactcagactcacctttagggcgtaaggctacacgccaggattttaaaattttcaaggggtagggcctctgtgacggtttctcacggaggtttggcaaggaggtccattaacagataaccgacgtttcgaatcctttcatcggggcggcgtggataccacactctcttgtggtggggtctgctacggcctacactttggtcgggacttcccttccttaggtccacaccttctgtgcggccgttacaggcggaggaggtatgtacgtagaaagccggtcttaacctatatcacgggcgctgtaacaacgcgtaccgtctccactgtcgtgtctcgcataatcggaagacctcgtacttggcgttacagttaacttccgaaccggcgttccataataggcgacgggaaacacccgacaagtttgtggctccaattaacactgtggtagcggcttcgaagacgcgttcataactatccttgtagccacttatggttaatacccctacgggagggatgaatcgtgaatgcagacctctgagtaatttgtgcctccagggcaacgggccgctacaccacgacacacgtgtttgtggccgccacgaaattggcacataagggggcggcatatctccgctgaaacagatcatgtgggaaggccacatatgtgtaggttccataataatccgatgtggggcagagccccctattattttcaacggaacgagactttgtgtctacattatgggatggtgcagaaacccgttttttcccctgggaacgggcacagacaaaatcggtctcattccacgaggcgacactggttttggggtgtcatcgttggagggaaaccatcgctttaagcaaaagcggcaccaacgagccagtctaacagcagcgtgtcatcacgacgactctcccgacgaaagggtgtgcgcgatcgcaagcgcttagatgctggtcgcgaacaacatgcgtgcagcacatactgtcgcggtatgttgcgnccagccaatacttacgcgacggcgaacatcgaagaagtgttttgtctgcn

SEQ ID NO: 556630 - DNA, 1060 bp, Homo sapiens
cattagtagaagattattctcaaaatgttgctgtgcgcctaggacatatggcatgcatgttagaaaatgaatgtgaagaccccagccaggagactattcacgttcctactataaattgcatctaaggtgattcttggtcctaaaagctcatggctttaatgcagcaaggcttgctaatctcccagaggaagttattcaaacagggacatagaaaagcacatgagaattctgacgagctgatgaatcagtcactacgattatcttcgggaagtttgcctggctagtgacaaggtcaactgtagatgctgaagctgtccatatattgctgactttgattccggcattcaatagactgactacacttggaacgctttgagcttgactctctgacaccggtggtagatattcaggacaacatcagtgatctagttaacaactttaactcctcgttagacaagactgcaactaaataacataagaatccacgggggaccaacaaccacttctgccgcccactccttgctccaccctcggactctcttatattaccaatctaaattgtactcgaggctcagtccccaccacacgattccgaaggattgagacaacgagtgcaaccaaaccggttttcctacgggaacagaaacacagccggagcgcacatcagatgacggacactagcgatttccaccacgcgggcttatctaataccccaccacaggcatgtacaccacacaggcaccatgataccataaaacacgcaacgaggtaccccccttgcacgaaagcgaccggtttaccaagagaactgccacaaacccaccgggggaactaaccaaccaaccacgccgggaccgaagccacagcgaaagaagagaagcacgacccgcagcaacgagttagatacaattacactatcgcagacccacacgacagccaccgaagcagtagagacacacaacaaccactgacacgcaacacacaccacataccacgtcgcaacaccacagaaacgactagccaggaccacgacgaaaacaccgacataagagcagcacag

SEQ ID NO: 556631 - DNA, 170 bp, Homo sapiens
accggtctgcatgcgctgagcagcacagcgccattacggaggcaacaatcatttttaaagaggcagggcgggacgcaatcatgtatttcctttgggattggacatagacaagctgaatgcagaacgggtgggtttgtgaatgaaaagcctgtaaaaggcgaattgcacaa

SEQ ID NO: 556632 - DNA, 270 bp, Homo sapiens
  misc_feature (213)..(213): n is a, c, g, or t
agcggcgtgccttctggctcagcagtctctcgcttagctcttgagtgggtggacgaagaagtgtgtgcgcagtgctggctaattttgtgtttttgtggagatggggttttgccgtgttgccctgtgctggtctcgaacccctgggctcaagcaattgatgtgccttggcctcccaaagtgctgtgattataagtgatagccactgcgcccggncagaacatttttataaacccagtgccaagctgagagtctgtccatgggtaccgagct

SEQ ID NO: 556633 - DNA, 399 bp, Homo sapiens
agtactacacggactctggtgttgttgcatctctgcccagctgggcgatcctcttcgcaagcgtccactttacaccctctgtgttcttgctccatcaccatctggtccagcacatgggcatcagccagtcctcaacacttgcagtcattctcatggggcaccagccggtttccgatcctcttgatcccgttctcccggagctccttccccctgcaggctcaactcgcccaagtcatgtgggcgcccaggcactttgcatgaggtcttcctcctatgcctgcccagcttgtggtccaccacatcagtcccaccatgtctgttgctgccataaggtcagcgcaatggtctccatggcatgccttgcaccttgcattgcagggttgggcttgtattatcccc

SEQ ID NO: 556634 - DNA, 404 bp, Homo sapiens
gtcagggagtggtgcggcgctgcgaacaaggtggtcgattgcgccatcacctggttcgctgtcgggctattcggccaagtggtacgaagtctcgaccacctggtggcgctgccgatcaactggaaccagcagatccacgccgtcaaccagaaggcctgggacaaagctcgatacgaacgtgcgcacccctggggtttctgggtatcccgagttccactctactgtaactttaattgctctgtgataggtagctaccttggggaaggattagtgaagaccggttatggtcaaggtgaaactcttgcctcgtccactccggcccacaaatctcagatcgttgaaccttgctacttggtatttcataacagcagaggcattccggagctcagcagacataattttca

SEQ ID NO: 556635 - DNA, 804 bp, Homo sapiens
cggggactcgccaagcggcgagtaagaggaaggccccaaggagccaggtagatcctccgggccacgcaagtaaaggactgctggcaagggcgcaggagatggccatacccccagttggtgcggggccataatccaagggggccgtgtcccgcggtgcatgcccgccccgatgacctacaggcgccccgacacgtaccgcaaccacatgccgggccagtccgccctaacatgcgcggcgccccgtggtatgatccgcgcacgcaggccaggaccttgcacgctggccagatcccatccaggggccaggcccccgcagcagcattacggccaggacagatgccccgcatgcccagcgctcattcatgagaatgccacacggagagtcacatctgtgttcctgcaccaacctgcacaagaggagaccaaacgagctcatgcatgtccatagctttatcaatcagttccctggtcttcaaggaggtccgtctggtacccgggcggcatagacatcgccttcgtggagtttagacaatgagagtacaggacaggggcagcatcgcgatgccctgcagggcatttaagatcacgcagaacaacgccatgaagatctcctttgccaagaagtagcaccgttttcccacatcgcttgccaccttcccaatgttctggggccacgcacgctttcccccattggctcagccctcctgaaggtaagtcccaccttgggggccttcttggagccgtgtgtagagtgagtggtcgcaacacagcattgtacccagagtaagtccccgggacatgcac

SEQ ID NO: 556636 - DNA, 212 bp, Homo sapiens
tcctttctttctggttgaggtagggctcttaaggtacagaactccacaaaccttccaaatctggaggagggccccatacattacacttcctcccttgctcggcggtggattgcgaggcccgtccttcgacttctgaggctggatttttaactgtccagactttcctccaactcatgggcgccacgggtgtggcgctggcagtctcagcctcc

SEQ ID NO: 556637 - DNA, 343 bp, Homo sapiens
  misc_feature (295)..(295): n is a, c, g, or t
agacagaatgcaaacaactttgttagaatacttgttagaagggccgggcgcagtggctcacgcctataatcccagcgtttggggaggccaaggcaggcggatcacctgagatcaggagtttgagaccgccagcctggccaacatggcgaaaccccgtctctaaaaatacaaaaattagccagggcatggtggcacatgctgttggtcccagctacttcaggaggcttgaggcaggagaattgctttgaacctggggaggcggaggtttgcagttgagtttgagattcattgccantgcactttcagccggggttaacaggagcaagattttttgccttaaaaa

SEQ ID NO: 556638 - DNA, 1202 bp, Homo sapiens
  misc_feature (50)..(50): n is a, c, g, or t
  misc_feature (75)..(75): n is a, c, g, or t
  misc_feature (241)..(241): n is a, c, g, or t
  misc_feature (249)..(249): n is a, c, g, or t
  misc_feature (488)..(488): n is a, c, g, or t
  misc_feature (584)..(584): n is a, c, g, or t
gcggcgagtgggggcgtgcgacggttactctggttactggggccgcgcgnctggcgagacgccagcccgcgagantgcatggtgaggaagccgtcgggagccgccgccgccatctgagggaggtacctggaaaccaccttttatcggtggggaagtgcagtcgcggtgggggctctgggggcagcgaacggaggcctctaatctttaggtggggcccttttggggcccaaccttttggggncccccccncctgagaagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttntgaaagggcacctgctcttggtgagaaaagaaattatagcacgaagagccagtatcagaagagtatccatcacccgcagcaaccgctcagggaacnccatcaatcacacgacaacacctgggacatatctggatttcctggtgctgacggagtgatgcgagtcttgctcgtggagctgtatccagcaggcgattttacaatacttgctttctaatgccctatacaacttggcttcacatacttttacactaactttatatgatttttaaaaactggtctgattctggacttctcgtcccttgggacactgttaactggagtctggcctggctctccgttgctcctcttggtacctcatatcggggacgaaccttatacccactcgagcacataatctccgcttgaccggtgcaccaaagaagccttggaccatgtggacttttctgggcattgcccactttcacctatttatacagaagtcggggacttcatcacttgcgccaacagggaggtcctgtctgtgcgtgctggtgttcctctcgcctgggcctggtgctctccctacctgttgtctgccaccgacaacgggggtgtctccatcggggcagacaagcagacgcggtcccaagttacgccatcttcatcggatatactctcaggcctgcctttcatggcctctcctgtgccacatccccctgaatcgaacctagtcaa

SEQ ID NO: 556639 - DNA, 1161 bp, Homo sapiens
  misc_feature (50)..(50): n is a, c, g, or t
  misc_feature (75)..(75): n is a, c, g, or t
  misc_feature (447)..(447): n is a, c, g, or t
  misc_feature (543)..(543): n is a, c, g, or t
gcggcgagtgggggcgtgcgacggttactctggttactggggccgcgcgnctggcgagacgccagcccgcgagantgcatggtgaggaagccgtcgggagccgccgccgccatctgagggaggtacctggaaaccaccttttatcggtggggaagtgcagtcgcggtgggggctctgggggcagcgaacggaggcctctaatctttaggtggggcagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttntgaaagggcacctgctcttggtgagaaaagaaattatagcacgaagagccagtatcagaagagtatccatcacccgcagcaaccgctcagggaacnccatcaatcacacgacaacacctgggacatatctggatttcctggtgctgacggagtgatgcgagtcttgctcgtggagctgtatccagcaggcgattttacaatacttgctttctaatgccctatacaacttggcttcacatacttttacactaactttatatgatttttaaaaactggtctgattctggacttctcgtcccttgggacactgttaactggagtctggcctggctctccgttgctcctcttggtacctcatatcggggacgaaccttatacccactcgagcacataatctccgcttgaccggtgcaccaaagaagccttggaccatgtggacttttctgggcattgcccactttcacctatttatacagaagtcggggacttcatcacttgcgccaacagggaggtcctgtctgtgcgtgctggtgttcctctcgcctgggcctggtgctctccctacctgttgtctgccaccgacaacgggggtgtctccatcggggcagacaagcagacgcggtcccaagttacgccatcttcatcggatatactctcaggcctgcctttcatggcctctcctgtgccacatccccctgaatcgaacctagtcaa

SEQ ID NO: 556640 - DNA, 487 bp, Homo sapiens
ggaatagtgggacatctctgtactaactgtccctgtttcgctctgtcacatagacactactctacaacaaattcagtctacttataaaaaagaaaacaatgtactattactagatgcaaaattattacttcaaagaaatctaggtaaaaagaaagactatcttaatataattaggggagggacaggggagacaaggcctctctctgtcgctacaggctggagtgcagtggtacaaacacagctcaaactacctgggttcaagtgatcctccacctcagtctcacacagtgctgggattacaaggtgtgaaacaccacaactggacaaattatattaatttatttatttatcttttatcgaaacagggtcttgctaatatgcccaggctagtctatagatcctgggctcaagcagtcaatcctctggacttgagccttccaagtagctgctactacagatagacaccacaatgcccaggtcagaatat

SEQ ID NO: 556641 - DNA, 483 bp, Homo sapiens
  misc_feature (107)..(107): n is a, c, g, or t
ttcgacgggttctgtagtagaatctcctgtttaacagtaaaatacctgtttaaatgtctatttgggcatgaatcgtaaatgatgcagaattacaggggcatcaccanggaacctagatatattgtttttgagacagggtctcactgtgttacccaggctggagtacagtgctgtgatcttggctcatggcaacccctccctcccaagtagctgggattacaggtgcaccaccacgcccagctaattttggtatttttagtagagacggggtttcgccatgtgggccgggctggttttgaactcctgacctcaggtgattcaccggcctcggctgttgaaagtgctacgattacaggcgtgagccaccacacccagcctaattttggtatttttatagagatgaggtttcaccatgttggccaggctggtctcacactcctgacctcgagtgatccacctgcctcggtctcccaaagtgctggg

SEQ ID NO: 556642 - DNA, 666 bp, Homo sapiens
cttcccaaagtgctgggattacaggcgtgagccaccagcgcccagacctaatggtaaaatatattttagaactaacaaaggtgctagtggtactatataaaggaaaaactaatatattatactaagtattatctagaataggtctagtggactataaatattaagaacactagtatatatatacagatttagtatatataatatagggaccataatacccatttatgggctaccagatagtaatatatagggtataaacctatacctactaaagaataacaaggggtacagacacagggtcagaaggcccagacaatagaccgaatattggtaacgggatataatactaaaccccaaagggccagattatagtaacagacttaactaacctttaaactcacgacacatttatggggcctaattaaaggcgccacacaagtgggcacaaccacactttgggccaacaacggaggatagagttgcggcaaagttaaccataatacttactcaacccgtagtacagcacgaaggtgaattaaagcgtacaaattgtagtacagtaggcgtagcagttaagctccccggggcctcttaacaccgcaggagcaggcacacttgggacacgagatttaaagggggcaaattagtacttctaaattagcatta

SEQ ID NO: 556643 - DNA, 130 bp, Homo sapiens
cgcgttgcgtgttctgtatcgctttcactgtaacacagcaagatgcattttagaatctttatattacagttttactccctattgcctttgtgtctaccagtgatatcttcacccgaaagtgaaaccagcg

SEQ ID NO: 556644 - DNA, 366 bp, Homo sapiens
  misc_feature (86)..(86): n is a, c, g, or t
  misc_feature (217)..(217): n is a, c, g, or t
cccaggcgcaagtggttctcctgcctcagcctccagactagctgagattacgggagcccaccaccatgcccagctaatttattttnattttttgtatttttagtggagacggggtttcaccattttggcagggtggtttcgaactcctgacctcgtgatccacctgcctcggcctcccaaagtgctgggattacaggcatgagccaccacaccccgnctaattcttagaacattttctatgccccccccaaaaaaaaaaacaacttatgaaaaataaagatgtgctggcttggttttatgaatgaattcttaataaaaggatacaacacagcttatttatttaaaggtcaactttctgtaatgcgg

SEQ ID NO: 556645 - DNA, 392 bp, Homo sapiens
  misc_feature (354)..(354): n is a, c, g, or t
taccattccttctgaaactattccaaacaatagaaaaagagggactcctccctgattcattttatgaggccagcatgatcctgataccacaacctggcagagacacaacaaaaaaagagaatttcaggccaatatccctgaagaacattgatgtgaaaatcctcaattaaatactgggcaaactgaatccagcagcacatcaaaaaaacttacccaccacgatcaagttgggctttcattactagggatggcaaggctagtttcaacattacacaaattcaattaaatattatttccaacacattaaacaggaacccaacaacaaaaaccactggattattcttcataggttgncggaaagggttttcgggttaaatttccaccacaccttt

SEQ ID NO: 556646 - DNA, 284 bp, Homo sapiens
tatagagaatccccaagactcgctaagacgggcagaaagacgacaaggctgcgcaagtacagagtggcatggccagcacctgcaccattgcaaccaaaatggggactacctgacaagggaggtcactccctctactcactgagctaggattagggagggacattgccccaaccatcgcaatgcgaggtgcagagacaggctcagcctcctcattgactaaaagacgcctaaatgtgcgaagagcgatgtctgctctagagtaccccaccaccccgtgtttcaca

SEQ ID NO: 556647 - DNA, 307 bp, Homo sapiens
gaattgtaaaacatcatagtgaagtttgcttgttgtaaaggcctgagaatttttttttcagttggttcttctgcaagggttgtgatacctgcaaaggatatgtaaaatctaatttttcttttttttttttttggcaacggtcttagagaattaggcttgcaagaattaggattaaggtgcacctgagtgaaaggttttttttaaaattttaatcattccctaagggttggaaccgggggaatgcgtacaaacgagttctcactccgggggggggacaccgagctcgaatccgcaactcagtggccaa

SEQ ID NO: 556648 - DNA, 354 bp, Homo sapiens
tctagagttacctagggcttagggaggcgaatgtcattaaggcagcaaagtaatctctgtagaaagatggaggaggaccctccatagcctcagagataaaggcaaagatttgcccctctcagtgtccagaaagggaaaatggcagcttttcttcccttccatgtgcagccactccaattgctacactccgggattacccttcatcccttatagtagataacgagtgcttgcagaagctcgaaaggccagagatatcgcttggtgtggggttaaaaagttcagcatattcccagcaggcagctggtgttcccctaaagaaccctagggtaacccgaggcttcgaaatttcggtaa

SEQ ID NO: 556649 - DNA, 421 bp, Homo sapiens
gcgctgtgcgaattttgcacgagatattttacactccccacaattctctgtgtgttgcgcacacacacttgtgtgacctctttgtgctctgtgtccatttgagtcccacaacacacttacacaattatttttcacaagcaaggttcacagatatccacgtttataaatctgtgaaggggcgctattaatgccaataggtaattatttttggaacattatacttgagcccaaatgatctctttttcccttagaatggccagacacccgtgcctcgggcttctctaacgggtctaccgggtggtccacacatcagaaagagaaaggttgtgctgtgcattggccacctgtcatgaattccttgagagagtatatatttaaggtgggaggtgactgcgataagtgccaagcacgagttatttct

SEQ ID NO: 556650 - DNA, 1224 bp, Homo sapiens
tcaaaaaaaaagagcgatcaaaaaaaaaaaagtgtgtgtatataaaaaaaagagggcgggggagcgcgggggggggacaccccccgcgcgcggcccccccacacccggggggggccgggggggaggggggctcactcgctcggaggaggaggagagagagaatatacaaaaacacgcgcgcgcgcgcaaacacggggggaaacacacccctctctctaaaaaaaaaaaaaaaaaaggcgggggggggggggggggcgacccgtgtgtatctcccaccacgctcgcgcggcggggtggtgagatgaggagatagagatatatatttcttctttcacgcgcgcggcggagtagagtaaatatgatgtgtgacagagggaggcccaaaatatgtattacccgcggcgggcacccacacgccccgcgcgcggggcgctcaacacgacagagacaacaacataatctgtgaacaaaaacaaaaacacaacaaacacaaaaaacacaacaaaaaagagagggggggggggcgcgccccccccaacacaaaaaacaccactccccgcgagggggggggagcgacgacgcaccccaacaatagcctcacaagacgagacccacacaaaacaacggtaatcactactcagagagcgcaacaacacacgggggggcggcccacccaacaacaaaaacgagacagcgcaccaaaacactatcatacaaaaacagaaaaacaggaacaactgcgggcgagcgccatactcttatataacacaaacacagcacccacgggagacgcgccggtcgcagaaacaccacccgcgcacgagcaacccaccgaggaggcagaaatccatcattcataaggaaaaaaggaagacaacacacacattatctacaggcgtggaggagggacggaatcgtactaacaaaacaattggcgagggacacaccacacaccccaccaccccaaagcaagcgaaatgaactcataccgatccgcctacaatacgaaagatagactaacaacaatacatcactgtccgcctacactggcggcgcctatccattttcgtccgcctctgaaacccaccaccctacgccgcacgcttcataatctacggagagaatcgcacaaacaacgatcaacaagtattgtcttcgatcccgacgcaggagtggacgatcaagttccatacgacacgaggcgaatttattatccacaggggg

SEQ ID NO: 556651 - DNA, 520 bp, Homo sapiens
aaccatagaagcctacctgtgacaggagagacaacaaggcgctaattatcctaaggtcaaaagaagagtcagcctcacctgatttatattagtaatagaggacatgacctcaactcccacttactggagtagcagcatccgaagtaatgcttgaagtacccctgggcctctctataacatttaagcaaacttgtttttatagcagctcttaataataaagcccaaatctcaagcggttgcttgaaggggagggacaaggggcacgcgggcaaccactttaccctagatattccagacgcctgttaaaagcaaggactccccacaagcaacttctctgccacatcgacacccaggtaccttatgatctatcacagaaccttcaaccctcacctaacgatgcagccagtagcttggtaccttgtgggcattgatccataaatcgtatcaaggtaacgataggtgtcaaagtctataatgagagtaaattgggccggagtaaccaaactcaaattcgtaatca

SEQ ID NO: 556652 - DNA, 290 bp, Homo sapiens
tgtgttgcccagactgatcatgaactgctgggttcaagcaatcctcccccacctcagcatcccaaagtgctgtcattacaggcatgagccaccatgtccagccttttctttttttaagtttccttgttagtagacaaggatagctttctttttctttttcttttttttgagacagtctcattctgtcaccaggctggagtgcagtggtgcgatcttggctcactgcaacctcggcctcccgggtttgagccattctcctgcctcagcctccctagtagctgggactacag

SEQ ID NO: 556653 - DNA, 106 bp, Homo sapiens
agacggactcccctggccagtacggctgtggagaggatcttaagggaggaggtggtgctgggagtggtttatcttgttttctcaccatgcaatggagaatgacttt

SEQ ID NO: 556654 - DNA, 554 bp, Homo sapiens
  misc_feature (145)..(145): n is a, c, g, or t
ggggccaagggttctctgtcctgggttcaccgtgatttggctttcccggtcctttcccgggaaaccctgtttggggttttgtgggtttgggtgggaagagggccctctccctaatgttaaccttctaactttcccaaggcccccngggcctggcttttgttagggggtggacaatgggggcccccctgtgccctcttttttttcccacaaggccccgggtgtttgggggggggttcagcccgccccccccccctgttttataaagggcccctttggccctttccaataaaaatggggggggggccccttggcccctggctttctgggtaaggggggcccccccaaaggttttctgggggtggatttgaatcttggggggggggggttgaaaccttttttgggcccccttgggcccccccccttttgtccccttttgggtgcccgggggcccccaaccaaaccccccgggcctgaaggtggtttttaatgggctttggggttttttttttgccccaaagtttttggggttttcccataaaattttttttgcccca

SEQ ID NO: 556655 - DNA, 786 bp, Homo sapiens
  misc_feature (5)..(5): n is a, c, g, or t
  misc_feature (16)..(17): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (58)..(58): n is a, c, g, or t
  misc_feature (69)..(69): n is a, c, g, or t
  misc_feature (74)..(74): n is a, c, g, or t
  misc_feature (82)..(82): n is a, c, g, or t
  misc_feature (86)..(86): n is a, c, g, or t
  misc_feature (96)..(96): n is a, c, g, or t
  misc_feature (119)..(119): n is a, c, g, or t
  misc_feature (146)..(146): n is a, c, g, or t
  misc_feature (149)..(149): n is a, c, g, or t
  misc_feature (151)..(151): n is a, c, g, or t
  misc_feature (160)..(160): n is a, c, g, or t
  misc_feature (173)..(173): n is a, c, g, or t
  misc_feature (184)..(184): n is a, c, g, or t
  misc_feature (187)..(188): n is a, c, g, or t
  misc_feature (190)..(190): n is a, c, g, or t
  misc_feature (195)..(195): n is a, c, g, or t
  misc_feature (203)..(203): n is a, c, g, or t
  misc_feature (206)..(206): n is a, c, g, or t
  misc_feature (225)..(225): n is a, c, g, or t
  misc_feature (227)..(227): n is a, c, g, or t
  misc_feature (229)..(229): n is a, c, g, or t
  misc_feature (231)..(231): n is a, c, g, or t
  misc_feature (239)..(239): n is a, c, g, or t
  misc_feature (249)..(249): n is a, c, g, or t
  misc_feature (269)..(269): n is a, c, g, or t
  misc_feature (288)..(288): n is a, c, g, or t
  misc_feature (292)..(292): n is a, c, g, or t
  misc_feature (303)..(303): n is a, c, g, or t
  misc_feature (306)..(306): n is a, c, g, or t
  misc_feature (314)..(314): n is a, c, g, or t
  misc_feature (325)..(326): n is a, c, g, or t
  misc_feature (338)..(338): n is a, c, g, or t
  misc_feature (354)..(354): n is a, c, g, or t
  misc_feature (364)..(364): n is a, c, g, or t
  misc_feature (375)..(375): n is a, c, g, or t
  misc_feature (390)..(390): n is a, c, g, or t
  misc_feature (402)..(402): n is a, c, g, or t
  misc_feature (411)..(411): n is a, c, g, or t
  misc_feature (420)..(420): n is a, c, g, or t
  misc_feature (462)..(462): n is a, c, g, or t
  misc_feature (465)..(465): n is a, c, g, or t
  misc_feature (535)..(535): n is a, c, g, or t
  misc_feature (609)..(609): n is a, c, g, or t
  misc_feature (613)..(613): n is a, c, g, or t
  misc_feature (628)..(628): n is a, c, g, or t
  misc_feature (653)..(653): n is a, c, g, or t
  misc_feature (662)..(662): n is a, c, g, or t
  misc_feature (673)..(673): n is a, c, g, or t
  misc_feature (770)..(770): n is a, c, g, or t
tgcanaacaaaaaaanncntnanaaaaaaaaacccaaaaaagcccacccttaccgganaccaaaccccnaaaangtcaaaancaancccgccgttnccccccgaaaaccaaaccccctnaaaagaaaaaacgaaaaaacccaaaanttnanccccacccnttgtggggaaaangcagtttgcantcnnangaaanaaccaacngtnacccaaaccaaaaaaaatncnancnaccccaancaacccaaanaaaaaaaacaaaaagaaganaaaaaaaggagccgaacanaaanaaaaaccacancantttccacnaaaacgaacanncaaaaggggccncaaaaaaaaaaccttnaaaaaacatnccagccaggancaaaccaagtaggancccaagacagtnacaaaagcngcgaccccncccaaaccggggcaccgaatgccccgccaagagccgcaagcngcncagtgatcatcacccacaaggacaggttgccgggatgaggcaccctttcctttcatgtttaggttcttcncacctgcatttcactttcctaaaggtcccagccacacagcgttcttttagggattaaagtagtaggaaaaaaanaaanagaacacaacatccntccttaaagaaaaaaagtaaatccnctttatggnggacttcagcnatggacaaatttgggatcagtgttctccagtttgaacatagtcttctgttacctgggagagagtggtcaggtactgccagcccagggcagccaaaancatgaaaaacgacagg

SEQ ID NO: 556656 - DNA, 253 bp, Homo sapiens
tcgacgcagaggcaggtggatcacttgaggtcaggagctcaagaccagcctggccaacatggtgaaacctgtctctactaaaaatacagaaattagccagacatggtggtgtatgcctataatcccagctacttgggaggctgaggcgcgagaatcacttgaacctgggaaggcgggaggttgcagtgagctgtgatcacgctactgcactccagcactccagcgcaggcaacagagggagactctttgtctc

SEQ ID NO: 556657 - DNA, 130 bp, Homo sapiens
gtgagtaggctaggatacggaagtataagtgctgagagccgaggaagaaaagccaactgtgcttggagtagtcagggaagacttcccagaagaaggtaagtctaggttaagggctaactggtgaatgacc

SEQ ID NO: 556658 - DNA, 1518 bp, Homo sapiens
  misc_feature (504)..(504): n is a, c, g, or t
  misc_feature (981)..(981): n is a, c, g, or t
  misc_feature (1104)..(1104): n is a, c, g, or t
  misc_feature (1134)..(1134): n is a, c, g, or t
cttgtccttttataataccctcttttggccgccccccctgttgttaggtgtcggatgtttctgtcccgccgttgctcctcagatgtgctgctccgccctcttctctctcatttgtgggagatgtttgattgtgtcgcgtcgcacgcccccgggggggaaccacccttcctttagattgccttaatgctcccccccctccggcgaagtgtgtgaggaaaagaagtgggttgtgctgcttctccccccggaaacacaagatttgtcggtggacgccccaggagagtttctcctccgcgcggtgatgatattttttcccccggcgtgtaccaccccgcggtttttgtgtgtcccccccctctgcggtaagaagtttgtggataaacgatgggggggacaaaaaaagatgggggtccccaccatctatggggacacccacacaacacaaggggtataacagcacctcttgggagtggagatctctcggcgcttctcacctataggcgngggggagagaaaaatgcgcccctccccgcgccgcgtcgagaagggccccccctcgcgaggggggccgcaaaaaggggtgtcccccgcgaaagcccccccactctgagagagacaccctcgggtggttcaagaaaaaattggggtgacacatgggagacgcccactctcacaccctcgctcacagggaggaaacacacacagtggtgtgtcaccacacacaaagagagagagtctctcatccacacagaaagagtgacacactctcccacacagagtttaacacactgcgaggaaaattcacacactcacacatagggggagaaacactctttgagatagagaccacaggcagagagccctcacagcagaaaggagagtgtataacaccctctcttatagagacaacacagcgggggtgtctcgcacacagagacacacacaaatcttcatcagagcgacacaactctctcctctggngcttataataatgtgtttcacacacaaaatcgtcatcacaccacagtggtttctctataatatgtttgtgtgagagaaaacacacatcgagagatctccacagagattgggcatcatcgggtntgtgcttcctatattgtggagactctctcncgctcgagagagagatgtgtggggtgagacgcccacgatatatatatgagattttttctctctataaggagatgggttttatagagaaatgtgagaacaaagtgtgttataccacaaaatggtggccacacattatattttgtgagatcttaatcacccctggtcacatcacataaactggcgttcttgccttgttcacatccaccaccacaccacccacggagacttataagaccacacaatgggagactgaatggtcactctttgaggctccttcacattaaattttgaccgtgaattatttggagatggcaggccttgtttttaagaaaaaccagtcaagtagggttgtcctataaaattaaaagccattttaacctccca

SEQ ID NO: 556659 - DNA, 126 bp, Homo sapiens
ttcacagtgcctcccaggaggctgcgggagctgcagcttcaaagcctcacagagatcttgaaaggaggggtcttgatccagacggaacccccagactctgctaccaggacacgatttagtgtaggg

SEQ ID NO: 556660 - DNA, 810 bp, Homo sapiens
  misc_feature (559)..(559): n is a, c, g, or t
ggaactgttggactacatgttttctcttagattatgtgattttgtgggcactggcaaaaggtgtgtgtgtgaatgtgtgcatgtgtgtgaatgtgtgtgtgtgtgtgtgtgttgtgtgtgtgtgtgtgtgtggcagacgtgcaaaagtgcagctgaaataataccttagatttctaggtaagtctctccacatttcaatagtgggtcagagtagaaccagggccgggtatcaattattgcttgtgtggcaccaggcataaactcactttctcaaatcatccagcgttcctataaatgtatgccggaaactctccttctgtgagtataactcctgagttcctatagcagataagatatacgacagtgcctccctagtgctcctccgccgtttgtggctaaaattccctttctctctaagtccaccatttcaagatgtgacgatagtgtatagtaagacagcttgtcgccctgccagatgtttctctccttgtccaaaggccagagacatcccaggaagagcgctggggggtcacacccgagcaacgctgtgcgttacccntgctaaaaaaccacccgttactccagaggaaggaccgcaccgtgccacgttggggaaccttatttcccaagagatgcttaacttcgggtgggctaagggcagacacccttgtcctcccacgggaggggtcccaaataaccggattggggggaacgaccgaccaaagacatggcgccctgcgaacccggtacgccaccggcccgggaaccctcacagggcccccggcgcaaggggtcacccccgaatttata

SEQ ID NO: 556661 - DNA, 127 bp, Homo sapiens
tttaccctggatgtggagatcgccacctaccgtatagctgtggagggcgaggagtgcaggctgaatggcgaagggttggacaagtcaacatctctgtagtgcagtccaccgtctccatgtgctatgg

SEQ ID NO: 556662 - DNA, 84 bp, Homo sapiens
aaaaaaaaaaaagtctgcgttcattgcagttccagtttctcttccattctgtgtcacagacaccaacaccccactcattggaaa

SEQ ID NO: 556663 - DNA, 400 bp, Homo sapiens
  misc_feature (21)..(21): n is a, c, g, or t
tccctggggaaatggtggccnatggctgccctcccaggaagggcctggcgggggggatgctgggcatgtgtttccagcgtccttgcccccagtgttccagctcagtctccaccaccttcttctctcccaggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgttggccacccctcaccctgacaccgacgtgtcctgtacatagattaggttttatattcctaataaagtatagcgggagagacctggaaaaaaa

SEQ ID NO: 556664 - DNA, 489 bp, Homo sapiens
accatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgttggccacccctcaccctgacaccgacgtgtcctgtacatagattaggttttatattcctaataaagtatagcgggagagacctggaaaaaaa

SEQ ID NO: 556665 - DNA, 310 bp, Homo sapiens
tctcatcacgactcccgtcgaacacggcgtgttgggctggctgctgctgctgggctggttgctggtcggtccttctgctggggctggactggttcggcgctttgcaccggctgtacctgctgtcctctgcggaccttgatggtgtcgtgctgaacacactgggggctgttgctggctgctggggggtgtactgcggcatctgttgttgtccttgtgacggtaacagatccaggctttggtggcagatgtcttccacaaacgtcgaccgggagactcttgacacacactgatcacatcatcttctatacat

SEQ ID NO: 556666 - DNA, 462 bp, Homo sapiens
cacggtactatcttatcctctaggtctcaacttaagtataaccgtccttcaacagaccccactccctgggcattttgtaaattatggtaaaagggacaaagcagtaaaatttaccatttgaactacttttattttatttattgctttgagacagagtcttgtgctgtagcccaggtgggagggcagtggcatgatctcagctcactacaacctccgtctcccgggttcaagtgattctcccgcctcaacctcctgagtagctgagattacaggcacgtgccaccacgcccagttaattttggtatttttagtagagatggggttccaccattttggccaggatggtttcgaactcttgacctcgtgatctgcccaaagtgctggaattacaggcgtgagccaccgcacctggcctgagacagggtcttgctctgttacccaggctggagtacggtggcgtga

SEQ ID NO: 556667 - DNA, 1902 bp, Homo sapiens
  misc_feature (185)..(185): n is a, c, g, or t
  misc_feature (218)..(218): n is a, c, g, or t
  misc_feature (222)..(222): n is a, c, g, or t
  misc_feature (228)..(228): n is a, c, g, or t
  misc_feature (256)..(257): n is a, c, g, or t
  misc_feature (261)..(261): n is a, c, g, or t
  misc_feature (275)..(275): n is a, c, g, or t
  misc_feature (301)..(301): n is a, c, g, or t
  misc_feature (314)..(314): n is a, c, g, or t
  misc_feature (338)..(338): n is a, c, g, or t
  misc_feature (345)..(345): n is a, c, g, or t
  misc_feature (1361)..(1361): n is a, c, g, or t
  misc_feature (1510)..(1510): n is a, c, g, or t
  misc_feature (1726)..(1726): n is a, c, g, or t
  misc_feature (1728)..(1728): n is a, c, g, or t
ggagacggggttcagcgtgatccatcattcgcaaaaggggagtaggcaacatatcattaaaagtcgggacaagtccatggataataaagcacggtatgatacattttctggctttgggtaacatcctttcaggtaagggggttcgtgatgaaaagggttccaggggctagggattggtacacttngagacgcaggaagcagctgaaagagctatgganaaantgaagngaatgctcctaaatgatcgcaaagtatnngtgngacgatttaagtcncgtaaagaacgagaagctgaactggnagctagggcaaanagaattcaccaatgtttacatcangaatttnggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagcccttgtatgtagctttagctcagcgccaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgntcactgtacaaggtcaggaacctttggactgcttccatgttggcatctgcccctcctcaagagcaaaagcaaatgttgggtgaacggctgtttcctcttattcaagccatgaaccctactcttgctggtacaatcactggactgttgtnggagatggataacttcagaacttcttcatatgctcgagtctccagagtcactccggtactaacggttgatgaagctgtagctgtaactacaagcccagcaagctaaagaggtgccagaaagcagtaacagtgccaccggtgttccaacgtgttacaattgatcagggacccatgaaaagaaactttgtgcttcacgcgaagaaaaatatctaaacntngaaaacttagatctctactggaaagcaacaacacgttgcgaaagtattggcatacataacaacgcgggcacgcgaaccttggaacctgatgttccgagcaaatgcccaggtctaggaaacgattatgctagtcctaaattccgttatgatcaaaaggaagcaaaaacacacaag

SEQ ID NO: 556668 - DNA, 395 bp, Homo sapiens
gattacctcctagacggacagaagtgaaaaccgctgccctagcgaacaacaccgatgatagagggcggaacagccttattgctgatacagagaaagtccgagtgatctggacagaagattgaaccagccacaacactcccttaagccaaagcctaatccagaccaagaccctcgctctctctgtcctacgaaggctgagagatgaggaagctgcagaaaaaaaagtttgaagccagcagaggctagttcatgaggttgaaggaaagaagccatctccataccataaaagcaaagacgaagcagcaagtgctgatggggaagctgcagcaagttctccaggagatctggctgagaccattggtgaaggtggccacactaaacaacagattttctgt

SEQ ID NO: 556669 - DNA, 1470 bp, Homo sapiens
  misc_feature (929)..(929): n is a, c, g, or t
  misc_feature (1078)..(1078): n is a, c, g, or t
  misc_feature (1294)..(1294): n is a, c, g, or t
  misc_feature (1296)..(1296): n is a, c, g, or t
atgcttcgacgcgttggtaagctctccatatgatcgagctgcaggcggcgaaattcactagtaattagagactgcgagaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagcccttgtatgtagctttagctcagcgccaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgntcactgtacaaggtcaggaacctttggactgcttccatgttggcatctgcccctcctcaagagcaaaagcaaatgttgggtgaacggctgtttcctcttattcaagccatgaaccctactcttgctggtacaatcactggactgttgtnggagatggataacttcagaacttcttcatatgctcgagtctccagagtcactccggtactaacggttgatgaagctgtagctgtaactacaagcccagcaagctaaagaggtgccagaaagcagtaacagtgccaccggtgttccaacgtgttacaattgatcagggacccatgaaaagaaactttgtgcttcacgcgaagaaaaatatctaaacntngaaaacttagatctctactggaaagcaacaacacgttgcgaaagtattggcatacataacaacgcgggcacgcgaaccttggaacctgatgttccgagcaaatgcccaggtctaggaaacgattatgctagtcctaaattccgttatgatcaaaaggaagcaaaaacacacaag

SEQ ID NO: 556670 - DNA, 1253 bp, Homo sapiens
  misc_feature (185)..(185): n is a, c, g, or t
  misc_feature (218)..(218): n is a, c, g, or t
  misc_feature (222)..(222): n is a, c, g, or t
  misc_feature (228)..(228): n is a, c, g, or t
  misc_feature (256)..(257): n is a, c, g, or t
  misc_feature (261)..(261): n is a, c, g, or t
  misc_feature (275)..(275): n is a, c, g, or t
  misc_feature (301)..(301): n is a, c, g, or t
  misc_feature (314)..(314): n is a, c, g, or t
  misc_feature (338)..(338): n is a, c, g, or t
  misc_feature (345)..(345): n is a, c, g, or t
ggagacggggttcagcgtgatccatcattcgcaaaaggggagtaggcaacatatcattaaaagtcgggacaagtccatggataataaagcacggtatgatacattttctggctttgggtaacatcctttcaggtaagggggttcgtgatgaaaagggttccaggggctagggattggtacacttngagacgcaggaagcagctgaaagagctatgganaaantgaagngaatgctcctaaatgatcgcaaagtatnngtgngacgatttaagtcncgtaaagaacgagaagctgaactggnagctagggcaaanagaattcaccaatgtttacatcangaatttnggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagcccttgtatgtagctttagctcagcgccaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagactgagtctgtataactgccttggggatcctcagagac

SEQ ID NO: 556671 - DNA, 411 bp, Homo sapiens
gaccccgagcttaagggctaccctgagggaggtgcacgaaggaaagatagtttctttatgactggaagacttattcgactgcggtgatgatacttgtaataggaagtgccgtcagaagcgataactgacgacgtataatgtctatctgaccgcaatcgctgaaacctctacaacttagttgaccgtagctgccagagccctgccctgaattcctgtgcttactccctctttaagattgcggacccactgcagagtgctgaagacggatttgccacgaggtgagaggctctctggtgtagagatcaacatggaacgtagttttgtcacttgaatgcacggaaattggcgttttgacagttttctacgtttaggagttttatacactttagggtaacgttatcatgtcattgc

SEQ ID NO: 556672 - DNA, 270 bp, Homo sapiens
  misc_feature (107)..(107): n is a, c, g, or t
  misc_feature (145)..(145): n is a, c, g, or t
gcagagcgcagcgcgcacgcccagcgagttccagaggcgccagtggaagctgcggcggtgttgtctcgcgaacggagaaatttcctctcctccgggtcggcctaggnctacgtccccagctccttttttttttctcggactcggnctctgacccccaactcggtcccctagtccggccccggctccgggccccccaaccctcgctccagaccggcccggccccctccccagtcctgccgcccggtcccaggcccggccgcgtacgcttcc

SEQ ID NO: 556673 - DNA, 292 bp, Homo sapiens
tactctactaggtatatatgaggcatcatatccactgactgtgtatatggaggttgcacaactactagtctatagagagcggagtctttgggagcgtgagagatctagtactagagttttcactgaacttggcgatgagatcttaggccatgtggggttagcctctcggatgagcttcatatgttacgtctaaagtgtatttagtaccttctctacctggtaaggctcagatgtgacaagaatgtgggaagaccatcttgacaagtacatagcagtgtgagaaacataaagc

SEQ ID NO: 556674 - DNA, 168 bp, Homo sapiens
gaggaaggaagtccccccccgccttcctctgtccggagaggcacaggtgtcaccagttccaaccaaaggctcctcacaggcgctgtgaatttttggaccagtcttgtaattatcgaatccaccacttgtttccatttaataaaaatgctcatgggaagtgaaaaaaaa

SEQ ID NO: 556675 - DNA, 1626 bp, Homo sapiens
  misc_feature (185)..(185): n is a, c, g, or t
  misc_feature (218)..(218): n is a, c, g, or t
  misc_feature (222)..(222): n is a, c, g, or t
  misc_feature (228)..(228): n is a, c, g, or t
  misc_feature (256)..(257): n is a, c, g, or t
  misc_feature (261)..(261): n is a, c, g, or t
  misc_feature (275)..(275): n is a, c, g, or t
  misc_feature (301)..(301): n is a, c, g, or t
  misc_feature (314)..(314): n is a, c, g, or t
  misc_feature (338)..(338): n is a, c, g, or t
  misc_feature (345)..(345): n is a, c, g, or t
  misc_feature (1085)..(1085): n is a, c, g, or t
  misc_feature (1234)..(1234): n is a, c, g, or t
  misc_feature (1450)..(1450): n is a, c, g, or t
  misc_feature (1452)..(1452): n is a, c, g, or t
ggagacggggttcagcgtgatccatcattcgcaaaaggggagtaggcaacatatcattaaaagtcgggacaagtccatggataataaagcacggtatgatacattttctggctttgggtaacatcctttcaggtaagggggttcgtgatgaaaagggttccaggggctagggattggtacacttngagacgcaggaagcagctgaaagagctatgganaaantgaagngaatgctcctaaatgatcgcaaagtatnngtgngacgatttaagtcncgtaaagaacgagaagctgaactggnagctagggcaaanagaattcaccaatgtttacatcangaatttnggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagtatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgntcactgtacaaggtcaggaacctttggactgcttccatgttggcatctgcccctcctcaagagcaaaagcaaatgttgggtgaacggctgtttcctcttattcaagccatgaaccctactcttgctggtacaatcactggactgttgtnggagatggataacttcagaacttcttcatatgctcgagtctccagagtcactccggtactaacggttgatgaagctgtagctgtaactacaagcccagcaagctaaagaggtgccagaaagcagtaacagtgccaccggtgttccaacgtgttacaattgatcagggacccatgaaaagaaactttgtgcttcacgcgaagaaaaatatctaaacntngaaaacttagatctctactggaaagcaacaacacgttgcgaaagtattggcatacataacaacgcgggcacgcgaaccttggaacctgatgttccgagcaaatgcccaggtctaggaaacgattatgctagtcctaaattccgttatgatcaaaaggaagcaaaaacacacaag

SEQ ID NO: 556676 - DNA, 1011 bp, Homo sapiens
  misc_feature (470)..(470): n is a, c, g, or t
  misc_feature (619)..(619): n is a, c, g, or t
  misc_feature (835)..(835): n is a, c, g, or t
  misc_feature (837)..(837): n is a, c, g, or t
gaagtatcggcgtgcgaaggataggaagtatctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgntcactgtacaaggtcaggaacctttggactgcttccatgttggcatctgcccctcctcaagagcaaaagcaaatgttgggtgaacggctgtttcctcttattcaagccatgaaccctactcttgctggtacaatcactggactgttgtnggagatggataacttcagaacttcttcatatgctcgagtctccagagtcactccggtactaacggttgatgaagctgtagctgtaactacaagcccagcaagctaaagaggtgccagaaagcagtaacagtgccaccggtgttccaacgtgttacaattgatcagggacccatgaaaagaaactttgtgcttcacgcgaagaaaaatatctaaacntngaaaacttagatctctactggaaagcaacaacacgttgcgaaagtattggcatacataacaacgcgggcacgcgaaccttggaacctgatgttccgagcaaatgcccaggtctaggaaacgattatgctagtcctaaattccgttatgatcaaaaggaagcaaaaacacacaag

SEQ ID NO: 556677 - DNA, 434 bp, Homo sapiens
aatattaggaatcaagaaactatatatataaaatcaaagctgctaaataaaattataaattgtgtttataattacaaatttgaattggaaatatcattataaaatcataatgtatttcctttacagaagcacattttctagccctgttatttgaaaatcagtaatgagcacccttagaatgcagattatagtctctaaatgcaattttctgctaaaaggaataagaattccttggagaaatgacgaatgtatgagatgagctgaaaacatcttgttgaacatgaaataaaggaaacccttaaaaaatactgcatttttaaggacttaggagccaatttaaagggattatttcttgccaaagatgggaaattgtgtataccaaaacaacagttgtgataaattgaaattcatattaaaatctgagagtttaaaat

SEQ ID NO: 556678 - DNA, 418 bp, Homo sapiens
cgtgtagtcgagtctatgaggatccccatcaacattgaacttcgagattggggtgacgattcacaaccgtcctttcctcaaagcgctagtcactgacgagttgcaagggcttgatgcgaccattccgaaggcgactgtggccagagacgacaccacggtgaccttccatgacgttgacgttcatgccaatggaattcggcacgtccgggagaaatcccagacagtggccgagacgatgtcagcctctggccgtgttgactggtctgagctgtcgcggttggcgggtgcaaaaatcacctataacgacgacgccggggaaaccggcagggtgacgatcgtgcgggagatgtcggtattgggagctcgggtagacgtcagtattaccgccgtacccggggtcgagccaatgttggtaagc

SEQ ID NO: 556679 - DNA, 328 bp, Homo sapiens
  misc_feature (313)..(313): n is a, c, g, or t
taagacattactacctctttaaccagaaatctgcctgccgattctttgagcccacgaacgttactctgtgatattcttctgaactatgtttccgttctatacaactagcagtaggcacacagaagcaaagtgagaagtttatatgtacatttgaccaaaagaaaggatgattcagtaaagtttgaacttattctctccctttttaaaagaagtaagcataggacaccaaaagcacaggcaacaaaagcaaaaataaacaagtggggactacatcaaactaaaaagtttctgcacagcaaagggaaacattcantaacacaaacaaaca

SEQ ID NO: 556680 - DNA, 964 bp, Homo sapiens
taaccctttgtaaagggtgtttttttcatccaaacattcctcctggacgcttttgtaaatccccaaaacctggttgtcttgggattacgcttttctctacatttcgcgtgccctaaaaaacaaactttgtagaaaagagaaaattcagtgtctctttcttctaccctctcttaaacttccgtattagttctttccccttttctcaaagaccccccttgtttggtcccccagcttaccccccaagtccctaagaccctcatacttggtctcacaatagcctgcctccgcctctctcattgtggggacctccaacagcttccttctggtgacgtaggtcgggtgacagttgatacggctcgggcctccctcctagatgctcccccccccgcgcggggtaaaaatgaatggttcccacgctgtgggccctcctttgtgggcgctgtgcgtgaaggacatccctctcccctgccccccggaggtgctcgcccacgtgctgttgcagtcccgcctttctttgatgccccgccacccaagtccgagggggaccactggcgttcctcgtcgtcaccagacaggcgttgcgttctagtgtgtgctgtgaatgaccttctccgccccgggcacagacgtctatatcttccttttgaagagttttatgtgtgcgcacacgccccagcgcatcatgatgttgttgtggatggccgccgcgttctagaagagacgcagagtctctaaacgccccaggcgttgttgttctacagacgtaccacccatgtgagagagagaaactttgtcactaatgacttgatactttaggtgggtgggttgctcattacgtatgtacctatgccaccaggggcgggacgtatttcttcgcaccctgctctctcgccattaaaggctgattgcccgcggcgagtcccgaaaagcttaaaacaaccctttaggacaccccaacaaaaca

SEQ ID NO: 556681 - DNA, 605 bp, Homo sapiens
gctattgctgttatctagatccaacgccggacagtagctgtgtccttgtcttctgcatgtcgcaggctccaattagtctctgttagcaccaaatagagctaatattatcaggagacgtgaccttttataaggccactgtcagtaggatataaaaagcagcccactgctcagtttccaggatcagcttcctccttctgtcacttgtgtaaagttggcactaccttgtgcctctcagatagctgaagtgctgctggtaagcatgtgcatgctctgcctttcttgtgaaaggttttcaatcagcgatatcagcacttacagtaagacagtaaagtagtgcacagcaaaaaggctaatttgcctttgccctggggtgttcagcttgaaagaataaagctcatttgggtaagttaaatgtcttactctactgtgcctatactttagctgcgatactaagcaagggaacaatacccgtttctctgagcccagagaagacttgatcaccgttctccaagctctgtgtaagccatgcttaaccccgggagatttcaggccgggagcaaacctttcacataagatcttgttaacccttatgcctgtggtcccaa

SEQ ID NO: 556682 - DNA, 332 bp, Homo sapiens
  misc_feature (29)..(29): n is a, c, g, or t
  misc_feature (62)..(62): n is a, c, g, or t
tttcctgggggggggggggaaattttaanccccctacccaaaagtttaaccccctttttgtntaaaagggggccccccccagggaaaaacccctttggggcgggggtgggggggggggtttttccccatgtcccccccccccttgttttggggggcagttttttttcccccaggtccccccccccccccccttggggggtttttcgggaaagttttttcccccccccgggccctggtttggggggaaaagggccgggactgtttaaaaaaccctttttttttctttttgggaaccaaaaaaaaaaaaaaccgggcttttttttggtttccca

SEQ ID NO: 556683 - DNA, 131 bp, Homo sapiens
gttaagccaacaacaatccccctttcctattttttttctccctgccccctggagggcactgtgtttggttgggcaaatgtatttactaggggtgtttccaccagtgggcattaaaggccctttttttaata

SEQ ID NO: 556684 - DNA, 403 bp, Homo sapiens
agctatatacggaagcgcatccctcctgacagtagacgagcaatttgatccgcatcgagagagcccacaggggtgcagaaaggcaagcgagggtgctggagtatgcctctcgcctggacaatgagcgtaccaaggatctaatcatagaagcaagatttcatcgcacaatcattggggcagaagggtgaacggactccgtgaaattcgtgaacaaaattacccagaggtcatacattaactttccagacccagcacaaaaaagtgccattgtccagctcagaggacctaagaatgaggtggaaaaatgcacaaaatacatgcagaagatggtggcagatctggtggaaaatagctatacaatttctagtccgatcatcaaacagttcacaagaatatcattggg

SEQ ID NO: 556685 - DNA, 483 bp, Homo sapiens
  misc_feature (18)..(18): n is a, c, g, or t
  misc_feature (26)..(26): n is a, c, g, or t
  misc_feature (31)..(31): n is a, c, g, or t
  misc_feature (45)..(45): n is a, c, g, or t
  misc_feature (63)..(63): n is a, c, g, or t
  misc_feature (129)..(129): n is a, c, g, or t
  misc_feature (131)..(131): n is a, c, g, or t
aagaaatggctggaaatnaaaggtgnggagnttcagaaaaggggnaaaaaatctagtggctgnataacttgtctgctgtgctctgatgatgtcagaaggttggagaacctgctgcccctgggttcctangnagctcccagctctggggtgctttttcagcctggggctcttgatgccttagaagaaacttgttcaatccgtggtgccgcctgtaggctgcatacagctcaggacggctttgactgtggcccaacacagattcataaactttcttaaaacgttatgagattttagcctggccaacatggtgaaaccccatctctactaaaaaatacatcaattagccaggcatggtgacatgcgcctgtagtcccagctactcgggaggctgaggcatgagaattgcttgaacctggaactgcagtgagccaagatcatgccactgccctccagcctgggtgacagagcaagaccctgtctcaa

SEQ ID NO: 556686 - DNA, 160 bp, Homo sapiens
cccgagcagaagaaggagggagggagccagccgctgcagccaccaccgccaccatgtcctaccagggcaagaagaacatcccttggcctgccccccaaccctgaggatggcctccatcccccaacctctcatattgcctctaaccaatggcaatgcatcc

SEQ ID NO: 556687 - DNA, 269 bp, Homo sapiens
agtcgatctgaggatccccgataggtctcctttggtctctctttgggccaaaccaaccccagagaagggggcctcagaccatcagctcttagcctaacaaagcctctatggacactggagtaggccagttatgctgaataggccaggcctcacaggcttagcaggtgaatggttccttcggctacgggccattcaggtgggaatcacaaggaccggggatttatctccctttaactcttctacagcggcccggtagtacggcctcatca

SEQ ID NO: 556688 - DNA, 827 bp, Homo sapiens
acattaggctaggtacgagtctcggtggttactctggccgaggctcctcccggtgcagaaggaacctgcagtgtccaccgtgcgatggagccagccctgtccctggtcagagaaatgacgacgaggatacctgggagcgggctggctggcctgggctggtgcctgctgcctgtgtgctgggctggcgactctgctcctccgcttgctgctgtctctgtggaactgggtgccagctgctgatgtgtggcttccatgctggacatgtggacccccgttcccctgtgctcccctgcccacccttgcctggggatgtggctggaatgatgcctgtgtgaagaagaaagagaaaatcaccctgggtgtggcatgcatgcagtagctggcaagacgtgatggcctcaaaaagtgtaaaatctcacagctatttgcagcatcccaactcccctgctagcactagataagtggagatggaacatttttcaagcaatgaagtgcctggcttggttttatgaatatgcagtgtcctgatgaagttgtagggccagaaggaatggaacacaatttttgtgcaacgacattggtgttgaacctgaaaatatcattatgtaagatttttagcgttggcacattggaggcgtgaaagcaatgggcatttttttaccaaggaagcaatggttccacgggaatgacttcattacagtgtgactgcacagaaaaagtaacaaaacaaatttgactttttgcggctcacagttgaatgatattccgtcattaagaatatctacggaatatcctttgatttgcagggatacgatcgagaacttgat

SEQ ID NO: 556689 - DNA, 884 bp, Homo sapiens
tttttttatttttttcgtggtttaggccccatggctaaagccctttattaaagcgaaattcccgaggggccagcccccatatttgatgggtccatgtgagtctccttagtgggccccatgagggattaaaagctgttgggtagaaagctagggacctggtcccacgcctggacccgggggcaggcaagggggcccacagcccccaccaccaccccaggagagggcggggtagaaaaccggagtcaaatctggggcggggtccaagcgcctgagcgccggttcacgcaggaaatagtccagttctcaggaagtgtgtctaaccacgccccagccccagccgcggaaccacctggggggggttcaatgtacactggcacggaagacggacgtaagcggggatcttaaggccccgggtatgatggaaacaacggggtcgacatgcggaccaacaggaggaccctgtcgtctcaggaggtgacgcgtggtccaaaattgggccggaaccccctgggtacccccgacaaacgcgtgctttgcccaacatgggctgcggagaggccccgcgggaactccaaccggggggggcagaggctcagtgggtcgccccatgggccacatacagttggccgcctggtgtgttccgccctccacagatgtggggatcactcacaccacatcagtcgtcgagttgcgaaaaaaaacaacacttgacccgctagtgcgggtacgaacagggccaccgaccatctggtgcgcgcggtagaagtgcccactttttggaccgcttacgaagcgaagcccattctggtgtgaaaacacgctttggcgccacctgcccaccttgtaactagcgctaccacgttatttagtaccagttgttgtaa

SEQ ID NO: 556690 - DNA, 708 bp, Homo sapiens
  misc_feature (20)..(20): n is a, c, g, or t
  misc_feature (29)..(29): n is a, c, g, or t
  misc_feature (40)..(40): n is a, c, g, or t
  misc_feature (110)..(110): n is a, c, g, or t
cctgatattataaaaacaancctttcggngaatatataanaacaacattcatatattttttttcattataactaaaataataaatattaatttcattttttttccatatntcaaataaattaaattttttttttataaatttattattttatgatttatttataaaaagtaaccaaatacgtataattattaatttatatattcatttatctttttctataggagtttctatttataaaaaataaataacaaaaaaaaaaaaaaaaaaaattttttataatataataagaaaggaccttatattattatccaataagtaataataaacataaaaaaataaaatttgacttaattataataaaaattaattttaatattatcatatgaaaattattcttctttatttaatttataattatatattatatatattaacattgtatttttttataaattatttccactaaaatcaaatacaaaaaaaacacaaacaacatattatttttttatttatattaattaataatatatatattaataatttaaattcatattttataatatttgtaatttaattaaaaaaataaaaataaatattattttatataaatataataaatataaaagacaaaaattatttataatatattttttatataaataattattttaaatataattaataattaaaaattattaaaaaatatt

SEQ ID NO: 556691 - DNA, 295 bp, Homo sapiens
  misc_feature (32)..(32): n is a, c, g, or t
tgtcctaattgccatgattaatacaatgatgnatatgtatacataccaggtataccttggaaatattgtgggttcagtttcagactacccacacaaagcaaatattggagtatattgagccagacaaatttttttttgtttcccagggcatataaaaattatgtttacactatactatagtctatttaatgtgcaatagcattatgtctaaaaaatgtatatactttaagtaaaaaaatactttattgctaaaaaatgctaataatatctgagccttcaacaatttgtaatgtta

SEQ ID NO: 556692 - DNA, 1050 bp, Homo sapiens
  misc_feature (486)..(486): n is a, c, g, or t
gccgaggagaccccgcgccagtgctggcaacagtgcacggtggagaagctgaggtcatcatcaggatttcgaaatatttgcttgtggatacgaaactatttcagcaatgcagacaagtaagtgtgttgttgtgggcgatgagtgctgttgagtaaaacatagtcgtcctgtatatccgtagcaacaacttagacgagagatttccactcgcaactagtggtaccgagctgatttcttgaacatatgcgtatgtcagtatcacagattgtgaatagggtggagtaaccatagtagctcttgggactttgtcgatagcatgcaggggcaagaggcattatgacagagttacgagcagcgtgaggtgtatccagcaagacagaatgtagtctcgtagatcggtagttcaatttccaggtcgggtcctcctccgatcgttcactttgtatgaatcgtgaaagaacaagatgtggagttgccttgatggantaatcatcaccgacttgtccaatataggacgtccgtttccttgcgctttgatgcgggggactccagaatctggagtcctcagttagtactggaactccagatcatacgtatgtggagcgaagactttgtgccgataggaaagcattggacagtaaaggccatagtccactgtcccaggagacctgcgtgtaaaatggcatgggccccgtggaaccatgaaagggccgtgtcaagtgtcactgtgcgaagtggtttgctggcaccttttacaccacggaaggagggttcttggaccggaaatggtggtgacgtagtagaaagggccttaattccacttaagagcttgggcgcccttcctaagggccctgccacggggaaagactttcccaactcgcaataaagaatgccgcaaaggttggcttcggtacttaatatgcctttagagaccctgggtgatacacacttcccgttcttcccccttttcctttattgacattagcctttggcgttttacccttggttggcgccagctttacgttaggtaagacgaaacaaggaattcga

SEQ ID NO: 556693 - DNA, 232 bp, Homo sapiens
tgagggtgcggcgagctgggtggtggcggcgggcgtgcgagacgcaaacatgcggatcttggtgaagaccctcacgggcaaaaccatcacccttgaggtcgagcccagtgacaccaatgagaatgtcaaagccaaaaatcaagacaaggagggaatcccaccctgaccagcagcgatctgatatgggccggacaaacagcgtggaggatggccgcagctctctcagcaatac

SEQ ID NO: 556694 - DNA, 286 bp, Homo sapiens
cctttaaaggggaaagggggggtttgtttaaaatagtaaacccgtaagtcccttttaaatttaaaaaaaaccaaattggggttgaagaataagtaggtttcccattggccatcgccgttttctttgaaaaaaaaaaccttttttaaaaaactaagcaggggtgtcccttttccccttcatgtaaaattctaactggggctaccagttaatctttaaattgttaagtaaaataaaattttgcctcttgggttaatgggttagccaattaaaagtttttaaaaggcca

SEQ ID NO: 556695 - DNA, 637 bp, Homo sapiens
  misc_feature (6)..(6): n is a, c, g, or t
  misc_feature (203)..(203): n is a, c, g, or t
  misc_feature (293)..(293): n is a, c, g, or t
  misc_feature (360)..(360): n is a, c, g, or t
  misc_feature (364)..(364): n is a, c, g, or t
  misc_feature (368)..(369): n is a, c, g, or t
  misc_feature (405)..(407): n is a, c, g, or t
  misc_feature (423)..(423): n is a, c, g, or t
  misc_feature (574)..(574): n is a, c, g, or t
  misc_feature (576)..(576): n is a, c, g, or t
  misc_feature (601)..(601): n is a, c, g, or t
ccctcntttgcagcaactatcacatcctcataaaaggggcaaaatttgtaagatgcctcttaaaataaatattcttttttataaaataataaaacttcaaataaatattctttacactaaacaatatgttgaaaaaattagaaaataaaggttgaattttactgtaactgtacaatatacatgaagtccaaagggaaatcagngtcttacaataaaggctttctgtaaggcaaaatacaatctaaaaacatactgtttgtttcacattcttccgattgttcaacatattagtntaattttttgtgtctgtgccatgtggtttggcacaacttgtttttcacagttgcaaatatttttgtntatncaannatatagcacattctctctggtgtaaacaatggtaannngtcatctgctaatttnccagttttgccagttctattctccaacaagaactttgcctgggggtgtctgtgttgctttagcttatgcgatacatgggtccccaagttctgtatctcatactttgagctccattggctgggttctgacaggcgtgtcggtttggagggcncntgggcggggagcctttcgccgccgncagcaaagactatcccaactttctattaacagtgcc

SEQ ID NO: 556696 - DNA, 759 bp, Homo sapiens
catcttgcgtccccgcgtgtgtgcgcctaatctcaggtggtccacccgaaaccccttgagcaccaatccctagtcccccgtcgcggtcccttattcgctccgacaagatgaaagaaacgatcatgaaccaggaaaaactcgccaaactgcaggcactcagtgtcgcagttgtgtgggcaatggaactgctcgcagaaatgcaacgaaggtggttcataggaacagccacagcagatgactaataacttcagttctccttaacagaacgttacgtgggtaaacgatatctctgtgtattgaagacggtgcaatattgtttaccaaccaaggcaacagtgatccactttagacaaccctaaagttcaggcatctctggcagcgaacactttcaccattacaggccatgctgagacaatgcagctgacatgaaatgctacccagcatcttaaaccagcttggtgcggatagtctgactagctttaaggagactgggcgaagctctggccaaacaatctgtggatggaaaagctccacttgctactggagaggatgatgatgcatgaagttccagatcttgtggagcaatattgatgaggcttccaagaatgaggtcaaactgaattgagtcaactttctgaacgatcaaatgctgagagaagttactgggagctgctactttgatattattgactgcttggaacgaacattgtggtatggatctgataaatctagatctctactattttaagcccaagccct

SEQ ID NO: 556697 - DNA, 159 bp, Homo sapiens
aacagctgtagtctcgcattctacagtggtattaacagccaggccccggggtcgcgtctacagtggccgggctagagcgaggatcatggtattccccttactaaaaaaagtgtgtattaggaggagagagaggaaaaaaagcggaaagaaggcaaacac

SEQ ID NO: 556698 - DNA, 1245 bp, Homo sapiens
gggctacccgctgcgctctgccttcctcggccatcgatgcctcggggctcggtggctgtcgtggcctggcgggctccccgttgggctgtgtggtgctggcgtgtcctgagctgtgcttgctgtgcaggctggaatgcggtgtcctgtgtgtctgctgcagtggctgtgtgtgggctgtgcgccagctggtgctgtgagtgcgtgcctgtgtgtgcctgccatgggcatgaagtgtcaacgatggacagagggcggcactgcccctgatccccgaacagggcctagtgtctaaccaaggaatctatcccttgaagccttagtgagcccctgagcctgactggttagccttggacctgaactgaggtgccttgagttgttgccctggccaagttgggcaagaggccctgatggtcggcagggtgacctgaaggttatccctttgttgagaagagggcaggcagagatttcgtagcgcagaattaaaaataagccgagggtgattgaggcaccccagagggagcgagtttagccccccctgaacagagccccgagcgcaggtgcaccaattggttcacctgcgaggttaaactaggatggcgaaaggttttccccaatggctgagaggcacatagtaagttgaacccaccaggaggtttggccccccattagacagttttgggaaagcggagttggcaatgaaacacgagccataggcagagagtgaaaaacctatgcacactaaaaggaaagccaaaggtaggttacccattttgccaaccgcacattacaagggaccattatcatttccccgcgaaatattccccgtgggaggagttaaacacccaagcgtatatacagagcgtaggattcaccgtttagactattcccaaggaagagtgcggcagcacttagctagcctcttaggcatgaggaaccgtgaagttcttatgggggacaggccaaaaacggacagaaagccccagtttagaagccacaaagtatccgtatcctcagaccttttgggtctttttgggccacaaccagaggggcagtctgctctggtgaaacgcgaagttttcgctacgtagcaccccagtaagcacaaaatcatgttggtgactgtgcgtacacgagaccacacagaagagaattttccattacccacgcacaaaatggatgtatcaaaaactccaaacacagtgtgcgaaacaccagagaaccacttcccgtgaatcgataactcgt

SEQ ID NO: 556699 - DNA, 167 bp, Homo sapiens
ccagatgtcatatccagtaacaatggaaagagtcagatgtgaaatatgacgctcgatttgacaaatatcttgatccgtcctttctacaacatcggattcattggtcgccaattttcacctccttcatgatgcgtgcatcttctatggtgggcttcagttgcaatgca

SEQ ID NO: 556700 - DNA, 238 bp, Homo sapiens
  misc_feature (57)..(59): n is a, c, g, or t
  misc_feature (65)..(65): n is a, c, g, or t
  misc_feature (67)..(68): n is a, c, g, or t
  misc_feature (72)..(72): n is a, c, g, or t
  misc_feature (76)..(76): n is a, c, g, or t
  misc_feature (83)..(83): n is a, c, g, or t
  misc_feature (88)..(88): n is a, c, g, or t
  misc_feature (111)..(111): n is a, c, g, or t
  misc_feature (114)..(116): n is a, c, g, or t
  misc_feature (120)..(122): n is a, c, g, or t
  misc_feature (124)..(125): n is a, c, g, or t
  misc_feature (127)..(127): n is a, c, g, or t
  misc_feature (135)..(135): n is a, c, g, or t
gagaacgcaaacaccggtggagcgagaaaacacttctgtggcacggcacacctgttnnnaaccancnnccanccangctgaangctgnggaccgggatgcagtgtcaggcntgnnngtcnnngnncncatcatcnagaaggacaaaatcaccaccaggacactgaaggcccgaatggactaaccctgttcccagagcccactttttttctttttttgaaataaaatagcctgtctttc

SEQ ID NO: 556701 - DNA, 940 bp, Homo sapiens
gcataaatctcaaccaggagctgggagaagcttctgctggcagctcgctgcaatggtggcattgaaaaccctgctgatgtcagtgtaatatcctccaggaatactggccagagggctgtgctagaaggttgctgctgatcacgtggagccactcccaattgctggccgggtcagtcctggaaccttgcagctaacccagatccatgcagtcctgtccgggtagccgacggtgttcttgtggttactgaccccagggactgaccagcaggctctcacggaggcatcttatgttaacctatctaccattgcgactgtgtaagcaagagattctcctctgcgctatgtggggacattgccatcccatgcaacaatccaagggagctcactcagtgggttggatgtggtggatgctgggctccgggacaggttctgcagcactgctgtgcgccacgatattccctgtgaacaccacataggggaggtcatgcctgatctgtacttctacagagatcctgaacgagatcgaaacggacagagcacggctggtgctgagaagggcaatgaccaaaggatgcgaattccacggctgaatggaatgatcccgcctcctgattcactgtatctcgtgtcgtgcgggttgcagactgcgtctgcatggtgtacacgtgccctctgtgcctatgtcagcagttccctactgtgtgagctggagcgctcagctgcctcgtgggactggtctgtcagtcccaatgctcatggcgctgcatggggaggggcacgcctgactgtgtgactgtgttcgtgctaaggctgtaggctgctgtgccatggtgtgggctctgtcagttttcacctggaaaggtcgggttgttgacggtcggggaaggtgaggggcttggttttggggccgtgtcggaagcggccttggggatgacggcac

SEQ ID NO: 556702 - DNA, 658 bp, Homo sapiens
cggggaggtccctcaacagcacacgccagcatcttcagccaccacacatccccagactcggctccagcccatcacttcagggccccgaacacccacaatgccacctccagttcgtactacagtgtctccgcagtacccgtcatgccccggcccccaagtggcatctgtggtccggcgtgcccccgaggctcagtgatcgcccccgatgccgcccgatcatccgacgcgcccgagaatcaacgtggtgcccatgcctccctcggccctcctattatggccccccggacagcccgccaggatggtgccaacagccgttgtgcctgctccagctggtggcccgctgtcgccagctgccagactgcaaggccgaccatgttcatcccgcacgctcgccatggcaagatgagcccacctcgaagaaaactgaagaccagaggacagcctcatgcacagaggaggagttcctgcgcagaaacaagggtccagggtccatcaaagtccaggtgcccaacatgcaggataagacggaatggacacggaatgggcaggtgcggtcttcaccctcccagtcacggaccagggctctgtcatcaaggtgcagattcatgaagcacaggcatgctgagggaaaacagaagctacagcatgaggcactacg

SEQ ID NO: 556703 - DNA, 486 bp, Homo sapiens
  misc_feature (473)..(473): n is a, c, g, or t
gactccagaggatccactctccctactgtatcctatttattaaaccatgtcttggagaacagccctctcgtagatgtcattaatgtccttgaaagggaaggcacccggggttgtggctcaggaaatgaacagagaagccactctttcttctcctcttgttggcactcctgttgttctcaggatcagttctcagaacctgctgggaggcagccccagatccagatccagccttccgtgtttcaggggaggaggacggaatgcagaaagccaccaggagaacagagccactgtcaagatcatcaccacagagaatgtagtgagcaccacgatgagcaggacttgatgagatcaggcatgggagaggcaatgatgcaaagacaggagccaatcgaaggctagatgcaggcagtgtgcataggggtgaggggcgtgtgtgagggtttgctatgtacacgtgcatgcctgtgtgcagngtaccgagctcga

SEQ ID NO: 556704 - DNA, 861 bp, Homo sapiens
gattctgctctcttcagtcgaagctacgtctgatcaatgcccatgtccccggtccaggtcgtactccctggatatgatcataattgagcgcgtggtcgcctcgggctgcgtcttgaactgctggtcaagtggctatagttgaccaatcaactggcaccaccggttcatagacctctgattacccttggtatgcaaattgtacggaaatattgattctcacgctatgggtaaaatcccaggggtagcggacaatatgggtgacaacgagaggcgttgccatcgaattggacctccgctatcaacacgatcgtccgcgaggagcgagagccctccataatccccctgcggcgagatgctcgtcgctcgtcgatcctgtcgtggtagatccaatgcgcagtctgtacaacaccatggacgtacggctggtggctctattttcgtagtggtggagaacgaccaacaaatgaggtcatgcaatcctacatggtgccgcatcttagatgacgccactcaaggttaagtcctgagagatgtcaaccgtgagatctatgacactggtcgccagatcattacgagtgactgctgaaacatcaaaggatctggaggccgtgtgcatatgctctcttcaaggagacttgtgcgtgtcagtcggataggacctccgtagacaaccattaaccatgctcatggatgagcactctaataacagtcgatcgtatagcccatcccgtgatgaaggcgacgtgagtgagcgcgagtatcctcgtaaagacgtccgtccatgtgtggcgcatgaagggaaggaaaggggtaaatcttaactcagggatataaggctgtgaactatggccaggggatttc

SEQ ID NO: 556705 - DNA, 281 bp, Homo sapiens
  misc_feature (243)..(243): n is a, c, g, or t
taaacatacagaggtctgctatggcactaactcaaagtaagactcgcgcaggagagagctgctgcatagccacagtataacttcacatgttcattaaaaagcaaactgaccgctaaaacttcaaagaaaaagatctcataaaaaagtcttaccccaaaattgcaaacaaatacattaaaaggttagaagaggtgatagaaagcaccacacattacacacaataaaaataactgaatgaattcnacctcaaaaaggccccattcagttgcaaattcaagggg

SEQ ID NO: 556706 - DNA, 946 bp, Homo sapiens
cttggctgcagcgggtgacatgggacaacgcagggaaggagcgagaagcggtccagcttatggcggaggccgagaagcgagtgaaggcttcccactctttcctccgagggttgttcggaggaaacacaagaatagaagaggcatgtgaaatgtataccagagctgcaaatatgttcaagatggccaagaactggagtgctgcagggaatgcgttagtcaagctgccaaactccacatgcagctccagagcaagcatgactctgctaccagctttgtggatgctggaaatgcgtacaagaaagcagaccctcaagaggctatcaactgcttaaatgcagccatcgacatttacacagacatggggaggttcacaatcgcagccaagcaccatatcaccatagccgagatctatgagactgagctcgtggacattgagaaggctattgcacactatgaacaatctgctgattactacaaaggagaggaatctaacagctctgccaacaagtgtctgctgaaggtggcagcctacgctgcacagctggagcagtaccagaaagccatcgagatctatgagcaggtgggagcaaacaccatggataacccttgttgaagttccagtgccaaggattactttcttccaggcgggctctgccacttcatagtggtatgagcctggaagccaaggcttgctctgggcaaatacggaggaaatgttccggcgattttaaggactccggagaagttattcttgagaacctcttggaagctcagaggcacgaacaggtgaggtttactgaagcctgaaggagttggtccaataactgggtccgggcggccccggtgtgtcgttcaaatctcccgggggaaagagatgaccggggggcacttgtgtgcgccctactatggcgggaacgcttatacgccactttgtttcccccttgtc

SEQ ID NO: 556707 - DNA, 971 bp, Homo sapiens
  misc_feature (663)..(663): n is a, c, g, or t
ttttaaagaaacaatttgtaaccaaaattttaaccccaaggattctcacaaaactatatttacaaatgacagcttgaaaaaaaatatccttgcccagtaactcaaagttcggtctctacaatgtcacccttaaatcgggcaggactattttggaaatcacaatatttgccctataaaaatattgtaccccgaacccagcctatgtttcctattatacagcactccaatatagagggactctttatgcaccttaaacgccaaaggtaacatctttcttgaaacctcttaaactattcttatcccccaatctgaggcacccctactgcccaggtatgagtatgtattggtatttttccaaaacacctctatatttatataagtcgcagctatttcggtatcttcccctctagaatggggctctgtgtttgttttccaacaagtaaatgtctttttatcaacagaactggtccttttgtctcccaattcttatttagtctgcgcaggctctatattatccccatggtcttatggggaaacaaaaaaattataatactttctttcacgtatccacacatttttatctgcgcccacgattgcagttctacctgagttatttacaactatttcaacaaaacaaaaaacaccaatctctacccgcatcgngcgagcaggtatctccaacgcaaagggttatataaatctacgatcccttgtgctataacctaaacaagtttcaaacaggccaactgtctcccactactggggctcacaaacggggcaccacatcttggctcaggtttaacccactcttcctggggtatatacaacatgccgcttcgttattgaatccccattttacaaacacccataagaagatttttaccccttttggtggtccccttgttttcaaggacaacaccccggttttgacccgctaaatcttcaaaagctcccccacgtatttaagttca

SEQ ID NO: 556708 - DNA, 543 bp, Homo sapiens
  misc_feature (10)..(10): n is a, c, g, or t
  misc_feature (33)..(33): n is a, c, g, or t
  misc_feature (39)..(39): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (75)..(75): n is a, c, g, or t
  misc_feature (100)..(100): n is a, c, g, or t
  misc_feature (104)..(104): n is a, c, g, or t
  misc_feature (107)..(107): n is a, c, g, or t
  misc_feature (109)..(109): n is a, c, g, or t
  misc_feature (113)..(113): n is a, c, g, or t
  misc_feature (119)..(119): n is a, c, g, or t
  misc_feature (121)..(121): n is a, c, g, or t
  misc_feature (127)..(127): n is a, c, g, or t
  misc_feature (131)..(131): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (166)..(166): n is a, c, g, or t
  misc_feature (168)..(169): n is a, c, g, or t
  misc_feature (180)..(180): n is a, c, g, or t
  misc_feature (210)..(210): n is a, c, g, or t
  misc_feature (213)..(213): n is a, c, g, or t
  misc_feature (252)..(252): n is a, c, g, or t
  misc_feature (273)..(273): n is a, c, g, or t
  misc_feature (289)..(289): n is a, c, g, or t
  misc_feature (298)..(298): n is a, c, g, or t
  misc_feature (310)..(310): n is a, c, g, or t
  misc_feature (317)..(317): n is a, c, g, or t
  misc_feature (324)..(324): n is a, c, g, or t
  misc_feature (331)..(331): n is a, c, g, or t
  misc_feature (356)..(357): n is a, c, g, or t
  misc_feature (362)..(362): n is a, c, g, or t
  misc_feature (383)..(383): n is a, c, g, or t
  misc_feature (419)..(419): n is a, c, g, or t
  misc_feature (425)..(425): n is a, c, g, or t
  misc_feature (433)..(433): n is a, c, g, or t
  misc_feature (440)..(440): n is a, c, g, or t
  misc_feature (444)..(445): n is a, c, g, or t
  misc_feature (449)..(449): n is a, c, g, or t
  misc_feature (455)..(455): n is a, c, g, or t
  misc_feature (461)..(461): n is a, c, g, or t
  misc_feature (464)..(464): n is a, c, g, or t
  misc_feature (474)..(474): n is a, c, g, or t
  misc_feature (476)..(476): n is a, c, g, or t
  misc_feature (497)..(497): n is a, c, g, or t
tagtttccanaatttggctttattttgcagtanaaaaancatttggagccattttganananaagtagaggcccngtcaagtcaaaaccgcattgcagcntggnccncngaanaagccncncccganaaanaaaanangcncnacncttgaccccctttatgtccncnnccccccccccncccccccaccaactttattaggttaaaacnccncaaacaggctttccccaaatgaccccccatgtctggggnttggttaaaattttatgcccncaaaaaccaaacttgnggctatgcnatttgggccccnccaaaanatttganaaaaaanaaaaaaaaaagtcaaagggaaaacnnccggntgccgtcccaaaccggggaanattcaatttagaatcccccgaaccccaagaggacanagggcncacaaccngtatggntccnncccntgagcngcagcngcncaaagccacncngattaaaaaattaaaaaaacngtctcaagttgtctgtgtgggtatcccaatgtttgtttaacttcac

SEQ ID NO: 556709 - DNA, 320 bp, Homo sapiens
ctgttgcccaggctggagtgcagtggcacaatatcagctcactgaggcctctcgaccttccagggtcaagcgatcctccctcctcagcctctctagtggctgggactacaggcaggcaccatcactcctggctaatatttttttttttttttaattttttgtagagacagggttttgtcatgttgcccaaactggtctcgaactcataggctcaagcgatccaactgcctcagcctcccaaagtgctgggataacagatgtgagccaccgtgcccggccacagaggcattatttttagcagggtgggcggtggattgtag

SEQ ID NO: 556710 - DNA, 430 bp, Homo sapiens
  misc_feature (98)..(98): n is a, c, g, or t
  misc_feature (117)..(117): n is a, c, g, or t
gtcattccagttcggctctgatctacaaaaaattcctgaagccatatatatacctctggtttccccctcgttagtcgtatatggccaagaaagcaatncagaattccatgatcaaancaaaggcaaagtaactttaagggtgcagccatgaatggattacctaaaggaccccatcatttaaaaaatggacctgataatatgaagcttcttccttgtaattgtctctgacctttttatctgagaccggaattcaggataggagtctagatatttacctgatcctaaccaggaaatatatgatatcggtatttaaaatgtagttagttatatttaatgcccccattcctaagttcctttttggttaatgaagctttcatttcggttatggcggtttgaataatatgattaaatagaaggtttgtgccggtag

SEQ ID NO: 556711 - DNA, 762 bp, Homo sapiens
gcagagcgagatcatggagtactcgtgtgctgctgcctcgaacactcttccagaggacgaaagtgccggaggggggaggctgagaagagactcctcctggtggacttcatgcagccaagccctgttccagcgacaagaattccaggccaagtcctgggtgagaaggtcttggggattgtggtacagaacaccataagttagccaacctcacggagtccctgtggttgctcaccttccagcgatccgcatgctacagccgacagtaatgtgacgtctgctatatgtgtgttctggtgttgaagacccctacattgagcatacccggggcattggatccagtgctgggtgtgcaagaccgtcaggagcagaaatcccaatacatcctgcttctgcaaccacttgacctactttgcagtgctgatggtctcctcggtggagtgtggactgccgtgcacaagcactacctgagcctcctctcctacgtgggctgtgtcgactctgccctggccctgccttgtctcccatttgccgccgtatctcttgctccagtgaggaagcctctgggactacatccattcgtggttgcacttgatccctgctgctgggccgttcttccttgcttggagcacgagcttccttgctcaggcgatgccggtggcccttgcacagggctcttgagggcctggttgccgagcccatggccatcttcccttgcactttctcccttggttcacctgccttttcctggaattgggccctcga

SEQ ID NO: 556712 - DNA, 199 bp, Homo sapiens
aatctagaggatacccaagatgtcagagtggacaagttggatccccggcccatcctctcctgcagtggattatctctatgcaatcaggtcacacattgtcaatacatacctctcatgcaggcagctttaagttcatgcacacactcacaccaagttgcctcctgactgagcagccctcctgtccaaggtaggctcgtgt

SEQ ID NO: 556713 - DNA, 391 bp, Homo sapiens
aaattctcgagcatttactccattccaaaacatacagtcaggttgatatgcatccattatggagtctgacttctacactatccagactgattgcatataacctcaatcacaaaatcatcttaaaacccaaggatatccgtaactcttattgttatccacggctttaatacctccaaatttactttactcatgtccacctttttatctaggcattctagcaaataacagctgcttcagtagtaacttactagtcttgttgctgaacctgattatcctgtactgcacttgttccgaggaaaaatcacgcgtaccatcttgccgactcgctcggagatcgctcccatatcccgggggtacaacgagcagacgaccatacggaacgaaccacgct

SEQ ID NO: 556714 - DNA, 329 bp, Homo sapiens
accggacgtggctgtcgattcgagaaatcagggataacaatttttttttaattaaaaaaaagggttactggaatattaacataatttaatggctcttaatttaaccaaaaattttttacacggattggtaaactccacccattaccgtatcgaagtgaaatccatctctcaggaacatacagttatgggtggaatgtatctgatgctgagagtccagcatatttaagaaaaatcctggcatggtcatggggttctggtggcagtcttctggtgtacaccctctcaaaaagcaaagaattccatctgacttcccggtagcgtcgaaaaaa

SEQ ID NO: 556715 - DNA, 88 bp, Homo sapiens
cttttgcggctccacgtcggcaccagctgcggggcaagatggaggcgctgattttggaaccttccctgtatactgtcaaagccatcct

SEQ ID NO: 556716 - DNA, 1014 bp, Homo sapiens
  misc_feature (629)..(629): n is a, c, g, or t
gccctttcaattgatacaacaccaaacaaccagcaaaggcatctgcaggtgcacagcaagtggcacatgttcaacaaccgtgcaggcatccaggccatcgtgtgcacatcatcaatgctccacacaggtgctatcatgtgcacatcattagtctttgacaccacaagatcatcttccagcatatctcgttggcattgcaacacattgcattgccagcttcatacatcatgcttgccagccagcatatccatcacacagacaggcacaacacacaacactgcattggcgaggatagattcctagtcttcattatgcaattctttcaatatattgcaatgcatgctcatgctacagcaaaggcaggtcacaccacaacacaatgcgaaacaccccaaacatgcagaactctcttaaatggatgaggtatattgtataaatatctcaacttatgttccaccgttaactactctcatctagaaccccactttacctgctgactggttacacacgttaacgcaacataacttaacgcataaccgaacaacaacaacatggccaaaccaactgtaataccattccacttggaacattaccataggcccttataaataacaacgtaacctgtcacngttctcactggcccacatatatatagacttaatactatataagacaaacgttctgtgggggtaggcgacaccccaaaatggacattgcgatgtccagtatgggctcggcagtcgcaaatgatgctttatcaaacacccaaacgggagggataataaatagattccctctctctcgagtcgacctgtttttttccagccgaagtgaatcgcaaatgttaccgcacagcgtattagtatgctgaaaccgaatttgggaacctctaccgacaccctcgcagtattaaaacacccgatggggagtttaacccgaccgatatccgttataggacggatagtaacaatcaactaccttacacaaaatgatgcagtgtagtgagagccacaa

SEQ ID NO: 556717 - DNA, 116 bp, Homo sapiens
ccagagtactgccctccaggggaactcaatttctagaagtctctgggcccagcactctttatttctcatcggagccctccctacggctttcattcttttttaaaactagacagctg

SEQ ID NO: 556718 - DNA, 225 bp, Homo sapiens
ttgacttcggcagctgactatactcaatatctccccactgcagtgtacacgcaaatatccctagaatatagggtactccttaaacacatctgagcactgacctggatagagtgcacttgggagacctggtgacaggcacaaaaagcatgatcagggctagcctcaatacaggaagaaatcatggctatataaaaatactatacctgagtcagctgacggacattc

SEQ ID NO: 556719 - DNA, 824 bp, Homo sapiens
  misc_feature (394)..(394): n is a, c, g, or t
gttatcttttttccttgaagggggaaaaaaatgtgagaagtgtttcttggcgaaattccctggctgcccttttggtggggaacttgtttccagccaaaggtttcttttatagagggcaattagggtatttccacatcagaaacaattaagtaatgttctgtgttttccatctggtgaacattgttttatggtggtcttaatttggtggttggctgccaactgtgttatacatagtatatggaaactttgtaaaacaaaggtttctcgaccaaattcacgattctttaagagatgcaaattcaccttttagcctactataaaaccaccttttagttgcgggttttgactgccccttgagcttctatggatatcttaaatgagtagtcaccttaantacttttgcacatgtaacatttgtctcactcttgagtgagggcaccttttcttgtggacaataatcggataggggcccaatagccaccaataacattgttatcaccaatccaactgtgtttctttgtgatccctatttccatagagccagtccagtctcacagaggttgactgccacttccagtgtctaaactacgaccacagttgttactcaaggtgatttccagttgatagtgaaactccagcctgggccactttctggataaactgtgaaaatagttttataagatcatgattattgaagataaccttttgggaaattttaaatgttcgctgagccgcttacactacttttggatgtagccctttttaagtatcttgttacatttacttttttaaattaagaaattaccgaagaatgtccagtaata

SEQ ID NO: 556720 - DNA, 589 bp, Homo sapiens
  misc_feature (137)..(137): n is a, c, g, or t
aatttgggggggagagggcacaaagaattctccccccccccacgtggtgtgggggggggccccccaaaaaaaaccctccttttttttttttaaaaaaaaaaaagggccccgccccggaattttttttttaatataancccctccccccaaaaaaggggggggtgttttcctcaaggggggcgcggtttttttttttttttgtgccccccccccccccccccccctccaaggggagggggcccccttttttttttttttggagggcgccttaaaaaagggggggggcccccccccggggggtttttttgaggggggggggggggcaaccctccccccccccgtggtggggggggcaaaaaaaaaaaaaaaaaggggggggtcttttgggagggccctccctccaattgtggggggccccccccccccaaaaaagattttgtgggaaaaaaaacggggggcaaagggggcccccaaattttcccccgaataaacacccgggcaaaaagggcttgaaaaccccccgggcccccaaagggttgggaaaaaagggggttaatttggaaagggtaaccggggtttcccctggact

SEQ ID NO: 556721 - DNA, 409 bp, Homo sapiens
gctgtgtgaacccctcgagatgcttttcgccgtatacccgtagaatcagctgagtcatcaggccgtccgaggtccgtggagcgccagaatgcggaccatgcagacctggcgtgcttactttgccgctgccttccacgcctcaatctcattcatgggcagctcattggcgggctcctctgcacggaccccaagccaggggctgacaagcgaagatatacacctggaaggtgcgtatcgcgctgcgtctaggaatgggatacgtgaaatgctagttatgcatgtacatggtagacaaattcacaagcgtagaacacgcccatacatgtgcacacttatgtagtgccagataggagaccctgacacacccaccttctcagctgggctctgcgtatcccccagccttaaggga

SEQ ID NO: 556722 - DNA, 692 bp, Homo sapiens
gaacagggaaaagtatgtaatgcagtgaactaaaaggaaacaccctgggacactgacaagcactgggcagcctggactgtcacaaagcactaaagatgctctcaggagagatggggaatggagaggaagaggagtaatgtcacaatttatacactattcaactttcatcccaaggcaattctgattccatattctccatcaaatagcctgtcaatcaaagaggaaaacaaaaaaactctaacttccactactaccaccatctataatggcaaaatcatatgatcattaatgctcctcaaattctagctcagcagatatgtactgcactgaatctgatgtgcattttccattactttggctgaactgatcaaaacagaaaaattctaaattaaggtacagttaatctctctcaaaatttttatccttcgtagattcattataaagctattggtaatattaacaggatttttaaggataacaaaagaggaaaatacaccatacaaaatgtcatacctggtggtacttcctgcttgtcttccacaggaaaaatgcttacttctaaaataaataatatagttataatctgttacatattgctgatcagtggtttatgccgtgccagatttaagtaatgatgatacttttcataagattttaaacaattcaaatgttttaatcatcactggcttctt

SEQ ID NO: 556723 - DNA, 550 bp, Homo sapiens
atgtatatagaaagagtagtgcctacctaatgaaattacaatagcgcttgtcagtgtgtaacgtaaactgcctgcctggaacatagtaaatgctatataaatatttgaggttttataattaattgggacatctgtatagtaaggactgttggcattgcttctggaattccccttgaatttcaaataatggaaatcaaagctcagagagcttgattaactatgtccaaaggccacacaaccaaaacttggcccaggtaggggatccaaacaccaatctctgaactgtaaaactcatacacttaacatgattctccattgcctcccattactggggggacctcaagaagctaactgtccagcaatggttcttaacgtggcctggagtttgtcagattcaggggaggctgaggtgggatggggacagcagggaaaggctgtggaagagcacggacaggtctaggagcctgagtagggggggtgtctcctgcccaccctacctcgcctcgctcccgcactcctcttctcgctttgtctcacttgtctccccatg

SEQ ID NO: 556724 - DNA, 1213 bp, Homo sapiens
  misc_feature (686)..(686): n is a, c, g, or t
  misc_feature (1213)..(1213): n is a, c, g, or t
gtaaagatgtgcggcggaggaacctggggggcagaagcaggagccagctgggcatgcgactcctgaaggtgttaactgtctggcctatgatgaagccatcatggctcagcaggaccgaattcagcaagagattgctagtgcagaaacccatctggtgtcacgagcgagctggcagctcgtggggtcctcatacaacggagtactgctgcacagatgaccaacatactatcatacagacagatcaagagacctccacgaaaaagtactcgatacatccgacaagaccagtgcctgaccggcaacgtgtatctattcgaggctattcggcattctaccacacttggcaggcacttgcatggcattgacatcacaggcagttgacagcaggattccaatggctagtgttctgccaaaggagccaaagggcaagaaccttggctggtcacaggggcgtttcacttgcaatttcaacaaatctgacgcgacttatccaacgaaaccacgatacgatgggaaccattgaatatgaagacagggtgtgggaagaaaagccaagaagccctacttggtacggaccagaaccctggccttgggaacataccatttacacatagaccacaatgaaggcgaaacattaccatgaaaagttaacgcgtatggtgaagcgagtcattacaccattagantgagtggcttaggctatacgagcgcgtaccgcaggagcctaaagccctagagcaaaggatcaggctgacagagcatgacacaacagatattcacttctcccagaaaagacgcatgcatcatcacatttcacgagaagggcaggttcggggcaccctgagagacacctttcggttacccacagagtggacacagttacacgttaagcacgcaaatggccaaactgaggaaatagggtctagggacaaatcccccacaattcagcaagagcacaagaagtagcaaaggcaaacggcctaggaaaccgtccaaaagcagaatatacctcgagtagcaaggtatccgacaattataggccatacccatataggtggcaccacaaaaagtgggttaacacacaccatataccccacagtgagtaggattttggtaaccaccacaaagtacccacaacaagggaggagtaagagaagacagggatatacaccaacaattcagggagcatcatcacaccatagatcaagtaggn

SEQ ID NO: 556725 - DNA, 197 bp, Homo sapiens
gagagggtcccgtgcggctgttggtgcgaggaagcggtagcacaagtacacccgactcgtgagtggctctcatcctggacagtgtatttggcacacagccctaggtattccatagcttgatggttttatctcggagatccagagacaatctgccggtcgtcagaggagaaggccacactcagcaccacgaatcgccg

SEQ ID NO: 556726 - DNA, 195 bp, Homo sapiens
tgtttgttttgctgagcacttcctctattcatttcatccccagacccctgtgcctctggtccctatagttttactttctccagaatgtcatactgttggaatcttagagcatgcagccttttcttttcttttcttttcttttgagacggagtctcgctctatcgcccaggctggagtgcagtggcgcgatctcgg

SEQ ID NO: 556727 - DNA, 137 bp, Homo sapiens
gcttcggtaccgcatcttgctcccatcagcgctatatgggcagcactatgcttctgtccccaagcacaagttaaccctgtagtctttgtaccaggctgtttgtgatcgtatcagccgctatgtgaaacagcctttac

SEQ ID NO: 556728 - DNA, 790 bp, Homo sapiens
  misc_feature (398)..(399): n is a, c, g, or t
  misc_feature (432)..(432): n is a, c, g, or t
  misc_feature (484)..(484): n is a, c, g, or t
  misc_feature (501)..(501): n is a, c, g, or t
  misc_feature (518)..(519): n is a, c, g, or t
  misc_feature (556)..(556): n is a, c, g, or t
  misc_feature (558)..(558): n is a, c, g, or t
  misc_feature (565)..(565): n is a, c, g, or t
  misc_feature (572)..(573): n is a, c, g, or t
  misc_feature (578)..(578): n is a, c, g, or t
  misc_feature (585)..(585): n is a, c, g, or t
  misc_feature (770)..(770): n is a, c, g, or t
  misc_feature (780)..(780): n is a, c, g, or t
tcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccagnnctgcaagaactgatcccctttgtgaagcctgcncccattgagcaggagccatcaaagaagcagaagaagcaacatgagggcagcnaaaagaaagcagcaagnaagagacgtcaccctannaaaacaggctgcagaaacatggaggtcacacgatggntngaaacanttcctgnnctccntatttgnccaggctttcatttctgtctgcgtgagatgatcacgagcgatgcccaagcagcaagggaagcctaagcacccattcatcccctgccaccgatctgagctgcgtaggtgagaggggaccagtgtccatgtacgacacagatgttcctgtctaattcgcctgggcatagcgatccataattgatganttgatgcaancatgttatta

SEQ ID NO: 556729 - DNA, 160 bp, Homo sapiens
  misc_feature (10)..(10): n is a, c, g, or t
  misc_feature (20)..(20): n is a, c, g, or t
aaaaaacaanaatccctggngaccaccaggaagaagattgcccgaacagaccccacacgcgaagcgatccgcacaaaatgccgcattgtaattcattgagtgtcatgtggtattaatcgcaccatcctgaaaatgcaaatgaataaaagtttggtcaatg

SEQ ID NO: 556730 - DNA, 114 bp, Homo sapiens
tcagtaggggtcgtctacgtgtcccatggacaactttatcttagtaaacaagtgcacattatgtcagttatttgcatgtttaaatattatagtctgattattgtaaacaaacaa

SEQ ID NO: 556731 - DNA, 3168 bp, Homo sapiens
  misc_feature (270)..(270): n is a, c, g, or t
  misc_feature (300)..(300): n is a, c, g, or t
  misc_feature (313)..(313): n is a, c, g, or t
  misc_feature (364)..(364): n is a, c, g, or t
  misc_feature (366)..(366): n is a, c, g, or t
  misc_feature (379)..(379): n is a, c, g, or t
  misc_feature (449)..(449): n is a, c, g, or t
  misc_feature (472)..(472): n is a, c, g, or t
  misc_feature (495)..(495): n is a, c, g, or t
  misc_feature (497)..(497): n is a, c, g, or t
  misc_feature (521)..(521): n is a, c, g, or t
  misc_feature (745)..(745): n is a, c, g, or t
  misc_feature (754)..(754): n is a, c, g, or t
  misc_feature (762)..(762): n is a, c, g, or t
  misc_feature (777)..(777): n is a, c, g, or t
  misc_feature (779)..(779): n is a, c, g, or t
  misc_feature (3004)..(3004): n is a, c, g, or t
ggcaaccctcaatgaccaattccccttttatatagtttggtatctgaattagaatcccagaatctacaaattcctctgggtgtgggtgctgcattttaaggattttataacactgccatcaccaagctctcttttgatattcactttaaggagataatttacgggcaaccagagagcataaaccaaagtagatatctatctagatagctagatacatctccatatcattgacaggatacattctggccgagtgtgagtacaacctatggntgtggttggagagaacatgtgttccacctnaatggcagatcangattattccttctcatctgctgcaatggctcaatgtgttaaggagaggagngngacagcaagaacngcattcattcagtcatacagaccaaaaggaggaatgtcgcccagccctctaaactgacccagaacccagntcatgtctcaactgctacctctnctacttagaaagaagtaactccncnaaagcagggttctggacaaatatntttttattgatcatatacaaatagatgaagatggacttggatgttaagaaaaataatactatacaaaatcgagagtagacagttgcccctagacttaaattaaaagtgtgcacattagataatttaatccaatgtatcaggtaaaaacttgaacaaaccttttggcctcttccttaaaattcagggaagcatgtcctccacaaaacagaatcaaaatataaatnaaagactgncttaagangaaaggaaaccttananatgaaaagaagccagatgagaggcacttaactaagaatgaaaagaaactgagtggacaaaataattatgagaagatgaaccttcaaatcagaaagagggaaaaaagcttatttgatactatgggaactcaaaagagagtgaacacaaatgtgaaaattccaagagtgaagaaaagtatcataactacatttagagcatgagaaaaagtatacaattttgagtaataagaacagaaatcaaaagtaactattgtatgctgtattttagtagagcaacactgaagaagaaagaaaacaagaaataatattaaatatgaacatatggagaacagaataatatttttaaaatttttagtttctaagcttatctgaaattttaattttcttttcttatgtaataccagagttattaggaaggtattatctaataacactattttcagtgatattttaagtagttgtcctagaaaaatttctattttttaaaaatgtatatttaaaaatacattaaatgtgtatatacatcaatcatatgtatcgatttctgtttttcttgaattgcaaatgaaatttgtatttttgtgttcctggaataaaataaactcgaatgggtcgtaatatattattcatgctgtaattcaacgtatttgaatactttaagaatgttacatttatagttaacagatactgacctataaattttctgtcatataatgatgctgtgagacaatctgagaagaattaaaatttaaattcatgtattcctacttttttctctattctctaactgtaaaatattttcattacagatggaggaacaaatagatgttagataaatagatatataatagatcatccaaaattcttattcttatggttttatgtagtcagtatttacctctatttttctacatgtttatccttccaatttagttcattacttcctgcacctttgatgtcatatacataaacaggaaataacacatggtggctgggatgtagagagagccacaggacttgtgaatgaaatccacaggcaaggatgtggcgattccttttgcaatattggagggaatgccaaaccctatgtttgctgtggaaaagagtatggtagttcctcaaaacatcaaaatggtattgccttatgattcagcagacccacatcccaagacagcaaaagaattgaaagcagagtcttgaaaaaatatttgcacatccatgtttgcagcagcattattggcaatagctaaaacgtagaagcaattgaactgtccaacaacagatgaatggatgagcaaaacatgatatatacatacaatggaaaattattcagccttaaacgagggaaatattctgacatatgttgcaacttggatgaaacttgaggatattatgccaagtgaaataagttagtcagtgaaggacaaatacagtataattccatatgtataagggacttgaagtggacagaatcatagagatagtacaatgatggttgccagaagctggggggaggaagaaatggggaagtattgtttaatgggtatagtttcagttttacaagatgaaacgaattatggagatggatggtagggatggctgcacaatgttatgactatatttagtaccactgaactgtacacttaaaatgtttaacagagtacattttatgttttatgtatcttaccacaataaaaaaataaaataccttaggaacattttcctgaaagagtccacataaaattcattttaatgcatgtgtttatgcatagctttctatttttctcttttctctttacattccaaattagaatataatgctaatcaagtatagtggctgcgtttctttcttcctctagtctgcaggtagcatacaaatgtaataaagtactcattcatgtcacatctatttattttctgccttataccaagcttgtgggattctcttaaatacaacatttttatacttacacctatgcaatacccattagcatcgccttcctaaatcaggggaaattgagtctctgtaaggtgcagtaacttactaagatacaaaactcagcattaaagtctgtatacttcaatatcctgccctcttctcatttgtctttactgccttttatgtatgtgttagatgttcaataaattctcttttttaaactgaatttaagccgtggagcagtgttttgttgaacactaacatatgatatggacactcttcctccnctttcatttatgatgcagtttcatgacaaagagaaaattctttcactgtggtagaagctttaaataatgaaatgccactttctacctttaacagaactgagggactcaggtgaatggctgagacttgacaaccagggcgacataatcctgtttaattccccctg

SEQ ID NO: 556732 - DNA, 422 bp, Homo sapiens
gtctgagctggggaagatggctcccattcaggttggaggggcttcggcagcccctcatgctggtacaggggcatgtgtatctctggctcttctccagaaggcaccaccacagctgcccacttctgggaagttctatctccggcgggtctgggtctccacaagctcggtgtccggagttgggtcctcgccatcccgctgccaggtcagtgtgatctccgcagggtagaagcccagggcccagcacctcaggggggcctcagggtcagagatggggtggtgggtcacatgtgtcttgggggggtccgcgcgctgcagcgtctccttcccgttctccaggttgtctgcggagccactccaggcacgtgccctccaggtaggctctcagcggctcggccacaggggcggcttcccagtttgctcag

SEQ ID NO: 556733 - DNA, 419 bp, Homo sapiens
ctctgcttttatgattcatgttaagcttttgttcatttaagctagaacttttctatttatacagatcaaataagaatttagtaggcttcctacctatttcacttcaaggagcaccatgatcaattagccaacactacagttctgtgcaaatcagactattgtgattgtggctttgactctgttgtccattatggttaacaatgtgcaccttgcctttggtaatggagtactgccacttggcccctgccaccctgtgatccaattattcctattgcatttaagtttccaactcagtgattgcagttccctctgtaatgtatggcctaaagagaagagaaatcatggagctcttgaagtatgctggggtctcctcataaaaatttttcacagaattggtataaaggaaacaaaaaaaaaaa

SEQ ID NO: 556734 - DNA, 2941 bp, Homo sapiens
  misc_feature (270)..(270): n is a, c, g, or t
  misc_feature (300)..(300): n is a, c, g, or t
  misc_feature (313)..(313): n is a, c, g, or t
  misc_feature (364)..(364): n is a, c, g, or t
  misc_feature (366)..(366): n is a, c, g, or t
  misc_feature (379)..(379): n is a, c, g, or t
  misc_feature (449)..(449): n is a, c, g, or t
  misc_feature (472)..(472): n is a, c, g, or t
  misc_feature (495)..(495): n is a, c, g, or t
  misc_feature (497)..(497): n is a, c, g, or t
  misc_feature (521)..(521): n is a, c, g, or t
  misc_feature (745)..(745): n is a, c, g, or t
  misc_feature (754)..(754): n is a, c, g, or t
  misc_feature (762)..(762): n is a, c, g, or t
  misc_feature (777)..(777): n is a, c, g, or t
  misc_feature (779)..(779): n is a, c, g, or t
ggcaaccctcaatgaccaattccccttttatatagtttggtatctgaattagaatcccagaatctacaaattcctctgggtgtgggtgctgcattttaaggattttataacactgccatcaccaagctctcttttgatattcactttaaggagataatttacgggcaaccagagagcataaaccaaagtagatatctatctagatagctagatacatctccatatcattgacaggatacattctggccgagtgtgagtacaacctatggntgtggttggagagaacatgtgttccacctnaatggcagatcangattattccttctcatctgctgcaatggctcaatgtgttaaggagaggagngngacagcaagaacngcattcattcagtcatacagaccaaaaggaggaatgtcgcccagccctctaaactgacccagaacccagntcatgtctcaactgctacctctnctacttagaaagaagtaactccncnaaagcagggttctggacaaatatntttttattgatcatatacaaatagatgaagatggacttggatgttaagaaaaataatactatacaaaatcgagagtagacagttgcccctagacttaaattaaaagtgtgcacattagataatttaatccaatgtatcaggtaaaaacttgaacaaaccttttggcctcttccttaaaattcagggaagcatgtcctccacaaaacagaatcaaaatataaatnaaagactgncttaagangaaaggaaaccttananatgaaaagaagccagatgagaggcacttaactaagaatgaaaagaaactgagtggacaaaataattatgagaagatgaaccttcaaatcagaaagagggaaaaaagcttatttgatactatgggaactcaaaagagagtgaacacaaatgtgaaaattccaagagtgaagaaaagtatcataactacatttagagcatgagaaaaagtatacaattttgagtaataagaacagaaatcaaaagtaactattgtatgctgtattttagtagagcaacactgaagaagaaagaaaacaagaaataatattaaatatgaacatatggagaacagaataatatttttaaaatttttagtttctaagcttatctgaaattttaattttcttttcttatgtaataccagagttattaggaaggtattatctaataacactattttcagtgatattttaagtagttgtcctagaaaaatttctattttttaaaaatgtatatttaaaaatacattaaatgtgtatatacatcaatcatatgtatcgatttctgtttttcttgaattgcaaatgaaatttgtatttttgtgttcctggaataaaataaactcgaatgggtcgtaatatattattcatgctgtaattcaacgtatttgaatactttaagaatgttacatttatagttaacagatactgacctataaattttctgtcatataatgatgctgtgagacaatctgagaagaattaaaatttaaattcatgtattcctacttttttctctattctctaactgtaaaatattttcattacagatggaggaacaaatagatgttagataaatagatatataatagatcatccaaaattcttattcttatggttttatgtagtcagtatttacctctatttttctacatgtttatccttccaatttagttcattacttcctgcacctttgatgtcatatacataaacaggaaataacacatggtggctgggatgtagagagagccacaggacttgtgaatgaaatccacaggcaaggatgtggcgattccttttgcaatattggagggaatgccaaaccctatgtttgctgtggaaaagagtatggtagttcctcaaaacatcaaaatggtattgccttatgattcagcagacccacatcccaagacagcaaaagaattgaaagcagagtcttgaaaaaatatttgcacatccatgtttgcagcagcattattggcaatagctaaaacgtagaagcaattgaactgtccaacaacagatgaatggatgagcaaaacatgatatatacatacaatggaaaattattcagccttaaacgagggaaatattctgacatatgttgcaacttggatgaaacttgaggatattatgccaagtgaaataagttagtcagtgaaggacaaatacagtataattccatatgtataagggacttgaagtggacagaatcatagagatagtacaatgatggttgccagaagctggggggaggaagaaatggggaagtattgtttaatgggtatagtttcagttttacaagatgaaacgaattatggagatggatggtagggatggctgcacaatgttatgactatatttagtaccactgaactgtacacttaaaatgtttaacagagtacattttatgttttatgtatcttaccacaataaaaaaataaaataccttaggaacattttcctgaaagagtccacataaaattcattttaatgcatgtgtttatgcatagctttctatttttctcttttctctttacattccaaattagaatataatgctaatcaagtatagtggctgcgtttctttcttcctctagtctgcaggtagcatacaaatgtaataaagtactcattcatgtcacatctatttattttctgccttataccaagcttgtgggattctcttaaatacaacatttttatacttacacctatgcaatacccattagcatcgccttcctaaatcaggggaaattgagtctctgtaaggtgcagtaacttactaagatacaaaactcagcattaaagtctgtatacttcaatatcctgccctcttctcatttgtctttactgccttttatgtatgtgttagatgttcaataaattctcttttttaaactg

SEQ ID NO: 556735 - DNA, 152 bp, Homo sapiens
aaccttagatcgagctggtaccgactgcatctgtgctccatcactgtactcccttgttcaccccagaagcaggaagaaggtcaagaatcagacctttggctgggcatggtggctcacacctgtaatcccaggactttgggtggccaaggcag

SEQ ID NO: 556736 - DNA, 243 bp, Homo sapiens
  misc_feature (28)..(28): n is a, c, g, or t
ggtgcccaaaaaggttgggcactgctantctataccgctgtaggatgactatagttaacaataatatgtagtttcaaaaagcctagaaggaagacattgaatgttcccaacacaaagaaatgatacatgtttgagatgatggatatgctgattatcttgatctgatcactatacatgatatgtattgtaacatcacctaggtaccccatgaatatgtacaattatgtgtcaagataaataagt

SEQ ID NO: 556737 - DNA, 752 bp, Homo sapiens
  misc_feature (514)..(514): n is a, c, g, or t
  misc_feature (522)..(522): n is a, c, g, or t
  misc_feature (534)..(534): n is a, c, g, or t
  misc_feature (546)..(546): n is a, c, g, or t
  misc_feature (553)..(554): n is a, c, g, or t
  misc_feature (562)..(564): n is a, c, g, or t
  misc_feature (571)..(571): n is a, c, g, or t
  misc_feature (578)..(578): n is a, c, g, or t
  misc_feature (589)..(591): n is a, c, g, or t
  misc_feature (593)..(594): n is a, c, g, or t
  misc_feature (597)..(597): n is a, c, g, or t
  misc_feature (639)..(639): n is a, c, g, or t
  misc_feature (644)..(644): n is a, c, g, or t
  misc_feature (646)..(646): n is a, c, g, or t
  misc_feature (663)..(663): n is a, c, g, or t
  misc_feature (677)..(677): n is a, c, g, or t
  misc_feature (747)..(747): n is a, c, g, or t
cggagaggagcggggcgggcgccgcgcgccgccagggcgggggcgcgcccacggagagcgggggacgccgaaaagggggaggcagcgggcaaaaagggcacggggccggcgggaggcaaggcgccgaggcgaccagagagggggaacggggggcacaccaacgggcgcaaaaacaacagacagcccgaggcgggcagggaaggagcagggcagcagacgagggcggaggcgggggggacgggcagagcgggggcgcgaaggcccagagggcgagggggggggacgcaccgcgcgggccagggggcggggggaaacagggggcggggaggccgaaggggggcaccaaccaaaaccgggcgccgggggcagcggagagggaacacaacccaaaaacgagacgccagcggggcggcccgggcggccgcagcccgtaccagcacggggcagggcgaaagggcagcggagtggaggaaggtgccgtgaacggccggtgtgggaggggaagagaaaggtnataggcgncaagaagaccanaggaagcgggtntgcgccnnaagaaacnnnaagcctngaatganagcaaaaaggnnnannccncgcagcgaaggagagcgggcaaaggcaaaaggagaaaccggngccgnanccagcgcaggggcccgngcagcagcgagaangaggagaaggggagcagcaaggccggcagaaacagcccggggaaggacgcggcggaagggaagcaagcgnaacag

SEQ ID NO: 556738 - DNA, 349 bp, Homo sapiens
cctggacatgcatatctggcaacattgaacacaatgaaagatgtgcttaatgattcagaaaataaggcccaggtgtctgtgaatgtccttagtgatcatgacaaggtggagaagtccctgcaagaaaaaaagtcctgtgatgaaatccttgggaatcagaaacctgcattacattaacttgcagaagaaactaaggctctggagaaaaatgttaagcctgatgtagaaaagttatgtaagcaagaatttgatgatttgcaaggaaagtggaccaagcttaaggttttggttaccaaagatatacaaatgcttgaggaaaatgctatcacaatcagagcttttgcggccg

SEQ ID NO: 556739 - DNA, 197 bp, Homo sapiens
gcagaaaaaaagtgagaacattttgattccccttttttttacttgatggggtttatgaacaacccgtagggcctttatggccagtttgagtcccgcccactttgacttttacgttcccattcctgggttacccccttcctcccgatttgttcccctattttgggctttaaatttcaataaaaaactttctgagggga

SEQ ID NO: 556740 - DNA, 364 bp, Homo sapiens
cgatacatcagccaagctatagtaatagatatagaattaggtgcaatcaaggcttataagagtgaatttcaagttgttaccagtaaagtttgtctttttcattcagcctgatgcctttaacagaaaactcagatgagtggattggtcacgtgagatggcagtgacaaaaacttcagtttaaaatgccttatggatctgtattggcattccttcccgctgatgaaattctaggagcttttagtaaattaaagctgcatttgcatgaagaagccagagaaattactgactggtttgaagataatgacgtgcatggtcggataagaagacatgccctggagttgctgtttgaccatcagtatcgtta

SEQ ID NO: 556741 - DNA, 154 bp, Homo sapiens
cctacagactgggtcctgcggagtggggcgttcactgatgacttccaggccctacgcggtcagaggctgagaccagtctccaaggaactggacccttttggacagtagagctgtgccagctgctgctggagtggcctggatgggggtgctgcgt

SEQ ID NO: 556742 - DNA, 441 bp, Homo sapiens
tggggaccccagggggacagaggcccaactctccctcccttgacacactgggtccaggaatagcaagaccctcccctcacacagggacaatattctcacagccagtttttttaaatctgtgagctgaaatcatgccaggtgattccagttgactgggagtaaggttggagcgttctccctacccccctcctgtgcggctaagagggtgctgaccgtctcccctgggcctggtgaccaagccagccttgtccaccctgacctactgtccagctgtaatcaccttttttgcagggtaccttccggcacactgagggctcgccatcttctgtggcgacatccctgaacaacttcttatactcagggccttgtgaaggaaagcgcgcgtccattaggctgtctgaagggaaagactagaacttcggagagcagggggtgtcctgg

SEQ ID NO: 556743 - DNA, 1761 bp, Homo sapiens
  misc_feature (1093)..(1093): n is a, c, g, or t
  misc_feature (1139)..(1139): n is a, c, g, or t
aactcctcccaccaaccgacaagagagacagagaaggacagagagagagagagacaacgaagaaacatcgtctcatgtctttcaatcttctgtgatgattatcattgtctgttcagtttgtgtgtgtcgtctaccatactactcgtcgttgtgtttctgaccattttttatcgttgggatagttccgctcattccctctcatttggatatgggttctcccacataataatcgtcttcgtttgtgtttttcccccagaagaggggctgctttccctattgttcattcacaaggggcgacatacaaggcttgcaggtgttgttgtgagacgccgcgcacacgctgtgcggaggggtcgtgcctctcagcaaagcgtgtttgttttttgttgcacacccccgtcgtcctcctttttattagtggggacactccacaatttatgctttttctcctcaaggaagcacgatcaatcacagttgtgggggaggaaatttttttccgacgtcgtattgattgtcgcgcgggggaggatccagtgtgcgatttgtgcaacagtctaaagtgggcttttatcatcgtgttgtagcccacgcaaatatggttctactttctgtgggcgtagaagttacgtatattgtctttcatcgggggcgccccacaaaacaccgtggtggtcgacaacaacagttgtgtggtaaaaaagcgcgtcttccccccgcccttataaagggtggtgggacaaaaaatattttttaggagagggacgcacaaaggttgtgtgtcgtgccgtctgttctacaagaacagtgtgtcctctctaataatatagcggcttttataatgggggtctctttcgtggggagaaaaaaaaccgcttaactatatctgttatacgataagaaactttcctccgcggagagaggttgttcttctgtgtcgtctgcaaataagatgtcttcctaccgaaacccccacgcattatgagatcctcgcgggttttataaagacttagggaactcgggggtgtctatatattttaatatctcactcggcgctctgcgagatagaagagatctctcgcggtgtatatagatnttgtgtgatatatgataaaagcagccactcttatagaggagagagngtcgtcactcttctctcttgtgccacacacacaaagagtgtgtcgcccactcttatatacacaccccctctctcacgcgagagagaaatatatatatagacaactctcgttctctgtttgctaaagaaactctctcatcggctgttatattctcgggggcgtctctatatatacaaatatatagacacagagcgtgtttctctcgagatatagtgtgtgcgcacacctcgtatgaacacacaggaacacctacacacaaatatagtgttaaaatcctctcgtgtgtctctttctctgggtgaacacacacagagtgtgttaaaattgttctggagaatataaaaaccactcgccccccacgcgaggaaattttcgcgggaatttgagagtgtttctctctccgatataagagacacaaaatatattgagatgcactcgcgagtatggtcacattaatgaggtgttttacccacctctcgagctgatacacgatatggaaaccccacttctctttttaatactccgagattatattattttgtggtataattggtggagaaaaactatacttgtgatgttttcactatatatgaaattttcccccataaacccgggtttttta

SEQ ID NO: 556744 - DNA, 700 bp, Homo sapiens
cgtggtggctcacacctgtaatcccagcactttgggaggccaaggtgggaggataacttgaggccaggagtttgaaaccagcctgggcaacatagttagaaccccatctctattaaaagaaaaatagtagtatgtagatagaacacatcaaaaatgtagaagaataagtagcaaatttaatgggttcaagggtaaagggaacgctgactttctctagtgtttcagttttctatttattttaacaacattaatgaatataaactgttagaagcagtgaagagtattttttttaaaggcatacttttctcagatgctattgttagataactatatgttaattttcatggttactaatacaaaactgggtatagaataaacgtatcctggctcccagtgtaggatgctttccattgtatcacaatgccctcagtcagctgtagcaatagactgtattcagtgtagttcatactaaacagggtaatttgattctataatttttgttccacattgacatcttcatatttaactttggatttaaacgcgacgaagggttttgaccttgttgaattctagaacatttcgaactctctttgccagggcccaggtggctcccaccctgtaatgccaggactttggggagggctgaacgtggggtggaatcacttgacgttccgggaaggttcgcacaatccggccctgg

SEQ ID NO: 556745 - DNA, 271 bp, Homo sapiens
gagtgatgtcatcaaaattaaacaattagctgagtaaaagcctaaattataaccatatctggacataaggggatgccacaagtggtcatgaggaagagattaatctctacactctcaaagccttggactaagagacattcattcattcaaacaaccctttttttttttttttttttggaaaggggttctttttggcccaggctgaagggggggggcacactcgtgggctcagggcaacctttaccttcccagaagtacacccggcgggggg

SEQ ID NO: 556746 - DNA, 744 bp, Homo sapiens
agcgaatgacctactctctttatcctctgactaacctgtagatcttcatcacacacttaattccttcatcctccttgcctatctcactctctgcaagatccctagcacctgtcccctttcgtcacctcttacctcaactacttggcacacgacaatcttcatactcagcgcttctacattctgggcctagcgaggagacgagaacaaggcgaagtagaaatatcgatccaggtaccagtgtgtatattgctaaacacgctcgaagcatgcgttctgtccccaaggcaaggagtgggagaaagaagcttttgagatgctagtcgtgacacggattccagcacaaacgagactcgtgttgtagagtcgagtgtaacaacactcagtcggactactcacccagttcatgaagtgagtcgacgtgatgtgggcctcgcacgcacactgatggctttcctgccttcattccactgtccctgccacagggacatgaatctcaatcctttgttgatgtgctgtcatagatattccatggtgtactgtgtgccatcgattttctttatgcagtctatcactctgactggtcattctgggttggttccacacgactttgctattgtgaaccagtgccgcaataaacataacgctatgcatgtgtctttatagtagaatgatttttaatcctttgggtatataccccagtgaatgagattgctgggtcaaatggtatttctggtctaaatcctt

SEQ ID NO: 556747 - DNA, 1062 bp, Homo sapiens
  misc_feature (999)..(1000): n is a, c, g, or t
cacgcgtccgattatttttgtcatttttttctttttattataaaagtaatgcaatgtagttatggggggggaaattgtactaaattctataaagtaaaaagtcaaagtcttttactgttcttcatcccacatcccattttccagagtgagctataattgggtgaatttttccaaactttataaatacacttgcaaacatttatacacagcaacctagataataatgttacaggcattgccttttcagttaatgtgtcatggccctttttctagactatgagtgcatagtcttctagtactaccaataacagcatttatcaagcatttactatatgccactaattctaacagctctgtgagacacttcatgaagaacttgaggttccaggtaattctgtaatttgcccaagagcacataatttatgggaccaggatttgaagcgaggcagcctgacctcaaagttcatcggtctttttgtttgtttgttttcctaagagacggggtttcactctgtcacccaggctggagtgcagtgacggatcatagctcactgctgccttgagctcctgagctgaaggaatcctcccgcctcagcctgcgagtagctgggactacaggcatgtgccactgcatccagctaattgttaagattttttgtagcgatgaggtctcactatgttgcccagactggtcttgatctcctggcctcaagcagtcttcccgctttgatctctgaaagtgctgggattacagatgtgagccaccatgcccagctaaagttcatgttttaaccataaaaataggtaatgctttagtacacatgtatgtaaataaaaatttagatattgccaaaatgaaattaagaatcttaaacaaggaccagctaagacctgcggggacatggtttcgcaaataattggaaacattaagtcatgtaaaagtagttggaaaagtatttttataatgttgaatgagtttattattactctgtggaaaannaaattatagtaacagcactgcagcagaaccaagactaccaagctttagtcagtgacttactc

SEQ ID NO: 556748 - DNA, 1222 bp, Homo sapiens
gatgattacttctttatagcccatcgtggatgaacggcggggcattggtggtatctttctttgatgactcttgactctccgctccaaggcaggaggctgctttcgcgtatcgtacagagcctgtgccagggctgtacgcttccttcttacacttccccttgtgcaaacaagcactgctgcactgcacctcattcaccccccaggcagacagctgctggcacgcagcctcagcacagcaggcacggctatgctacgacacttctaactcctgctgatatgactcgcgggccacaacagcttctggccctctttcacatccaaggatccagcacactctgacaacgctactcctctgactgctccttctaccctcataaccgtgcccgcactggcgagatacactggcacttcaacccatcagaagcaacttccacacagcaagtcctgcacacacttcctggccaagctttcctaccgcccactccaaacgcggcacctgggcgctgcgctctgaaatgccacgagcagcacatggcctgctgacagcggcgctatatggcagggccacatcgactgcttgtgctcacccactgcccactctgcgtccgcgcacctatctgcccaacctagtgctgcgcactgtctactcctgttgcctctacgctccttcttccacctcttgcaccccctatccctcgctgcgcgccccgcctgacttaacccactgcttctcggcgactgctttgctccagcctgcactgcacacttgcgctgcccgacttgccgccacgcactctgctcccgcaacgctccacctctgcacttcacacaccgatcaatgtctataccttctcctagatggctccactaactctaattactatgaacccttaagcactttcacaccaacacacatatgggcaccactttggaaagcatatacccacaacagggcatatttcgcaacgcaactacaccgggcgccacccatgttcgcacattaaagcgctacgtcccccaccctgctcctctaacaccgcacaaaccacttcgtccttaacagtccctaggaagacctaccttcggtcatctaccacccatgaaccaaattctatcaccaccaaagcctatctcatcatatagcttgtggcagacccaagacataaagcactaaccgtggaccgcgcggacagcagtacctactacctctcactctctcccc

SEQ ID NO: 556749 - DNA, 531 bp, Homo sapiens
  misc_feature (468)..(469): n is a, c, g, or t
tgactgagagaggtgccacagtacactaagacacgctgacacaagtgaaagtgtgtttacaaagctgtgccacagtcttagtaaaactgtgtcttggccgggcgcagtgctcatgcctataatcccagcactttgggaggccgaggcaggcggatcactggtcttgatctcctggcctcaagcagtcttcccgctttgatctctgaaagtgctgggattacagatgtgagccaccatgcccagctaaagttcatgttttaaccataaaaataggtaatgctttagtacacatgtatgtaaataaaaatttagatattgccaaaatgaaattaagaatcttaaacaaggaccagctaagacctgcggggacatggtttcgcaaataattggaaacattaagtcatgtaaaagtagttggaaaagtatttttataatgttgaatgagtttattattactctgtggaaaannaaattatagtaacagcactgcagcagaaccaagactaccaagctttagtcagtgacttactc

SEQ ID NO: 556750 - DNA, 242 bp, Homo sapiens
tcagtcggtacctgatgtatccccaacacttcaggaggctaaggcaagaggatcacttgaggtcaggagtttgagaccagcctggccaacatggcaaaaccccgtctctacttaaaagacaaaaattagccagggttagtagcacgtgcctataggagatcgagaccatcttggctaacacggtgaaacgctgtctctactaaaaatacacaaaattagccgggcgtggtgttgggcgataa

SEQ ID NO: 556751 - DNA, 781 bp, Homo sapiens
cgggttcctgggctccgggctctgggtggcggcggctgtgagcggcggcactgcggcgcaggcggcggaggccagcgggcgccgtcggcggctggccctgtcggccgcgggatgaggaagcggaccgagcccgtcgccttggagcatgagctgctgcgccgctgctggtgctccgtcctcctccggctctggccgccgctggctgctggactgcctgactgcctgcctgaagcagaacctcacgcctgactgggccctggtggctgtgttgagccgcgctagcgcagcctgacgctgggcaatgaagctggggctgcctggggcaggcgcaaaggcgcgtgtaggtttggcccctagaggaatgatactctttctggtgttttggggttggtacagttgcgcattccactttcctcatcacaactatgtcctggacatagcaggccaaagctgatttcctcttgacatttcgtacagagttccctaatttcattggatttgaggaaaaccacaggatcagggttcgaatcacacgtgtaacctactacctgcagccagaggaagacgtgaccattggagtctggcacacggtccctgcagtctggtggaagaacgcccaaggcaaagaccagatgtggtatgaggctgccttgggttccaggcaccctatcattctgtaccctgcatgggaacgcaggtaccagaggaggcgaccaccgcggtggagctttaccagggtgcctgaggtccccttgggtaaccatgttggtcacccttgaca

SEQ ID NO: 556752 - DNA, 129 bp, Homo sapiens
  misc_feature (104)..(104): n is a, c, g, or t
agcgcatggtctgatgagcatgctcgcagcatctatagctgacacttgtgcatctaaatcatcgctggcagagtgactggccactgcagcacagatgacatctncagaagcgtgcgacgctcgttgcat

SEQ ID NO: 556753 - DNA, 726 bp, Homo sapiens
  misc_feature (84)..(84): n is a, c, g, or t
  misc_feature (87)..(87): n is a, c, g, or t
  misc_feature (89)..(90): n is a, c, g, or t
  misc_feature (92)..(92): n is a, c, g, or t
  misc_feature (335)..(335): n is a, c, g, or t
  misc_feature (337)..(337): n is a, c, g, or t
  misc_feature (342)..(342): n is a, c, g, or t
  misc_feature (347)..(348): n is a, c, g, or t
  misc_feature (352)..(353): n is a, c, g, or t
  misc_feature (359)..(359): n is a, c, g, or t
  misc_feature (363)..(363): n is a, c, g, or t
  misc_feature (365)..(366): n is a, c, g, or t
  misc_feature (376)..(376): n is a, c, g, or t
  misc_feature (380)..(380): n is a, c, g, or t
  misc_feature (384)..(384): n is a, c, g, or t
  misc_feature (389)..(390): n is a, c, g, or t
  misc_feature (393)..(394): n is a, c, g, or t
  misc_feature (400)..(401): n is a, c, g, or t
  misc_feature (405)..(405): n is a, c, g, or t
  misc_feature (412)..(412): n is a, c, g, or t
  misc_feature (424)..(425): n is a, c, g, or t
  misc_feature (428)..(428): n is a, c, g, or t
  misc_feature (432)..(432): n is a, c, g, or t
  misc_feature (445)..(445): n is a, c, g, or t
  misc_feature (447)..(447): n is a, c, g, or t
  misc_feature (451)..(451): n is a, c, g, or t
  misc_feature (457)..(457): n is a, c, g, or t
  misc_feature (461)..(461): n is a, c, g, or t
  misc_feature (467)..(467): n is a, c, g, or t
  misc_feature (469)..(469): n is a, c, g, or t
  misc_feature (493)..(493): n is a, c, g, or t
  misc_feature (496)..(496): n is a, c, g, or t
  misc_feature (498)..(498): n is a, c, g, or t
  misc_feature (504)..(504): n is a, c, g, or t
  misc_feature (552)..(552): n is a, c, g, or t
  misc_feature (554)..(554): n is a, c, g, or t
  misc_feature (557)..(557): n is a, c, g, or t
  misc_feature (562)..(562): n is a, c, g, or t
  misc_feature (577)..(577): n is a, c, g, or t
  misc_feature (583)..(583): n is a, c, g, or t
  misc_feature (587)..(587): n is a, c, g, or t
  misc_feature (591)..(591): n is a, c, g, or t
  misc_feature (598)..(598): n is a, c, g, or t
  misc_feature (603)..(603): n is a, c, g, or t
  misc_feature (608)..(609): n is a, c, g, or t
  misc_feature (627)..(627): n is a, c, g, or t
  misc_feature (629)..(629): n is a, c, g, or t
  misc_feature (631)..(631): n is a, c, g, or t
  misc_feature (635)..(635): n is a, c, g, or t
  misc_feature (639)..(639): n is a, c, g, or t
  misc_feature (643)..(643): n is a, c, g, or t
  misc_feature (665)..(665): n is a, c, g, or t
cccaaaagctgtcctcaaaagcaaggaaaatatatactgacttcatagaaaaggaagctccaaaagagataaacatagattttnaancnnanactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccananagacngaccnngaanncagccngggngnncaggaaacancacncagnactannganncaaagnngggnagtgaancaggaagccagnnacngacnaggagaagctggnancagnacagcncccncactgngnacagaacgcaagaagggaataggnggncngaacgnggcgtcccaccctgaaaagcaggaacgcaagatgatgaaagagacaangnaanactgntggtccaaaagcatntaaaancaanaganctgggantatgnggccnnaggtagctggttgtacancntncccnaaancganccatgttaccacatagtagttntagtttaggattcagtaacagtgaagtgtttactatgtgcaacggtatcgaagttcttatg

SEQ ID NO: 556754 - DNA, 788 bp, Homo sapiens
  misc_feature (84)..(84): n is a, c, g, or t
  misc_feature (87)..(87): n is a, c, g, or t
  misc_feature (89)..(90): n is a, c, g, or t
  misc_feature (92)..(92): n is a, c, g, or t
  misc_feature (349)..(349): n is a, c, g, or t
  misc_feature (395)..(395): n is a, c, g, or t
  misc_feature (582)..(582): n is a, c, g, or t
  misc_feature (614)..(614): n is a, c, g, or t
  misc_feature (616)..(616): n is a, c, g, or t
  misc_feature (619)..(619): n is a, c, g, or t
  misc_feature (624)..(624): n is a, c, g, or t
  misc_feature (639)..(639): n is a, c, g, or t
  misc_feature (645)..(645): n is a, c, g, or t
  misc_feature (649)..(649): n is a, c, g, or t
  misc_feature (653)..(653): n is a, c, g, or t
  misc_feature (660)..(660): n is a, c, g, or t
  misc_feature (665)..(665): n is a, c, g, or t
  misc_feature (670)..(671): n is a, c, g, or t
  misc_feature (689)..(689): n is a, c, g, or t
  misc_feature (691)..(691): n is a, c, g, or t
  misc_feature (693)..(693): n is a, c, g, or t
  misc_feature (697)..(697): n is a, c, g, or t
  misc_feature (701)..(701): n is a, c, g, or t
  misc_feature (705)..(705): n is a, c, g, or t
  misc_feature (727)..(727): n is a, c, g, or t
cccaaaagctgtcctcaaaagcaaggaaaatatatactgacttcatagaaaaggaagctccaaaagagataaacatagattttnaancnnanactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactggacctntggaattcagcctgggctgtttcaggggaaaccagttcactcaggnaactaatttggatttcaaaaggttgtggggtagtgggaaatcagggcaaggcccagtaaacctgggacctaaggggaggaaaagctggtaatcaaggaaaccaggcttccccttcaactggttgtacaagaaaccgccaagaacgggacattacggtggtcttagaacgtggtggtctcactctganaaagcaaatgtaacgatgatgaaagagacaangnaanactgntggtccaaaagcatntaaaancaanaganctgggantatgnggccnnaggtagctggttgtacancntncccnaaancganccatgttaccacatagtagttntagtttaggattcagtaacagtgaagtgtttactatgtgcaacggtatcgaagttcttatg

SEQ ID NO: 556755 - DNA, 729 bp, Homo sapiens
  misc_feature (84)..(84): n is a, c, g, or t
  misc_feature (87)..(87): n is a, c, g, or t
  misc_feature (89)..(90): n is a, c, g, or t
  misc_feature (92)..(92): n is a, c, g, or t
  misc_feature (177)..(177): n is a, c, g, or t
  misc_feature (338)..(338): n is a, c, g, or t
  misc_feature (340)..(340): n is a, c, g, or t
  misc_feature (345)..(345): n is a, c, g, or t
  misc_feature (350)..(351): n is a, c, g, or t
  misc_feature (355)..(356): n is a, c, g, or t
  misc_feature (362)..(362): n is a, c, g, or t
  misc_feature (366)..(366): n is a, c, g, or t
  misc_feature (368)..(369): n is a, c, g, or t
  misc_feature (379)..(379): n is a, c, g, or t
  misc_feature (383)..(383): n is a, c, g, or t
  misc_feature (387)..(387): n is a, c, g, or t
  misc_feature (392)..(393): n is a, c, g, or t
  misc_feature (396)..(397): n is a, c, g, or t
  misc_feature (403)..(404): n is a, c, g, or t
  misc_feature (408)..(408): n is a, c, g, or t
  misc_feature (415)..(415): n is a, c, g, or t
  misc_feature (427)..(428): n is a, c, g, or t
  misc_feature (431)..(431): n is a, c, g, or t
  misc_feature (435)..(435): n is a, c, g, or t
  misc_feature (448)..(448): n is a, c, g, or t
  misc_feature (450)..(450): n is a, c, g, or t
  misc_feature (454)..(454): n is a, c, g, or t
  misc_feature (460)..(460): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (496)..(496): n is a, c, g, or t
  misc_feature (499)..(499): n is a, c, g, or t
  misc_feature (501)..(501): n is a, c, g, or t
  misc_feature (507)..(507): n is a, c, g, or t
  misc_feature (555)..(555): n is a, c, g, or t
  misc_feature (557)..(557): n is a, c, g, or t
  misc_feature (560)..(560): n is a, c, g, or t
  misc_feature (565)..(565): n is a, c, g, or t
  misc_feature (580)..(580): n is a, c, g, or t
  misc_feature (586)..(586): n is a, c, g, or t
  misc_feature (590)..(590): n is a, c, g, or t
  misc_feature (594)..(594): n is a, c, g, or t
  misc_feature (601)..(601): n is a, c, g, or t
  misc_feature (606)..(606): n is a, c, g, or t
  misc_feature (611)..(612): n is a, c, g, or t
  misc_feature (630)..(630): n is a, c, g, or t
  misc_feature (632)..(632): n is a, c, g, or t
  misc_feature (634)..(634): n is a, c, g, or t
  misc_feature (638)..(638): n is a, c, g, or t
  misc_feature (642)..(642): n is a, c, g, or t
  misc_feature (646)..(646): n is a, c, g, or t
  misc_feature (668)..(668): n is a, c, g, or t
cccaaaagctgtcctcaaaagcaaggaaaatatatactgacttcatagaaaaggaagctccaaaagagataaacatagattttnaancnnanactctgattgcccagaatatacaagaagctacaagtggctgctttacaactgcccagaaaagggtatacagcttgatggaggggngggggggggggggggggtgggaaaagagggggggggtgtagggtggtgtgggtgggggtgaggggggggtggggggggaggagggtgatggtgcggcgggggggggggggaaggaggagaaatgaagctttttcctgaggggaaggactgtgacctgccananagacngaccnngaanncagccngggngnncaggaaacancacncagnactannganncaaagnngggnagtgaancaggaagccagnnacngacnaggagaagctggnancagnacagcncccncactgngnacagaacgcaagaagggaataggnggncngaacgnggcgtcccaccctgaaaagcaggaacgcaagatgatgaaagagacaangnaanactgntggtccaaaagcatntaaaancaanaganctgggantatgnggccnnaggtagctggttgtacancntncccnaaancganccatgttaccacatagtagttntagtttaggattcagtaacagtgaagtgtttactatgtgcaacggtatcgaagttcttatg

SEQ ID NO: 556756 - DNA, 503 bp, Homo sapiens
  misc_feature (42)..(42): n is a, c, g, or t
  misc_feature (52)..(52): n is a, c, g, or t
  misc_feature (61)..(61): n is a, c, g, or t
  misc_feature (77)..(77): n is a, c, g, or t
  misc_feature (177)..(177): n is a, c, g, or t
  misc_feature (197)..(197): n is a, c, g, or t
  misc_feature (311)..(311): n is a, c, g, or t
  misc_feature (376)..(376): n is a, c, g, or t
  misc_feature (473)..(473): n is a, c, g, or t
cacgctgttgaacatgtcactctccccccttctcctttgggntggtcaccancaggtgttngccaatgcagcatccncaaccctgaagtgcttgatatcacagaggaaactctgcattctcgcttcctggagggtgtccccaatgttgccagtgtctgtctgcagattggctacccnactgttgcatcagtaccccnttctatcatcaacggggacaaacgagtcctggccttgtctgtggagacggattaccccttcccccttgctgaaaaggtcaaggcctttttgggtgatccatctgcctttgtggntgctgcccctgtgggtgctgcccccccagctgctcctgctgttgttgcagccccagctaaggttnaagccaaggaaaagtcggaggagtcggccgaggatatgggatttggtctctttgactaatcccccaaaagccccccccttagcccgttttttttgcnaaacaaggaaataaaggcttacttctttta

SEQ ID NO: 556757 - DNA, 755 bp, Homo sapiens
  misc_feature (2)..(2): n is a, c, g, or t
  misc_feature (713)..(713): n is a, c, g, or t
  misc_feature (738)..(738): n is a, c, g, or t
gngcatgaggctgttttttacattttacagttacagtttcagagaaagtttgatatttatctaaaatttttcaatgtatgaactttttcatttgacaaaccataattgtacatattcttgggatacagagtgatattttctttacatgtatagaatgtgtagtgatcaaatcagggtaatttccactaatttaaaatgccacctttatgttattgtaatttatatatatactatatatatacacacacacacatatatatatacatgtccacatacagtgtgtgtgtgcacatgtacacacatgcatatgtgtatataatgcccagtataagcaatgtgcacaaataaaattagctaacagagatagtatagagtgagaggagaggcagattaatctttgaggaaaagcacaattttatagctgaatggagaaagctgaggtggtttctaagatggagaataagacaaaaaatgtaagtacgttgtttgactgaattcaagaaagaagggtaaaagagaagaaagtagtggtcttatcattaaatgccacagagaggtaaagataaaaacaacatattgttttgggtttagtaatttaagggttaccaaattccgttttggaggaggaacagattccatgtccactagaatggaatgaacgagaaatggaggaggaaaataggtagtttttcaaaagttttcaaaaatatganaagaagaaatgaagtggtacttggnagagattgttgaaatgg

SEQ ID NO: 556758 - DNA, 376 bp, Homo sapiens
ccacagccatttctcaagctctccagtgttgtggtctgacaagtcagagaccacatctcttaacagcattcacaaccagagaggaggtgatatatagtgggaccaagcagagtgtcaaaccgcaggtctcccttcacacggtctagacataatatcttgaaaagatttttcacaaggtgcttaagaatgtgcctttgcacagcctgcatagaaccaaccttgtaatatattcataggtaaccccaagggttaaaatggcctagaagagtgcctatggaggtacagccttaaaccattatctctcacttctgcaccactggagcggtacccgctttctctttcctccaaaagacagagagtgaccccccaaaaggtg

SEQ ID NO: 556759 - DNA, 1516 bp, Homo sapiens
tggcaacatacgttttttattactccaaggacaccctggactgtcaccaatgcccagtcttcacgggggctatgttagtgggtgacctcacgggctgtgaaccacaaaactccctgtgtgtgaacgccgtgtgtgcatacagccctgtgggcatacttttgggcacaccgcaagaggacacctgcggttaccttgaacaccgtgacttgtgctctctagaagacatgtgtgtgattccctgtgtgtcttttctcccgtgaaaatggtgtttccccttctcccgtgtgtctgtgccacgtgtctccccccaaaatttttcttgtgcgcttctccaggggggcctctcctcacccgtgtgtcgtgggttaaccttagggctctctgtgggcccttagacttagacatcttttggggtaaggtggcccctctctgtgccccaaaactcagaggtcgccgtgggcccctgagagcgctgtgaacgcttgtgtgtgggcgcctcccgagagacccctgtgaaccctgtgggctcttcggaggccctcagtctcttgtgttggcgcgcccccacgcgggatgttgtgccctgtgtgctttgtgacagggggcccaccccacacatattgagggcccaagctctctcggcaggtgtttcccccacacggttttaaaagggcgctgtgataaagaacccctttgtgtgccccccaagaaagagctatacgagacgggatggcagagagatcgcataggtcctccagcagcattatctccatgggagagaggagactctctcaagaagaaattctctcctccccgccgtcctctctttcgggcattaaaggagacctttagaaaccccccctttagtagaacactttttttaaccacggccgccgatgatatctcttctcccgccgcttttttttcccccccccgggggggtgctcttctcccccctatttttttgggcgagacaccccgaggggggagctccctgtggcccttccgttggttttcacaccccccccagagcggtcgcgttggtggcgtagcgttgtacgagcgcgccctccatttaaccacattctccatgtggatacttgctcccaccgttggatcgcgagcccccttcgactagacgccgctcctcccacaggggcgcgtattcaagattgtgggacgatccgctccccccttactcttttatggaggcgcgcatcccccccccagagaagtcgctcgtagggggacccccaaccggaggcgcaggttacgctgaccgtcgctactaccctcatagccccgacgagcgcgctacatctcataccaacgtattattagaaacaacccaaagcttctctcgtgcgcggcgcgcgcacgaccacccacgaggcggggcgctccatcactcctcattgagattgtgacgccccccgtgggcacggatggtgccgtctatgcagacacctcatatgggtgggcgctcctccccggagagattcctccctccttgaag

SEQ ID NO: 556760 - DNA, 1630 bp, Homo sapiens
  misc_feature (1328)..(1328): n is a, c, g, or t
tactggcaaacaaaatccatttaggggggaaaaggggactatatttaaaagcgtgctagaaaaacgtgaatataaagcaaatctcaagaacgtgaaaacgagttctccaacctcccattcaattcctccaaacgcggtgaccgggtctcggccagcaactctcctttctccttattttttcttctcccctgtgtgtgatagagggagaaaattctcaaggttctcacgacaggacattctccttctctcctgtgcgccacaaagagtgtcctctcaaccacagagatacaagagagggctgtgcagggacacacaaaacttctgtgtggcgcggtgagatatcagagtgcgcacaagaggcgcgctctcagagaaagagctctcatacctctccagagctctctgtgagagactgttcacaaacagagctgtggtgtggcgtcacccagagtgtgagagtgtcagaggcactatcataacactccccacacagagacacaagagacacacgcaggcaagccacaccccctaaagagacgtcgtcgggggggcaacacgccgctgtgtgggcacccgtgaagagcgccgtgtcatgagggggtctatacaaatttccagagagcggccccagcggcgtctcatgcgtgagaagcgtgccagctggcacgagagtttacgcgtggaggagaacaccacaaatagggcgccgcccaaaattatacaaccatctgttgtgcgcccaggcgcgcactgtggagaccaccctctcaaaacaaaccaatagacgggggggcgggtcctcacccctcttctcgtagtggtcgccgccgggcgtgtacaaagcggggggaggaagaatgtcgcccctacaaggggggaatattaaaggggcgcgaccagccgctcctcacaacgagttcatcaccttcctgttggcaaccaccgagcacggcaacaacggcggctaaggagctaacatacaacactacactaaacatgggggccgccggcccccccctattttgttgatagagatagatatggtcaagtaatactagtaagtaaccaatataatacttgccgcggcagctgcttatcatctacgaaacatgttcgctagaagagacaacacgccacgccagccgttggtggtgttggatccaaacaaagcgtgtgacgcacgacgacgagcatatatttcatacacacaaaacgaacacgcctcgctggttgttggcccccaaacaaatagggtgggcgtggtggacgaacaaccacgcgaagcgataaaaattacagccggccagtaatcgacagaaacaaacagncagcacaacgttcctgcgtgggcccgccacagagagcgactacgcgagggtgactacagaagaaacaggcaggcgaacgaacagaccacaccaacaaagctgacgtggaggatggaaacgattgttagccacgacccaaacagaagtaccaaccgccctccgcgcgcgcggcccgccccgctgttgatggctatcgctctctagatagcagaataacaataatggacggggcacacaaacacacacatgatttggtaagcggacgcacgctgaaaacaaaagccccccttcttagtcggcaa

SEQ ID NO: 556761 - DNA, 568 bp, Homo sapiens
tggggaaaaaagcaaaaatatgacttaaatttaacttcaacaaggacccggtgtaccagcccagggaaaaggtattgggagggaaatggtcaggtcttccggttccttaaccagcagagccccagcaacctagaaagcgcctcacctagcctcttaagggatgtggggaaggagcagggatatgggaaatcagaggctcaaaaatgtaaagaaggctgatggcaagccgggggagaaggccgggacaaccgagggaagggctgagggctattgaggagtcccctagcgcaggtcttcggcaggtgaccttgccctgtggcccgtgggcaggatggagtcctggggggggtcactatgggggcccctggggggggactcctccaggaacaggcggggattggccgtgcgtgggtgggcgttccagggcatgtgccgcaccatttccggggatgtcctgggttggatgaggtttgatgccaatggtctccccggttaagaattggccggaaatgtggtcttcgatctcctggaggggggtatcctttctccaccaccaggcactggggcg

SEQ ID NO: 556762 - DNA, 182 bp, Homo sapiens
ggcagcactgccgactttaaatggccgcccatgagcagataacaggcctgttattttcaaacgcccgttagtgcaagtgaagaaatttttatatcggtatgttcagcaaaaagacatcgcccctgtgacacgctttggcacattcctgcatcagcgctgctattgaaacttctaaaactagg

SEQ ID NO: 556763 - DNA, 165 bp, Homo sapiens
ggtttgagatatcgacataggctaacatacgaatacagtctctaacaagatagctaggactgtcccgagaccgctgtgtacaatagaacttgtatatacctctctatacgcgaacgaagggttgtggataaaggcgagcaagaattctgcatgtggggttgtgtg

SEQ ID NO: 556764 - DNA, 106 bp, Homo sapiens
cgttttttcggaacccattgattttctgttgactttcgtcgagtatcagaagtaattggagcaaatggcaattgcccggtaatgtcagatgaagcggcatcgaatt

SEQ ID NO: 556765 - DNA, 232 bp, Homo sapiens
tagaggatcccgtattacagaggctcacttctgtcattcaggtcatctggtagtctccggagaagatgctcgttatttccttaccagccgctgagtgcacacttgttcttctcaaaagcatcattgtttacttaaatattttcatattctttggcatcaggaatcacttagatgagatagctccattgtggcgagagcgtgacctttccaaaggtactcgtctgttatctgg

SEQ ID NO: 556766 - DNA, 303 bp, Homo sapiens
  misc_feature (126)..(126): n is a, c, g, or t
ggttttgtcagtcaaacgttaaaaactttaacattttcaaagggcccagactgtggacaaaaacacatgtaatggagattggacaggttggttttttgtttggacccttggaagaggttaattccnaacggtttccaattttaaaattttaaaatcttgtttaacaaaagcttggattaaaaaactgttttcatttcattacagaattgtttaaaaaagttcatttgttgaaaaaaaaggatcctttttaaaaccccagcatttggactgttcctttttaaaaaactgaaaatataaaaggga

SEQ ID NO: 556767 - DNA, 753 bp, Homo sapiens
attccaatttgggggtgggaggtggaaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttcttttaatcaacaatttgccggccccccccttttgggacccttttaaccgaggggccaaaccacagctgcacttattactcgacagaaacacagtctaacgtgtaagtgcaaacttggacattagcaggcacattactaacttcagaagttccatgactgtacgatgtctgcgtttctagcttacgtcttttaaactttctaattcaattctattttcga

SEQ ID NO: 556768 - DNA, 696 bp, Homo sapiens
  misc_feature (256)..(256): n is a, c, g, or t
  misc_feature (547)..(547): n is a, c, g, or t
  misc_feature (644)..(644): n is a, c, g, or t
gtcacgctgctgtccctttctttttttcaggcggcgggaagatggcggacatttcagatctgaggcgtgcctaccaaaagcacgtcgaccatctttcaataacaagaagagggtcctgctgggagaaactggcacatggaggcaagctcccgacggtactactagaccatcgttctgggcttcaatgacacccaatggaggcttattagatgcggcagcccttatcattcgtaccacatgcaataactgtccttcntttccaactagggtaaatagtggtccatcttcgacgaggccgagactaccattctcatgagacgattgagatgaccaacgattgcaacgatgggccaagaagagaccactttcggttgattccagtcacgagcatatatctcgccatctcacactccgtaatacggtatcaaaccgccttcgaaatgcaatgcgccgagcgaaatgaacatgtctgtacacctgtccccctgcttcagggacgtccagatcggtgacatcgtcacagtgggcgagtgccggcctctgagcnagacagtgcgcttcaacgtgctcaaggtcaccaaggctgccggcaccaagaagcagttccagaagttctgaggctggacatcggcccgctccccacnatgaaataaagttattttcctcaattcaaaaagaaaaaataactaaaaaaag

SEQ ID NO: 556769 - DNA, 162 bp, Homo sapiens
actacggtcatcttctaactatatgtgtgtggttctgtgtatttatgggtaaggtacaaactgtaaataaggtatgggaatcaaccgaaatcctaatggtaatcctctttaccaaaaaagaaggtctatagggggaacccgggcccccctggggcggcaggt

SEQ ID NO: 556770 - DNA, 148 bp, Homo sapiens
ggcacccaaaactagaccctgcatctgtgatcatcccacagaatgagacaacatgggagcaagaaagtgttgccttgaacccaataaatgtgactcacgtgtgggccctgctccctggtggtgccagacagccctgccctgtctccac

SEQ ID NO: 556771 - DNA, 399 bp, Homo sapiens
cgacctgacatggggtgctggggactgaactctggtcctctgtaagactggcaagtgctattaaccactgagtcatgtcttcagcctctatgtttaatttaaaaaaaaaaagatttatttttattgtgtctgtgtggtggtggtgatgtgctgtctgtgctgtgctgtgcgttcagtgctgtctgtgctgtgctgtcggtgctgtgctgtggtttgctctgctgtctgtgctgtgctgtgctgtctgtgctgtgctgtctgtgctgtctgtgctgtctgtgctgtgctgtgctgtctgtgctgtgctgtgctgtactgtgctgtctgtactgttctgtgctgtcctgtgctgtgatgtgctatctgtgtttttcgtaagacgcgcccgcgaatttagta

SEQ ID NO: 556772 - DNA, 227 bp, Homo sapiens
tggaggagaagaaacactacctcatgtggggtctctcctccgatttctggggagagaagccccaccctcagctacatcatcgggaaggaccacctgggttgaacacttgccttaagaagaccgattcccaggccgaggggacccggaaacattgccaggacctgggcgccttcaccaagagcatggttgtctttgggtgccccaactgaccacacccccattccccc

SEQ ID NO: 556773 - DNA, 84 bp, Homo sapiens
taattcctcaggctgtcctattccaaggagagaaatggcaagtccatagacgaccaaaacatagttaatcatggccaggttcaa

SEQ ID NO: 556774 - DNA, 356 bp, Homo sapiens
gaggaaggtagaaccgccgatgcaggcacgtcttacatggccagagcaggagcaagagagagaggtgggaggtaccacacacttttaaacaatgagatctcatgataactcactcactataccataacaaaggggatggctctaaatcattaatgagaactccacctccatgatccaatcacctcccaccagaccctacctccgaaactgggaattacaatgagacttgagatttggacagggtcatatccagaccatataattctacccctgccccctcccaaattttatgtccttctcaaatttcaaaatacaatcatgccttcccaacagtcccctaaagtcttaacttattc

SEQ ID NO: 556775 - DNA, 378 bp, Homo sapiens
cttaccgagcagtggtgggggtctgtgcattgctgcatgtgatgagcctgggcaggctctgtaaaaggagagccctgaatgcctaaaccctgaatgcttgcttggttgtcactcctaagcgccacccctcagcatggctgcaggacctctgtgctcaggggaagcctgtgaccctgcctctcttagggacaggaacggcctggcatagtcactggtcctgagttgaagttgatgctgggcggccagagatcttggtttcacatacggcactctcatgccaggcagggagacgttctgtttctccacactcttcccaagacctggcaaccaagcaggcctgggaagggctggggcgagaaactcactcatccctcgttg

SEQ ID NO: 556776 - DNA, 446 bp, Homo sapiens
tttatcgatgccacctttgatccatcagggctggccatcgctcagctgggaagaggtgaagtgcgggtgatttctgcgtgtggttgtacaggccatcgcagcggatgaagaaacccctgtattatggctctggaattcgacagtcaggaacagctaaaatatcttttgataattgaatactttaatcagagtgacttttcgtctgttgcaatgactcgttctggtctgtccttggaggagttgaggattatggaaggacagcggtcatatttctgaggtcatcactcctccagacatcaaatcagtcgaatttaatgacttggatttgcatgtccgtgcactttgctggatggtaagatggtaatggaagggttttctgaagagattggcaaccacctgataaaaggccaggggacttcctctgccattgtttttgaggggctccg

SEQ ID NO: 556777 - DNA, 106 bp, Homo sapiens
tcggtacctatggtctggtccgtcccctgcgcactcagggtagggctcacatgggggttgtttctagtcagtagtctcccaagcttcctgatgctgatgagcccct

SEQ ID NO: 556778 - DNA, 350 bp, Homo sapiens
cccagccgctacatggtgtctactactccgtggatccagcgaagggatgagtaacaaatgcagaggcagggtggtctcccagacaacaaggatgtccagagttctcctgaccctgtctgaaccacacttcacatgcaaggcagcggcatcacagttatatccatcccaggccacccattcactcattccaagatgtcaggcctctttaactctgcatccctatgggtaagacgcaagcgaggtgagaaaagtcatccctggcaatgagagcctgtcccacacatgccactcggcatgagatggatggaggaagaagccaaagagcagggatgccttcctgtccccgtgga

SEQ ID NO: 556779 - DNA, 211 bp, Homo sapiens
ctgtcagcactcacagctccatttcctcaactagaaatcaaggagggtggggtacccttcaactctcctatttctctgcctgtttctctctacacatggtatctacctctgttcgggctgccatatcaaaatatcataaaccaggcagcttacaaacaatggaaattcatttcccacagttgtggaggctgggaaagtccaagactgaggg

SEQ ID NO: 556780 - DNA, 295 bp, Homo sapiens
ccccaatgggggggggggggggggggggggggggttttttttccccccccttttttttttcccccccctttccccgggggcccccccccccctttttttttcccctttttggaccccggggggcctccccccccccggtttttttttggggcgggggggggggtcccttttttcccccgggccccttttttccctttgggctttttttggggccccttttaccccgttttttttcaaaaaccgggggggggggggggggggtttttcggggtttttttccccccccgggcccgca

SEQ ID NO: 556781 - DNA, 1394 bp, Homo sapiens
gcctgctcagacccagaggccttcctctgattcagggctgttcacatgacagtgtactgtcaggacagcagaagctttgatttgctccatcccacaaaccatatgcatccatggtgacctcatcccatctgccacagttgcagctgtagagatgacgagtgtcacgtaaagcaacagcatatgattccttctccaacttgctacaccagccctctttcaacgctcacaccacacaccctccatgtgcgggctccttcctactcactcctcatgcaaactacactgcttgctcgctcacaactggcacccaactctgctccttccttacattcaactgcctgcacctcctagctcacagcacactcttgccacttcaccctctcctgcctttccacgccaggcactgccaccccctcgtcttcctcggctcctaccccgcaacctccttgcgccctgctcccacccacctctcctccatcacactaccccactctctcactctctttcacacactctcaagccgcctccacaccacgggaccactcatctttacgccccactaccacccctcacttctgcctgtcactaccccttgcccctcactcctgcaaactcaactgcgcgcatattcactctgctctcaacccactatccagcgcaccaaacacgcactccttctcctctcctcttccctcacaagcctcggcccctcgcacccccacgcatccaacccccgcgctccaccccacctctccgatctccaagcctccaccaaccccctaccttcacacctacttgcgctcccctttcacccactttccagcggcctcctgccctaccacaccagccctttccccccaacgcaccgaccttcctccattccccctctggcccctacgcttctcaaccccgcctcccccctgccgtcctcactcaattcctccccttccaccatctcaccctcctactagtctcctttccccacacctcctccctacaccatctcacccaccccttggcccttcaatccacccccctcctccacagctccaccacgcacctcgcctcccctggcccccagcccacttccctctccctcgtcccccccccacgcgcgccccgccccgcccctccctcccccctctcctccctcaccctcctcccccctctccctcccacccaacccccaccctcccacccctaccctcccctcacccccccgcccttcaccccttacctccccacccccacccccctacatcctcacaccccatctactacccccccctccccacactcctcccctccacccccccctctccctcccaccccccccacccaaccatccccccacaccgcacacctcaccccccctcgccacacacaccccccca

SEQ ID NO: 556782 - DNA, 433 bp, Homo sapiens
tcagcctcctgagtagctaggattacaggcacatgcgaccacacccagctaatttttctatttttagtagagacagggtttcactatgttggccaggttggtctccaactcctgacctcaagtgatctgcctctctcagcttcccaaagtgctgggattacaggtgtgagccgccccacccagccccatttgatgctcagctgaatgtgtcaatacctgtgtgcaatgtggaataaaaatgtctcttctgcaataagatgtctcttatgcaatgaaaatgtctcagtgtcttatagataatgaactgttggttcctcctgtagcttccttccgagcctcacaccaggcggcccctgttccttcagatcgtgtttcaggtcagtttctcccagttcctcccagcagaagagacagccttttcactgcttctgcc

SEQ ID NO: 556783 - DNA, 427 bp, Homo sapiens
tcgtctctacaggtatcccccccgttgtggccagcgaacaggagtggggtgttctatgggttggtggtatctggtggacgcttgtatatcgtgaaatcacattgactggtccattatgacatcataccaactttaggtcactgtacagcatgaatacgcccgtggggcaggggccgatccctggataccctcccagtctgccctagaaagggaaggtcatcaagatctgtgctgaccatggtcccggtgcagcatggtgtgtgctgcatgccacttgagggatcatggagtcttatcaggtgcttctggggttgccgctgaatccaacaggctaaggtggctttggaagcattcagcaagaccacgcccaggccgccaagcgtcggtttcactgcgtgtgtatattaacatattgtgcctctatatc

SEQ ID NO: 556784 - DNA, 862 bp, Homo sapiens
ctatgcgaatgaccctgaccaccgcacatttggcttttcacaagttctccaggtcattcttgggcacgatcaaatttgagaatcacaggtctaggatacgacggggaaaacagaaatgtggggtggtcagggacattcggataattcgggctatttgtattcaggtgtgagctggcaaatccgagacctgttttgcgtagctaattaccagcaatgacaaactcccaggctctgaggcccaagcctcctgggctgcaactggtctttatttttggaggcaatgaatggagcacctcggcctgggaccctcagtgtagggttttctgactcttaggcaacttcctagggtgctgtacttcctttttaaagttggggagcggcagggggagggggaagtgccacgcccttgtagtttcatgatgtcatgttgcatgtgctcttgagctgtaaataaagagacgatggttaaaaagcccacctggtgtctctctttgttcctccaggagacggtctgtctgtgctggtagtgagctctacaggggcatttggaggggatccttagcctggtattccacctatgacttctcaacacactggactgagcatttgccctgagctaagcagcaaacaaggcagacaggacccctgccctcgcctggtcctcatcataatccctcagccagacctcttgactgcgagtctcagatttttttgttgtttttttttttttagacagagtcttgctctgtcacccatgctggagtaaagtggcacggtctcggctcactgcaacttctgccccccaggttcaagcaattctcctgcctcagcctcccgagtagctgggattacaaacgtgtgc

SEQ ID NO: 556785 - DNA, 614 bp, Homo sapiens
gagttcggggaggggggaaactgggctggtacgccccagcaccacatcccggggcaccccccgtcgttttaccttctgcttggggaggagagggattagattgattcaccccgcacccctcccctgccgtggtctcgtggtgtgatgtgagatatactgttgtctttggatttgttcgagtcagcgtcgtcaattttttgtttttttggttgagaaggatgctagtatggcgtgactctgtctgttgtgtgcggttgagattgatgtttctggccccccactatgtgattttttgtggtgggggggggggggttggttgttctatgttggtggttgtgcgttctctgtctcgttggttttgtgttgttctcctctctcgtgtctgtgtgttttgatcatttagcttcgactctctgccccctctctctgtgtgtgggttgccgtctcccttctcctgagccgtgcggtgggattaattatcactcatgttttgaagaagtttttgtctgttggtggtatgatcagacgtccgtctctcctcgctcccccgaaaactagtgttgtggttgggggggcgtttctaaatatgtttgtcttttctgaaatcaacatta

SEQ ID NO: 556786 - DNA, 728 bp, Homo sapiens
  misc_feature (20)..(20): n is a, c, g, or t
  misc_feature (63)..(63): n is a, c, g, or t
  misc_feature (110)..(110): n is a, c, g, or t
  misc_feature (202)..(202): n is a, c, g, or t
  misc_feature (210)..(210): n is a, c, g, or t
  misc_feature (222)..(222): n is a, c, g, or t
  misc_feature (244)..(244): n is a, c, g, or t
  misc_feature (343)..(343): n is a, c, g, or t
  misc_feature (430)..(430): n is a, c, g, or t
  misc_feature (444)..(444): n is a, c, g, or t
  misc_feature (452)..(452): n is a, c, g, or t
  misc_feature (456)..(457): n is a, c, g, or t
  misc_feature (491)..(491): n is a, c, g, or t
  misc_feature (494)..(494): n is a, c, g, or t
  misc_feature (501)..(501): n is a, c, g, or t
  misc_feature (506)..(506): n is a, c, g, or t
  misc_feature (513)..(513): n is a, c, g, or t
  misc_feature (554)..(554): n is a, c, g, or t
  misc_feature (595)..(596): n is a, c, g, or t
  misc_feature (651)..(651): n is a, c, g, or t
  misc_feature (653)..(653): n is a, c, g, or t
  misc_feature (686)..(686): n is a, c, g, or t
atcatttataatcccaccancgagaggatgtactttactattcaatccttcacaagtgatgtncatatatgttatattatcaaatgtactttttacctttcaaaaatatnaaattcacatattacttagccttatttccatattatatatcttaccaagaacctcttttttacaaatgtgtaaagttcttttattaaaaganagaaactngtagattggttnaaaatacaataaacaatgagangcagataacaagagaaacatctaaaaccattaatagcaacaggttataagtggaaatatggacaaaggaatatcagggaatgctaataaaaagcaagcnatatggtattgttaatatcagataaaaatcaaggtaaactacattaaataggggtaaggatggtttcgattaaccttccaacgcatnaatataagtttgtntctgactntacnnatctcaactatttcatccacttctctaaacatanatncattgcntaaangcctgtngtgtatatattctttaaactcctggagagattaaataagcntttctctaaaagttccttttgctttggcctcctcctctagnntctcctcctcttctggcttttcctcaggctttggctcttcctcatgctttggttnantctcattttctggttttccttccattttttganaggatttcatcttgtatctgtatacctctcttccttccttct

SEQ ID NO: 556787 - DNA, 155 bp, Homo sapiens
gcggccgcctactactactactgctcgaattcaagcttctaacgatgtacggggacatggaggtccctggatcatcgaaaggacctctcccactcctcctaccaccgaagtggttaggactctatataaataaaaacaaggctgttagaaaaaaa

SEQ ID NO: 556788 - DNA, 1080 bp, Homo sapiens
gaccagggtctggatgagcttgaatttgaactgaacttgacgtttgtatttctagaaccctgggtctcttacatgtctggtctttctttggttctcggctttgctcacccttcgactaaacggaagctatattcactccacaacaaaacaaacaacacaaacaaacacacacaaaaaaaaaacaacaacacaaacaaccaacaaacaaacaaaaacaaacaccatacaaaaactacacacaacaccaaaaacaatacaaaacacatacaaaatcacaacacacctcttctcgcccagcccctcctccccacccgacacaccacctctttcaccacccaatcttcccctcacccacagacggacgatcactacaaaatcaaacaccacatatacaaatcacagtctacaataaaagcaaacaccaaccaacaaacaaaatatatccctcgcctcatcaaactcacatcctccccggcaaaaaaaaaaacacaatcccttctatccactcacccctgcataataacaaacaaaacgctcccctataccccccatactattcaaaataaattatataaagaaataacaacaatcaatccgctaacaacatacctcacagacaaaacacttttcttttcaataattgcacttcacatcacacccacaagcacccacccccccctactccaaaccatcactctccgcgcactctcactcatgaaaaccccctacctcttcactaccacacccccaccaactctaaaagtctccatccaccaccacccccctccccccctgacacgttaccacaaacatccaacaacccacaaaaatcacatcagaactaatccacgctacacccaaaaacccacactccgctcacccctaaccaaactcgatcaacaaatcacctaaccacaatgtaactacaatcacaattgacaccagctctcacctctacacagtcccatacaccataacaagaataaaacatacaagatttactaatcctcgaaaacagctacctcaacagctcctatcacatctactcacaccaatcccctacaacacacacgcacaact

SEQ ID NO: 556789 - DNA, 1125 bp, Homo sapiens
  misc_feature (304)..(304): n is a, c, g, or t
  misc_feature (538)..(538): n is a, c, g, or t
cagtgggatggaaagtgtcctgtccttggtggatgacttcattcttcattcatcccggcgcctggctcccaagcccttgtggaccgagagtttctcccgaggtccctcatctaccctgcggtaggtcaaacgaaactccagcacccaccttctcgtctctaaagtttcggaaataattgttttcacgtcgatgattatgagtaatgctactataaacattcttgcatatgatttttgactgaacacgttttctttttttatatctgaagagatttattcacgtgaccaatggcctatgacacangcccaggaggtcctgagaacatgtgcacaaggtggttgggctacagctggttttctacgatctagggagaccattaagacgtccaggtgaatccatgtgagaatgtagactgccttgggtttgaaacacagtggtattcccatccctcttgggggtggtattagcttggcgaggttgggacatttggcttggggtcacacgggggtccactactggtggccttaaaccttttanccgaaggaagcccccaagaacttggtgttaccacaggtggcggagaggggacccaactcattatcctgtttttcccaaggcaagcggcacgcagaggaaaaaagtctccaagtgttacgtttcctctcagggtccctatcaggcttgagggcacccttacggctgggcgaattcccagggcagtagcgtgagatccctgtggaccacacccccgtgtgcccaggggcgagtactgcgcaggccgtgggccaacccggccacataaacgggggaccgcggacgaccaggcgaaagtagcccccaaagtgtgaccacgagtgggaaccagcgagaaacgcgatataaccgagagagcaaaccgccctcgcaggcgggcacccacaatactcggaggataacaaggccgtggcgggcccaacacgacatttgccgccacagatatccgacagctcgaccgcctcgtgcgcgccaaccagtgagtcgaccaacatgcgcgggtcacaccacgtagtgccccccgagagccggtactgcccagccacgggcgcagcaggctatcacggactaccgtcacgcctgacacgccc

SEQ ID NO: 556790 - DNA, 551 bp, Homo sapiens
taggtatattaaatacttgtgatcctgtaaccttgaataatgcattgattagtacataagtgtcatatttgctctcttgggtgctacatatatcctgtgtaaagtgcctctgagtgatgtgtactcttgttgctcgccgcacttccgcactgtcgctatcactctcgtcgttcgtttatctacctctctgacacatgttagcgcattgtgtcgtgtctttgtcgtctcattatcgtcccttcgcgtgtcgtgcatttccttcacttccctccttgcctccttcttcggtttctctcgtgttcttatcatatccttcgtatacctccttttttttctcttggtgtatgtgtaacacactgttgagtaagcagtgggagccatacaacacaatccctagggctcatgtttccccagagacgctagcgcatagcttgagctagacttggatagggcagacgtcctataaatatctgcgacactggttcgaggttgactaactatagaactgccactgcggagacccaacctcgaaggcccggtaagtgactcga

SEQ ID NO: 556791 - DNA, 262 bp, Homo sapiens
ccccagaggcacaaggaggaaacggagggggagcgtacaacgaatttcctgaacctatcaaactgggacaagaaggaccgggcaaggctcggagaaaggttgcagtggctggagggggcagtgagagtggagcacagagtccttcacaaaccaagaacacacgtaggccttcaacacaattcccctctcctcttccaaacaaaacatacatcggatctgctactcctccagcaacaagaaatcattctgggttcacgggaca

SEQ ID NO: 556792 - DNA, 205 bp, Homo sapiens
cgcgacggcaggtgtactcatgcctgatttttcttgtttcttatcccatctcaacactttttcatttcttccttttcaccatcccaattggaactctccttgctggtggcttcaactcttggtttggtgtttggagacacagtttccctgttacccaggctctagtgcattggtgagaacctagcttactgcagcctccaatgcc

SEQ ID NO: 556793 - DNA, 158 bp, Homo sapiens
ctgaggagttcgacgcatcgaggctatgattgcgttgccgtgggtcaaacgagtatagatggtctcgagatgtgagacccctgtgggcgagtgtaggacgctgaataatttatgaaggagaggggtcagggttgattcgggaggatcctattggtgcg

SEQ ID NO: 556794 - DNA, 981 bp, Homo sapiens
  misc_feature (7)..(7): n is a, c, g, or t
  misc_feature (124)..(124): n is a, c, g, or t
  misc_feature (605)..(605): n is a, c, g, or t
  misc_feature (610)..(611): n is a, c, g, or t
  misc_feature (624)..(624): n is a, c, g, or t
  misc_feature (643)..(643): n is a, c, g, or t
  misc_feature (649)..(649): n is a, c, g, or t
  misc_feature (673)..(673): n is a, c, g, or t
  misc_feature (677)..(678): n is a, c, g, or t
  misc_feature (688)..(688): n is a, c, g, or t
  misc_feature (711)..(711): n is a, c, g, or t
  misc_feature (714)..(714): n is a, c, g, or t
  misc_feature (733)..(733): n is a, c, g, or t
  misc_feature (750)..(750): n is a, c, g, or t
  misc_feature (760)..(760): n is a, c, g, or t
  misc_feature (796)..(796): n is a, c, g, or t
  misc_feature (807)..(807): n is a, c, g, or t
  misc_feature (819)..(819): n is a, c, g, or t
  misc_feature (833)..(833): n is a, c, g, or t
  misc_feature (847)..(847): n is a, c, g, or t
  misc_feature (859)..(859): n is a, c, g, or t
  misc_feature (880)..(880): n is a, c, g, or t
  misc_feature (892)..(893): n is a, c, g, or t
  misc_feature (896)..(896): n is a, c, g, or t
  misc_feature (909)..(909): n is a, c, g, or t
  misc_feature (914)..(914): n is a, c, g, or t
  misc_feature (950)..(950): n is a, c, g, or t
cagccgnaaccgaacccaggaaaccccgacccccagcccaaccccgagcaacccagaacagcccaaaagcccagaaaacccagaaaaaagcaaaaaaaaccacccaaaccccagcagcgaccgncgaaaaagaagcccccccaacaaaaaagaaagagagggccagaacaagcagaagaaagcgccaaccagagcacaagagcagaagccaagccacagcaccaaaagacaaagaagccagccaaggagacgcccccgacaaacaaccgaaagcccccaaaaccaaaacagcaaacccgcagcgcgcccgcgccgcccacgaaaacaaacagcaaaaccacaaacgagcgcgccgaaaccagcggaaaccacagcccaacacccacccccacaaaagcacgaacagcgccccaacccaaaagaaaacaagaaaaaccagaacccgcggcaccagggcagccaaacccgcacaaaggaaaaagccgaaccccagaacccaaaaaacccaccaagaagaagccccagaacacacgccaacaagaaagaggaagcccacacggaggatggtcagaaccaagaagaagagaacgtcagcccggaggagnaaganncacagaaacgttnagaaaaacccaagcagtancttctntatatcagaaccaaagcaacaagncacnnacaagcacangccgaaaaaacaaaaacgaagancgnacccacaacacagtacganccacccccaccaaaagnctaacccaanacccgaaacagcaaggaaaccccccccaaacgagancaaagcgagcnaagccgccaacnctaagacaaaacanaggccaccaccccnaaacctccaacnaaaaggccacccaaaacatanatcgcggccagnnaanccacaaaccccancgagnccaaacaagaccagagcccgaagaacaagaaacacnaccacaagttcccgaacccacaagctcagat

SEQ ID NO: 556795 - DNA, 358 bp, Homo sapiens
cttgaataactgatcacagtcaccgttgatcctttccccaggaaatagtactttttgtttttattttcttccatgaactagccttttatccatagcagagaggttttctctcaagaagaaacaggatctgaacaggatctgaaccttaattcttcttctggtgggagttcagtccatttccttcttattctggattaatttcccctttgccattgaataaaacagaggactttacaaagggcctacttcatgccaagtaatgtgttaatagttctaagtggtttatgtgcatctcaaaagaccttcgccacaatttcacagactatatgttattagcccattttacaaactagcaaac

SEQ ID NO: 556796 - DNA, 146 bp, Homo sapiens
acggaatacagccagcgtggacatgaagtcggggaggccgcagctgaagctcaatcatgaccttccagaagtacgggcaagggcggttcagacccatgaaacaaacgagggagcaggagacaccccctgaactttttttatttctc

SEQ ID NO: 556797 - DNA, 529 bp, Homo sapiens
gtaatcccacacgcgaatcggaaagtgcctttccacaaagagaaaacgcccccgcctcccttacattttgatgtccacagagtaaccggcacgcgttcttgaagtgaggcgtgcccctccaaaatggactgaacctcccacaagcatagcctccccatatatcacctttaagccgttgggcataaaaaaattcaaaagggttggcacccgctatattaagagcgccccccctttggagaaggaggatctattttcaggaaagagctgactctaaagttgccttcggtggttttgaagcggcggaaaggaaaataaacaccgggcatggtgggaaaaaaaaaaggcggcggagaaaaaaggggggagcgccttctccatcaacagtaacatcattctggatcaaaagagacccccgggctggtttaccgtttttagaaagcgggtggtgattttcgtgcaaaggtgtaaatctgggaaatgcattgtttctgggacatccccataaagagtttaaaaactttctgcaaga

SEQ ID NO: 556798 - DNA, 1073 bp, Homo sapiens
  misc_feature (2)..(2): n is a, c, g, or t
  misc_feature (108)..(108): n is a, c, g, or t
  misc_feature (142)..(142): n is a, c, g, or t
  misc_feature (179)..(179): n is a, c, g, or t
  misc_feature (249)..(249): n is a, c, g, or t
  misc_feature (295)..(295): n is a, c, g, or t
  misc_feature (428)..(428): n is a, c, g, or t
  misc_feature (544)..(544): n is a, c, g, or t
  misc_feature (960)..(960): n is a, c, g, or t
  misc_feature (1047)..(1047): n is a, c, g, or t
tnctctatacacacttctcacacacatctaattcacacaatatacaaaccattcaacactctcatccccacacactcactcaaccccttacacccctcctctccaacnctcacccctcacaacccttaccatatccaatcancactaaaaacatccaaaactcacaaccaaacccaaanacctccattcccctaaccccacccccatccaatttcacaacacaccacccaccctccacaactaccaccnccctctccctttccctctctctcatctttcaaaacactcccaaccntccacaaaccaatcacccccacctactcaccacaacccacccgctcctcccccctccacctcactcaccactcaccttccctccccccttcctcacccccccatcccactcccttcactcaccccaccctccntctcctcctcccccccaccactcccgccgtcctacctccttccttctttccttccactcacacaacactcctccttcacccactcatccccactccccaaactccaacctcctccncctcccctcaacgcactcacacactccctcccacacccccacctacccaccttctcttctcctctcctccctccctccctccccacatcctcccatcctcagctcaagccccaggtctaggaatagggacagtgaagaaagtgtaccctccaagaaaaagcttctgaggacttttctaattgtgcagatacttctgaagcccatgccgccccgcccccacagccccatccccttgcccagggcctcacatgcccggctcccccaaccggtccttccccttgggctgccggtgcagctgtgggcccaggctttggcaggcccagcttcaagacagtgggacacagaaaacactttgcagcatcgcctctccctccgccacacccaggtcagcagagatgggccccccaccgagagancacagctctggtacagggaggtgggcagggttggagaggaatggagagacatgtcacctctatagaaacgcgttcaaagtacaagcnaagcaggggggaaggagagggccaga

SEQ ID NO: 556799 - DNA, 152 bp, Homo sapiens
gacctgcgcgaaataacacaaacattacaataacaaaataagaaaaatattaggtgagtgcaaaagtaattgccgtttttgcattgctggaataaagctagtttgatactggaatatcttcttttttttttttttgaaaaggaatccccccc

SEQ ID NO: 556800 - DNA, 869 bp, Homo sapiens
tgctatggtatggagtcctggttataatctggcacagaggctgtacgagtcatctgtctggacgcgctgggttgatgctgtgggggctccctgtggaactgtgttggagcctgagcaagcgctagccatgtgcgcaagcgcgcacagactgtatgccatcctgatggacaccccgggcttctgggtgaactgctgtggaacatcgctgctggaggacattctcactgctgtaaatcacgagtggcatgttccgagttaacgatgattgtagatgctctaactagctaggtacccgatactacacaagaagacagtcgctacattggtcggagaccatctaatctaattgtaagttataatacaagactgattccgtataagtcaaaagaacaaattcatacaattcgcacgttaataaagaagataagagcatgtagtcagcgtagagaacacagactgcgaagtgtctagacagatctgcatcaacacggcaatacaaactaaggagaagaggatgaatcacatgtacaatcttgtagcataaacagaaaaatataacaagatagaacgacagattcactaaacttattgagtggcagaaacgcggcagaaacaaccacagtagcataaccaaaacagaaggaggagcaagagtacaaacaatcaccacaagagaagataagacgaaccaaagaagaacaacttagatagtaacagtaatagacgcaaaataacacccaagaaagcagaggagaaatctaaagggacagaaccagcagtaaaagatgatacaggacagaccgacgagaacaccagagcagtagaagaagcacagcaggacagaaagtaagagattagtcgaaacaaag

SEQ ID NO: 556801 - DNA, 219 bp, Homo sapiens
  misc_feature (213)..(213): n is a, c, g, or t
tcgacccggtgacagcactattagtattgggcagcacgcagatggtggacagcttcgattgaagccgcttgtgtcggataaaggtgtcctcggcagcagcagacctgatgacttactgtgatgcccacgccgtgtgaggatcccctcatcacccctgtgccacttcggagaaccccttccgggagaagaagttcttctgtgctctcactctgnatgctc

SEQ ID NO: 556802 - DNA, 239 bp, Homo sapiens
ttgtacacgtggaagcctacagttgtggggagcttctgtccacctgtgctgtagaggagcatgttccagcccgtgtgccccaggatggttgagttgaacatgatgaacacaacatggggcaccggccgcctgaagtacttgatgtttacctacaattgctgcttgtggctgggtggcctggatgccatggcagaggacatctggacgctggccctaatgagtgactacatcagcctgct

SEQ ID NO: 556803 - DNA, 1112 bp, Homo sapiens
ggacgcgtgggtcgacccacgcgtccggcgccccagtgcgtcaacaactggttggctaaagggcttggagcgcagtcacttataggctgtttgcagtgcagagctagagtcccgcactctgatctctcctcagtgcagaccctactggatgttgagccccaggtcgatctacaacctggtatgctgtaacagggctttggatctgtgtatcgctccaggctccgatacgttgccttctctcgtaagcttcctctaatttatcgctttaagcgaagaggggtaaatcgaagcgagacgtaaacaactgtcgatcggttcatcgatacttcgcccatcgaagcatggggccttatgagtccatcgtctgggcagcttggacaccctggtatatcgcaagggagtcggttccccttagttcgacatttccatgtattgtactgggcataaagtggcatgtggtcgtacatttgggcaggcgcacagccctaatacgccgtgtgctttccaattcatttggggatttcttgttgagcgtcccaggggaaaggtgcgctcccaccggactttggccagttgcaaggcgttccttgggattcatttccccctttgatgccccacaggggcaaattcgaaatcatggagatactggatactttcagcgacacaaggcaacggggccttaacaatctcccttgatgtcctcctgtgtgattgacacagcctcttagtggacccttttgttagacatttgcgcctgggcggaaaattgccggtgaacggggggtttcatttggacaaagcatccacttggggggatctcggactatgtcccctcgatagcgtttcgccttcgttggtggcgcgattatcccctatggtggcgcactcgtacggaaggtccgagtaaatcatttaagccgaacagtcgggactcggattgccagtacaggaggccactcggtacctcgctgttccagattcaccttttccacaccattggatggatgtgcacacccacaattttgggctcagccgccttaggtgcagagtaagagcgcactacactctctatactagggggagaagtctccctctaggaccttgctcccaca

SEQ ID NO: 556804 - DNA, 173 bp, Homo sapiens
actgcgatattgaaaaaatttgaaaagggacccggatagacaccattgtgtgtgtatgtatgtgtgtgcacacgtgtgtgtgtttcctactcagcacacctcctcattcttttgacaatgaagcacctccttattggggggttctatgtagtttgggtgggtcagaacataag

SEQ ID NO: 556805 - DNA, 294 bp, Homo sapiens
ccttctttccttcctttctttctctctttccttcctttctcttccttttctccttttctttctttctctccttccttccttcctttctctccttctctctctctctctttctttctttctttcttgccttccttccggatgatgagtgagaagtatgggagaacttgtcggggtcagtgctcttctaaactccccttcccccaataatgcagctggtataatggaatggtaaatgcaccggttgggattcaggcagagccccagtctgcctacagcagacaaggtagagccgag

SEQ ID NO: 556806 - DNA, 138 bp, Homo sapiens
  misc_feature (42)..(42): n is a, c, g, or t
  misc_feature (69)..(69): n is a, c, g, or t
aacattgcaaatgacaaacaattcatttttaattaaatactnacaaggaaaaaaggcaccatggcccantcaagtattttgcataagatgtaacaaatattgtaaacaattaataggtggacaagagagaagaagatc

SEQ ID NO: 556807 - DNA, 185 bp, Homo sapiens
aaaatcaagcaggtgtagttatatcagataaagtagactttaaagcacaatagtaaaaaaaaaaccaaagaaagtcattacataataattaacaggatcaatccaacaagaggatattacaatcctaaatttacatgccccgtaactctggcagctcccagtattcataaaaccaattactcatt

SEQ ID NO: 556808 - DNA, 103 bp, Homo sapiens
gagtgagcctttcgaagagatactcgcccagcccatgctccgggccaccagcctgtggaggttggtcaggtggttacccatcttcttgataagcttcacttcc

SEQ ID NO: 556809 - DNA, 325 bp, Homo sapiens
cttacctagagtagtccaattcatagcaacaagtagggtagtggttgccagattctgtggggaggtggaaaatggagagcaacttaatgggttatactgtttccattttataagatgaaaaagttttggagattgattgcataacaatgtgaatatacttaacaggactggactatacacataggttaaggatggtaatttttatgttacggggttttttcccataatttttaaaaataatctagggacaattctttcataaggtcataatttagaagcagtggcagatttagacagcattattactattttttattattttcaa

SEQ ID NO: 556810 - DNA, 150 bp, Homo sapiens
gagagagctagtgccatcagattcgagtccttatgttgtgctccacctgtttcttccgttcagattctctcgcttcatataactccctgtctgtgccaaacgatcaaataaaagggcggcgttaattccactgggccggtggtacttacc

SEQ ID NO: 556811 - DNA, 328 bp, Homo sapiens
cactctctgatcattaaatagagacagtgtcacatgatgcattcatttctctatggcactgtgtatttgtgtggataaaagcgaaacaaaacacaacaaagaaaaaagctatggaattccatcacttggaaaaactagatcctgttggttatagcataagtgagttctccacgtctgtctctctcgctcatgtaatatactctgaccctgagtggaaaggggttgtatgtactgttttaatatttacctacatttgctatttagcttcagtgtactattcctgccacctgtgtattttaagggtgctattgaaacttctaaaactagg

SEQ ID NO: 556812 - DNA, 168 bp, Homo sapiens
gaggcgggtctgaactgcggatgtggatcacggtggacgtcgggggagcagggttgtggggcgcccaagaacagcaacctcgtggttcctccttgagcatctcatagttggggggctggcactgttgacaggagagaagaaggtttggacagtgtgattcatggtgtc

SEQ ID NO: 556813 - DNA, 178 bp, Homo sapiens
tacctaaatgtatttaaaatcttacacccctgttacttccttatatatactctggtctccaaataaacaaaactgtcacttgcccaataacacataccatcctttttctgtgcctcttgcattcatttttcttttcctgaaattgctcttccttttactacctaagaccctagtgtac

SEQ ID NO: 556814 - DNA, 221 bp, Homo sapiens
acctcaagtatattttaaaaactagaaaagctgtgcagctgttatacaggcatggaaagtatgttggcttacatttatcatcagcaccttaaaaatattcgagtagcaggcacagtgcatgcgcctgtaatcccagccattcgggaggctgaggtgggaagatcgcttgagcccaggagttcaaggccaccctgatcaacatagtgagacctcatctaaaa

SEQ ID NO: 556815 - DNA, 489 bp, Homo sapiens
ctagggatgctatgtgaacttgcagtgtacgtaaagtgagttagatgtaagacagatggagcatcatgggttggattattactgagttcaataatctggtgggttttgccagctagaaacataataaaatacatgataaaggaatagaaaggaaatatatttatttgaaattaaattactgcttataaattcatgtctctgattttacaaagtgtaatgggtaaaattaccatattctttttcttatttcaatccatacaatgagagtcatgttcagtttttcactgacttcatgctgggtaatgttcactctgcattagcggttgccatgttcaccgttttcttacaatgtctatccagtgcttgttactgtctcactgacagacagaagtctagctgttttcatccacataatggcaggcagggctagtgttgctgctgcttcacccagagaatctcattttacaataaagttagtattatacttga

SEQ ID NO: 556816 - DNA, 441 bp, Homo sapiens
  misc_feature (7)..(7): n is a, c, g, or t
  misc_feature (16)..(16): n is a, c, g, or t
  misc_feature (44)..(44): n is a, c, g, or t
acctggncctaaaaanccaaaaaactggccttcaaaaccccccngttgttcctttaaactagcccctgtgaacaaggccaagaaacagtatcctcctaagcacctcagtctcttccatcccattaaacaaggattaaaatggtaagtccaccaggctgggccgcaagttgtcacgccctgtaatcccagcactttgggaggcctgaggtgggcggatcacctgagatcaggagtttgagaccagccctggccggaatggtgaaaccctgtctctactaaaactacaaaaaattggcccaggcgtggtggcacgtgcctgtaatccctgctactcaggaggctgaggcaggagaatcacttgaacccgggaggtggaggttgtggtgagccgagattgcactactgcattccagcctggcaacagagcaagactccatctca

SEQ ID NO: 556817 - DNA, 508 bp, Homo sapiens
tcagatccaactataagtctagtaaatagtagatattcgaccacctcccatgaaccacaaatgtatctttatggcatttaaaatggtgaatcccagccaggcacagtggctcaaacctgtagtcccggcacttggggaggctgaggtaggtggatcacgtgaggtcaggagtaagagaccagcctgaccagcacggcgaaatcccatctctactaaaagtacaaaaataagccaggtgtggtggtgcatgtgtgtggccccacctacttgggaggctgaagcaggagaattgcttgaacccaggaggcagaggttgcggtgagcaatgatcacaccactgcactctagcctgcactacagagcaagactccatctcaaacagaaacgaagagacgcgaccagaaaccgaaaggaagcaatgaaatgaactggacatgatgacatgcactgcactgcaataactaaatcaatcaccataaaacagaggtgtggtctcgaggtcagaact

SEQ ID NO: 556818 - DNA, 342 bp, Homo sapiens
ggaccttgaatcgaacggtctccttaacaaccattacaattgcatagtttggtgtgataacaaaagcatagcaaagagtacaaagttattaatatatgttagctgaactgaaattgactgttaaaaacagtctatcttgtgtagatgttagttgaaacttagaagggaaaaacagtcaatagcaaaaaaggtttctttaaacaataggttaactgctaaagaaataataggctttataaatttgtttacaaaaataaagctttatttaaaaccaaagaattatacaattcttcaatcacaaaccagcttcttttgaaaatgcccctattttctcttggcaca

SEQ ID NO: 556819 - DNA, 222 bp, Homo sapiens
ggtggcccccccggggggcctttttttttggggttaaaatcccccccttaaagggcccctcggggcctggggctcccccccggggcccttttttttgggggttcccaggggttttttttccccccccccccccgggtttggccctgggcccccttccccctttttccccggggcgggtttttggggtggtttgggattaaattccttttttgggttttccga

SEQ ID NO: 556820 - DNA, 276 bp, Homo sapiens
gacgcatttatctagcatttactgtggaagttaatgctctgttcttcactataatgtattatgtggttaaactgagctatccccgcatctgatgactattggcatccactttgccaggccaatggcctggattaagggttaggattatttgtagctagaatgtcattttatttctgtgaaatcttattcgctcatactttgacggttaggtgtggcctttaccttaccagtacatttattcccgctaccagttgactagcccatatcattgttcaa

SEQ ID NO: 556821 - DNA, 207 bp, Homo sapiens
acccaccgccactgatcagggatcgtagttgagtgtcgcgggccgtaacgcccatctcgatacaccaaccgatctggagtcttggttgagtgattcggcccgaatcacccagatcgctgccgccactgatctgggatcttgggtaagtgattcgggccgaatcagccagtccgccatctccgccaatatctgactcttgcgggggga

SEQ ID NO: 556822 - DNA, 236 bp, Homo sapiens
cccgctcgtggggactacggaatcctggactctctccaggacgccgttcgacatcgaatcaaactggtttactccatcgataaccatttgcaccagctccacctctgatttgcctatatcggtccaagattagaaattatcaaatgacactcgcctgatagctagcagatgttccaactcctccatgtaccagcgttttgtggagtcttgagtgttcctccaggggtgctacctgc

SEQ ID NO: 556823 - DNA, 167 bp, Homo sapiens
aagcagttaatacagactcaactgtggggctctacgcacttctcccttcccaggctcccaatgtatctagggactacagtgtgcttcgcagctgtggtggctcaggatgcctttcatttctatttcttgcctaagttgctataggttagaaacgtctactaacagtg

SEQ ID NO: 556824 - DNA, 497 bp, Homo sapiens
gtctgtgtggaaagcggctgtgcagacattcaatggttattattatgaaaacaaaaaaaacaaaaaaaaaaaaacatttgtgggccgctgcgccggaaaaaattttcaaacccattctgtgggggggcggggcccaaggggaaggaaacctcgggccacaacggcgtaccccagagaacacccggggcacaaagcacaaagtggggcggggagttttctcacaccaatataaaaacaacacagccgggcgggacaacccggagcgggggttcttgacaacaatctcccagttgggacttctgcggaggcgccaaacaggcgggactcttactcaacaggagagaggcacgcgagggaggccgagcatacaaaaaattaacggccccagctagagtgggaaaaagcacgacgataccaaacagcagcgacgggccaagagtaaccacacagcaacagatagtagacggatgcgaataaacaacagaacagaccaacga

SEQ ID NO: 556825 - DNA, 455 bp, Homo sapiens
gtagaccctgtatcggaggcacttcctgtgtgtccgtgcatatgagctcggcgccgagtgggagacacaggggcgttgacaggacctcagcatccgagagggccactcgagggaccttccaggggacgttccgtaaaacggcgatacgggcacactttttttttttaaggagagaccacagatcctgtgggattatcgaggcgatgttggcccgagaacctcggctgcgctgggacgggtggggagctagggcacccatctgacgatgagccagagccggggcaagtgggttgggcgaggggtggcccttggcctgagatgtgtggggcttgcaagggtgggtgggggctggtcagagggggaggtcaggctcgggtgaatgctgagcctgggggaacagattggattccgccggtctgagtcacggctggggagtctcccagcctgcagtcacc

SEQ ID NO: 556826 - DNA, 944 bp, Homo sapiens
  misc_feature (153)..(153): n is a, c, g, or t
ttgggccagttgccgcttttgcgcgggcccccacaatccccttttcttcgccccttttagagggaggacaacctccgggcgttccccccgagacgttgtaggcgctttattatctttataggtcctcccggagatatttggggagagattttnggggtgttacccccccccaggggagagtgacccccccctccccaacacgccactgggctgcattgtgttcgcccccctttgtagaaactctgggggggacgactacattataatcagagaagataagtacaccgccaggaggaagaagtccttcttggttgttgttcatcaggcaggaggggggcccccttctcttgtggagcgcccgggggaggaggaggtcttttcttgcctcctcctgtggcgcggcgtctttgcgcctcgccacctgaggccttctcagagagctttgccactatatctttcttccccggggagcgctttttctctctcccccaacgctcacaggcgcctctcacaccccccctcgggggggggagcctccgcagaggattttctctctatagacgggggcctcgcgaccgtgggtgtcccccaccatagaagccgcccgacgcggggtagatgttgccaccacgaggaagagctctctcgtttgtggcgctgctgtggttttatatgggtgtagagaccaccctcccgacctttccttatccctattgggacttaccctctatagggacttactttttacctccctcgccctcttgaggccccacctctctccaagaagatattcccggtttccaacaaaaagcccggccccccaatattttttttagccccccccggttcagggcgttttgcccaatttggatagaaatagctgccccccaccatatttccccctcctttaattacaaatgagggttttctggttccaaaaaaaa

SEQ ID NO: 556827 - DNA, 241 bp, Homo sapiens
tagaccagctgttacagcacaggttgttcacccgtgagccccaggatacctaccactacctgcccttgagcctgccacaccggaggcctcacttcttctttgccaagttccgcatcgctcgcagcttgacgcccttctctccgtacgagcccctgaacttccacgccatgttccagcccttacttgagatgatacacgaggctcagcaggccattgacatccacttgcacagcccggcctt

SEQ ID NO: 556828 - DNA, 719 bp, Homo sapiens
gagcgagaggacgagcatagcatctgcatgaagatggatgtgggcagcaactaggtcctgatggagagccctggcggtactagtccgcagatctccctgtgggccgatcgggtgatcgcgtgctgggcacagtcgcagcttgaatacagccattcgtttatcggtggtcggtgcgtggtggtcctcaatcgtctgctggtggatccgtgtgcgcacgtccttgcgtcattggtggtctccgagatggacgcaagagaaaatagagcggagaatagagtctcatgagaacgatcgaagcgatgaggtggacgccacgggcaagccaaaaacaacagcgcttggcccccttgaagattgagcaaccttggtttattcaagttgccaaaacttttctcccaatttgggcctcccaggtgggccatcgatgcgtggtacttgacttaacgcaggaacgctgtgccttgatttcctgccctttattaaacggcccaaggaacaccccgtggaggatggcattgcttggttttactagtccacttgacagagagtacggctctcgaaggaggacgccaatttcgccctagggttcgttttgaggggcgttcgtccaccataaaggaaaaaagttccctagcaagaggttttcccagtgactgggaaagtggcctcgtcgtagcagggggctagagccgggcagtatgtcgtaccggttcataatg

SEQ ID NO: 556829 - DNA, 761 bp, Homo sapiens
cgatgttgctggcgccccggttctcttgtgggcgggaatccggcgcgcattttttctttgtagcgggtcccctgtagcgcgtgtttttccggtgtctcgcggttgccgggaacataatttccgccgggttttttgttggcccctgttgcgtctgctgggcaggaggtctcttcccggtcgatggcctctttcttgcccttgtagcgctcattaagagattgcgcttcttgcgaggagttgctcgtaactggttgcattgccgcgctagttgtgtgcgtctttgtgtgggaagtcgagtgtagccaatcctttgttaatatctcgctgccgttgatctccccccttcttttatccttccctgtgtagaatattttatcgagtggagttaataaacccctcgtgttcctcacgtattccactagaacttccactcctctcctttactctatgcacgtggattctccctccacactgcatgtgttgtcaccccgccctctatacttattccccttgtcacacactcttcttctcccccctcagccactcattagtggtctcactccaccccgcacgccctatcttcaccaccatctaacgccccgtcattcccacccgcgtattaaccacccgtcctaggtttgttataccacactccttttccagcacgttatttaactctcctcgaattcttcgctcctcgacgcaccccgcaacatccatcatcccgggttttctcctcctgtcaaacaaaataaccaaaa

SEQ ID NO: 556830 - DNA, 164 bp, Homo sapiens
tctgctccaatcagccatcttcgtccctcaggtcacttgtatcaagtatttttactttttatttttcatttaggatattttctatagtgtcttcaggctcactgatcattacttctatagctcacgctctgatattaaccccatctattaaaaatttaaggtac

SEQ ID NO: 556831 - DNA, 282 bp, Homo sapiens
taaggaaaatgtagcatttaacttcagaaatttagtggttcagaatagttggtgtgtgatattatggcttttattaagctgtaatatcatgtaatgatattacatgtaaatgatattacatgtaaatgatattacatgtaaatgatattacatgtaaatgatattacatgtaaatacatgtgatcatgtaaaagtggaatttatattaattttaattttccttttaggatctcagattacttaacattaacatacaacacaaagctagagataatgtgcgta

SEQ ID NO: 556832 - DNA, 1846 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgaaaaaaaacccaaagcgaaacaacagcagaacaacagacaaagataaaaccgccaaggacagcacaacagcggaagacagaacacacgaca

SEQ ID NO: 556833 - DNA, 206 bp, Homo sapiens
aaaggggcccccccccccccgggccccccccgggcgggggttttggagggcccccctttttttgaattgggcgggggggttgggccttgggggttttttttttggttcccaaaaggtttaggaaagggggggggggcccccggggggggggcccctttttgcccccgggggggattttttttaattttccccttttggatttggga

SEQ ID NO: 556834 - DNA, 1474 bp, Homo sapiens
  misc_feature (13)..(13): n is a, c, g, or t
gcagataccccancctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacagctacactcgccatcacgcgtaccagtcagcaaccgttatactcgccgtccttttactctcggaga

SEQ ID NO: 556835 - DNA, 652 bp, Homo sapiens
gcaggagaatgacgtgaacccaggaggcagagcttgcagtgagccgagattatgccactgcactccagcctgcacgacagagtgagactctttctcaaaaaaaaaaaattaaaaaatctgaaactgtttgaattaagggtagtagtaccactacaaataaaacacaaatagattgggtagttaccacataatttattttgtctttctttcttagcgggggggtagatgggttagagagtatggccaaagatgaaatggagaatttcctgataatatggagtttatgcaaaatcagtatatgggtaagttaccaaacttataattcttaagggtcactcaaggtgatatggtccattcatctttcaataagtattatccagttttacttggttcacactacttggttcacacctacttggttgggctgtgtgacgcaaaacaaataaaggcttggcctttatggaattctataatggtttaagacgagttacgatagctgattggcaactatacagtgggccctctgagtagggggtatcgcatccagggcatggaaccaaacctgcagatcagaactatcggcaataaaacacgccgggtgtgatggctcacgctgtaatcccaagcacttggggaggccaaggtgggggaa

SEQ ID NO: 556836 - DNA, 291 bp, Homo sapiens
acacttcacacctgggggtgctcaagacaccccatgacccaatgatgtgccccatccaaagtctctgtgcggaaagttacaaaggcctcactgcaagctccctgtcggagagcgcacttatgcccttggaggcaagctgcctggtcatactggctgtaaagagcaaggtgcctgcacaggaccttctctgtatcctatgccaagtcttccaggctaatgacacaagagtccaccatagtctttctggacagagcgatataagatggggcctatacagctacccaccacatg

SEQ ID NO: 556837 - DNA, 173 bp, Homo sapiens
  misc_feature (17)..(17): n is a, c, g, or t
  misc_feature (125)..(125): n is a, c, g, or t
gccaatgctcctatttnagtctgaaggctgtctgctgtagaaccaggaagagctgatgttgtggaagttcaaaggcagtctgctggagaattctctgctgccctggggaaggtcaatcttttttnttttattcaggcttgcaactgattggatgagttcctcccacatactat

SEQ ID NO: 556838 - DNA, 251 bp, Homo sapiens
  misc_feature (180)..(180): n is a, c, g, or t
ttattccgcggtacagggacacagatttattaaggacacattcctgtgcacattgaaagtgtctgctacccatatcttcttgaacgtataataggaagatagctcgataatgagaattctaccactatttgattaacgagccaatttttatacgccatttctggaacgttcagcacgatngaatagtcaccatgttactatcgttttctcgcgccacgggtacgcgagcatcgaattccgtaatacattgt

SEQ ID NO: 556839 - DNA, 105 bp, Homo sapiens
tgctgcagatcctgtatgagatccccctcttgagggcgatgaggatacgtctcgcatggcagaagtcgataaggttaggagttcatagttggaaaacttgtgccc

SEQ ID NO: 556840 - DNA, 526 bp, Homo sapiens
  misc_feature (139)..(139): n is a, c, g, or t
  misc_feature (163)..(163): n is a, c, g, or t
  misc_feature (409)..(409): n is a, c, g, or t
  misc_feature (417)..(417): n is a, c, g, or t
  misc_feature (480)..(480): n is a, c, g, or t
  misc_feature (488)..(488): n is a, c, g, or t
  misc_feature (514)..(514): n is a, c, g, or t
tggggtttcaccattgttggccaggatggtcttgatctcttgatctcatgatccacccgccttggcctcccaaagtgctgggattacaggcatgagcactgtgcccagcccttttttttttttttttttgacggagctncgctctcttgcccaggatggagtntagtggcacgatctcggcttactgtaacctccacctcctaggttcaagcaattctcctgcctcagcctcctgagtagtggggattacaggtgcccgccaccatgtctggctaatttttgtgtttttagtagagacggggtttcaccatgttggccaggctggtcttgaactcctgacctcagatgatccacctgccctgaacctccgacagtgctgggatttacaggcataagcaaccgtgcctgnaccagggnttttttagcaaggaaaacgtgaggaatgaatgggtgtttggtttgcaacaaatcataattgcnacatgttntgaaacctgaagttatttgttaagtnttttatgaagaa

SEQ ID NO: 556841 - DNA, 104 bp, Homo sapiens
cttatagaaaaacaaaaagaacaaaaaacaaaacacacacacacacacacacacacacacacacacacgcccccagaggcacaggatacagagtggaaacagcc

SEQ ID NO: 556842 - DNA, 252 bp, Homo sapiens
  misc_feature (36)..(36): n is a, c, g, or t
  misc_feature (42)..(42): n is a, c, g, or t
  misc_feature (51)..(51): n is a, c, g, or t
  misc_feature (75)..(75): n is a, c, g, or t
  misc_feature (80)..(80): n is a, c, g, or t
  misc_feature (116)..(116): n is a, c, g, or t
  misc_feature (227)..(227): n is a, c, g, or t
ggcaagaaggcattttttttttttaaaggaaccaanctctcnaatcatgangtgatataaaagcggcatatgccnccaangctttgaattcgggtcccagttgctgtcccaaaggngggggtgaaactccccccccccccccttttttatataataaaagggccttagcatgggttgcagctgtcccccctccagtaagctggtttccaaatgttttcccctgggcntcccaataaaaagaaccatgggcta

SEQ ID NO: 556843 - DNA, 973 bp, Homo sapiens
  misc_feature (243)..(243): n is a, c, g, or t
  misc_feature (322)..(322): n is a, c, g, or t
gaccttcacttcgcccctccagctgctgctgctgtagcccgaccgcgagcgtgccaagcggacttcagtcagctagcggagcggtggcggcggaccccctcaggacactcaccagtattccccttcttcccccgccggttctcgaccatggacgaactccacggcatcagtatcttgcagcagacgcttgcacaatgctagtgattccttcccctactcattcatggctaggacccgttgtgnccaatagacttgctctacgtagaattatcttattcacatccattatacgagacttagagttaatcttcgtgcgctgttngagtagaatagaacctgcaattgtgcaaaatacataaagctctttgacaatggatgtggccagttggtatatttatacctacaactgattaccggggttactatcttaattaaccagataagctgtgtataaacgcctcatctggagatctcttgagatcacccaaaaggtatcaacgctggtggtgacgtactgcgtgtcctgatctgtgtcacctaggatatacatgtcgggaacacctgtgaataaacacttctgcgccacacacgacaatcggtaattattgaaaagatccacgtactcttgatctaaggtgttgaaacctgactcaccttccgatacttatcccttccttaatccaatcatcaggaagcgaaaaagtggtgagaatcaagtcttcttacgaatgagggagtgtataaactttggttgtgatgtcggactttggattgtagttggagcctgcaatttccagtggttacacgtagtcattaggatatgaagaggtaggtatgtggtgtatcacgatgacacttttgagaagtgcctaaatcaaaagtgaaaatgcattaacttggaagcgggttacagggactggggagttccaaggttcacatgaatggtcaccttgttgggggccaaacacgggcc

SEQ ID NO: 556844 - DNA, 966 bp, Homo sapiens
tcataatgcagttatttaggtgaacacaacagctgacttttcagaacaaggcagcaactcacttttatatgctaccacagtatttcataactttctgggaaaccttatttaggtcatacaatggtcatcttatctattttccaaaacaggtcatattttaatacattgtcacaattctcatatcacagttgcgtgaccgagcaattcggtcacagttgctacgcgtgtcatatcaaggcatcctttctaacattcatgccaactacgaggcatggtcatccattctccaaagtcctcattttggccacaaggcttaaaaccaagtcagccacacacacgcattgccacattgtacggccattcgagtaaactatggctggtcttctacactatatctcaccctggctacttttacactttgacaaaccctaaaaacaccactggttctgacacacacgcccataattcacattacccttaagataaaatcgttcattaaacttttccaacacgtgaattgttacctttggtacacacacactggcactcgtctacacattttcggcacgcttggggacaacccctgggagaacaacagacgctgacgctggactaacatctctatcgggagcggcgttggactcctcatcagcgacttctcggtccttcattagacacagataaaacaagaacagcacattctggcagcacgtattttgtaaaaccctcttggagcattttcacactgctttacgacttcactttatccaggccatacacgcgaagggaataccccgtggctataagcgggctacttcactctacatggcctagttggccctttctatttacacgctgacaacccaccgtcatcggtcgcaggcgcttcatgggcccattaccccaaagacgtaactattacaggcctgggctctcacacgaacccacactcacaacgacaccaca

SEQ ID NO: 556845 - DNA, 91 bp, Homo sapiens
  misc_feature (33)..(33): n is a, c, g, or t
gccaccgccgactccaggcactcactcaaactngatcttcaactctgcatacaagcagaagcaataaaccaatctgattttcttttcaatt

SEQ ID NO: 556846 - DNA, 391 bp, Homo sapiens
gccgcaggcttagcgctctcgccctgtgcatgtagcggacagagcccgacgaggtggtcatgagccaagccatccaggcggcgcacgccactgcgcgcggcgagctgagcgcggagcacctgctcaagtggatcgacaccaccggctgtctggcggctgagaaacacgctggagattcctgcgatacagcctcagcggatgacatacagttggaggagacaggtagagttggacaagttatcaccatcaaagcacaagatactagagcattgagcacaagcatggagatcagtatcaaggtcatggcacaggatatgctcactggcattgagaagctagctagagtggctttcatgacatttgtagccccagctggataagaggttcgttt

SEQ ID NO: 556847 - DNA, 154 bp, Homo sapiens
tgccagacaggatggacactcgtttgaattgacttgtcaagaaggctggacgagagacttctgtccctcccagatgtgaacctggcactggccagcagctcttctctgagctccatgtacagataaatcaggccagactgagaaggctccccag

SEQ ID NO: 556848 - DNA, 175 bp, Homo sapiens
ttggtaaagttggagttctgccgtgttactgatgctgatctcgaactcctagacctcaagcagttctctttccttggcctttcagagtgctgggattacatgtgtgagccactgtgcttggccaaaatatcgttttttaaatcatagtagcttagtatatctagttgagtgagcc

SEQ ID NO: 556849 - DNA, 223 bp, Homo sapiens
gtcaagcacatgaggttcttactttatgccgtccaatctactggtttggtgtgtggtttcttcctttctttaatctttcgcaagtcctctcaatcttcatattttcttccacctttatggtaacgtctttcataattactcttttattcatcaaccatatgtgtaggtatatgatgttaaattaagctcatgattcccctccccaatagctatcaaactatcc

SEQ ID NO: 556850 - DNA, 627 bp, Homo sapiens
  misc_feature (1)..(1): n is a, c, g, or t
naacagcaaagtcttgtgtgtttctatatgacgcgattcctttaacagtcctgttacactgaaactgctgttcttggacttatcacaggtcttctccttaaacttaatgccaaaagtaatttagcaacatatctgacttgattgagtgtagagctattcacagtctcatttgatcccacttagatatattgtgctaaagagtaccaatgtagtacctagtggtattaataatatatgccacatattatctaaaatttgaaatagcctgaatccaaagcacagcgtgggttaacatacataaatactagcactgacctctgaaaccttagtataacaaaccccgagtaccaataagtccccagagggtctgcatgttggattcatatataccatcctctaacaaaagaacacagggctctctggagagaggagtcgattccagggcagggacagggataatacaagagcctggtggtgctagaaagaaagaaagtgctcaaaacaaaaagcacagaatggagaatgttgatggggcacaagaatccaactgaaggatgtggccacagctggaagatctggagcaacaaaataaatggtgataatattgatcataatacaatactgtct

SEQ ID NO: 556851 - DNA, 87 bp, Homo sapiens
gggtcttcgaaagtgctgggacaggcaggagtgagccaccgcatctggcccggaaagtgtttggagcgtagaaaaatgcaaattata

SEQ ID NO: 556852 - DNA, 213 bp, Homo sapiens
gacattacacctttgcagtccagcctgggctacaagagcgaaactccatctcaaaaaaaaaaaaaaaaaacccaaaaggtgattctcaaacaccagcctggccaacttggtgaaccctcaccccacccgaaaatacaaaatttacccaggcgtggtggcacacgtcttattatctccagctactcaggaggctgaggcattgagggggaccct

SEQ ID NO: 556853 - DNA, 93 bp, Homo sapiens
ggacgcgtgggtcgacccacgcgtccgcggggagatggctgaggccgaaggggttcccacgaccccaggcccggcttcgggatcgactttcag

SEQ ID NO: 556854 - DNA, 369 bp, Homo sapiens
ggctgatcactgcttttgcacagatctgaggcatgagaatctttcgaacctggaggtggaggttgcagggaggtgagattgtgtgactgcactccagcctgggcagcagagtaagacaccgtctcaataaagaaataaattacccagtctgaggtatttatttacagcaatgcgataatggactaatatagaaaattggtactgaggagtgaggcattgctatatagatacctgaaaatgtggaaacagctttggaactgggtaacccacagaggttggaagagtgtggagggctcagaagaagacagcaagatgaggagagttttgaactttctagagacttgttaaattgttgtgaccaaatgctca

SEQ ID NO: 556855 - DNA, 1127 bp, Homo sapiens
agcgtcggggctcgcggatggcggcgcaagggcggtagggcctggtgccggtggtcggcggcgcccccggggctgggaggcggcccgcgagaagctggcgctgcggcgcacgaaggtgctgagcaccgaggcatatggagctgtacagagctggcctcagggcggagggcgagcgggtatcgacccctgaggttgttccaaagatccgtggtggaacctgctgaaagctgaaacgtggcccccacttcgcccgtcattaccagattgctcaaaggtcctagtgtgttgccaggagctagaagtgctagcgaatgcagaggcccccaggaggaccctttgcgggcccgtgttctcatgaccacaacagtagagaagcgggtgcccgaagaaccccgagggggatgaagacaataacggcaaaggcggctaggcaccgtccggggaagcacacgaatactttgtgggcccacagatggtgccggggaagactcgcataggaaaagaccgactagaaaggaggaatcgcaagggccaaagctaggaattggcccactggcacagggccccatatggggccatacaccagggtcttggccacaaaaatgcgtagagcatggaagccctgtggtcacaaagaaagaccccgtaacgtaccagtggggcaaggcaagaaccattagaggaatgtgaggggcctaaaaggcacttgcgattccaggatcatttaggatcccccccaaaggcataaacgcgccgataccacaatgtattcaacgcgtaccattttaccaaaggtggaaattaagactagaaccgccttttaccatggaacaagttgccagaaaggggggtcccaacgagatgaacaaacagaagaaacacaacaacagaagagctcgtccacccaatcacaggtggttggtagtgatcccaccgcgccactatatagagggtcgcgctcgtaaaatccagcattttccagaaagcgagagctgatgctcccccgggtggcaaccaaaagaacttttcagggtacccacccattttatcaggacagacaagacgttataaaatatatacatagacagcgtgagggagacgtaaaacaaccagcggtggagcacgta

SEQ ID NO: 556856 - DNA, 365 bp, Homo sapiens
ttaagtatcaggctgcacaggtgggtacatctatgcaaccctaacctttctgaaattactaggcatagatattcctgaagcactagtctcagcctgcatgtatggtccctcatggctactgtctcatttgaaaagtgagcctatgaacagaggaaaacactatgatttttaccactgtttggtcacaccaattcttgacattaactctctcgaaggcacattagtatgaccttcaaatcctagcccccaggaaagcttcacttgagaaagtacgtttcctgggtatcccttcctacaaaccacgaagcaaaatgacacacaccctccttacatgcatcaaaacagtgctgataatggatgaaaca

SEQ ID NO: 556857 - DNA, 172 bp, Homo sapiens
cctgagtccttctcatgccatctctctgttctctctcctgcctcctcctccacacagaaggaacacagcgctgctaacgcctcggatttagccccaggacgcctcattgtcagactcttgacctgcagaactgtgagatgatcaacctgcatagcataagctacttcccacc

SEQ ID NO: 556858 - DNA, 140 bp, Homo sapiens
tcgttgaacataacaaccttttatagcggctgcaccatcgggatgtcctgatccaacatcgaggtcgttaacccagattgtttatatggactctagtaataggattgcgctgttatccctaggttaacttgttccgtcgg

SEQ ID NO: 556859 - DNA, 126 bp, Homo sapiens
cctgaggacacggctgtgtattactgtgcgaaagaagggggggaggtatttagcagtagcagctcctatttgagggtaccacacacagctggaggctatttgtacttcgatctctggggccgtggc

SEQ ID NO: 556860 - DNA, 409 bp, Homo sapiens
gtggaacatcacttggttctcatgatctgcctgcctcatgctcccaaagtgctgggattacaggcgtgagccactgcgcccagcctattagttcattttcatactgttgataaagatacccaagactggataatttataaagaaaaagaagtttaatggactcacagttcctggtggctggggaggcctcataatcatggcagaatgcaaaaggcacatcttacatggcggcaggcaagagagaatgagaaccaagtgaaagtggaaaccccttataaaaccatcagatctcatgagacttattcactaccatgagaacagtatgagggcaactgcccccatgattcaattatctcccaccagttccctcctacaacacgtgggaatgatgggagctacaattcaagat

SEQ ID NO: 556861 - DNA, 131 bp, Homo sapiens
atagcccagatacagctggaccacggatccatcaccttccagggacagccgaactaagcccagagctacaggcggccatggcaggggtgtggccctgaaccactccccctcccaccatgcccgcacggtgc

SEQ ID NO: 556862 - DNA, 192 bp, Homo sapiens
cagagatcatgatgccactgcacttcagcctgggcaacagagcgagactccgtctcaaaaaaaaaaaagggctaaagttagccatccatatatgaactccttttccctatactatcgctcatagaaaaattttactactaactttggccaatagactatgcataacaaacatgaatgaggcacccgcgtaga

SEQ ID NO: 556863 - DNA, 127 bp, Homo sapiens
ggaaagcgtgttgaccatctcgagcttaacttgtgacctccccgagagactaagaccggcatagctgtttggtgttaggtggctttggttggccagcagattgctttttacttgcaggaccccccct

SEQ ID NO: 556864 - DNA, 391 bp, Homo sapiens
ggactatgagaatcgaacccatccctgagaatccaaaattctcctctacctgcacgacaaacacataaaaaaaaaaaaaaaaaaaaaaacaaaaaaaaaaaaaaaaaaaaaaaaaaaaatcgtgtttgtgtggggcgcgcgctggggccccgtgaaaaaggttttttaaaacaccttgtgtgtgtgggggcgggggggcccagtgggagatggtggaaacagggtggttcaaagagcgtgtgttctctagagagaagaactggtgggtagtagaacgagggtggtggggttttcttccagacatataaaaaaaaaggcgcggggggggaagcagaggaggtgttttggaacaaaattccggagaggggagttcggagggtcctaaggggga

SEQ ID NO: 556865 - DNA, 158 bp, Homo sapiens
tcactgcagcctctgctcccggttcaaacgattctcatgcttcagctactcaggaggctgaggcaggagaattgcttgaacccgggaggcagaggtagcagtgagccaagatcacgccactgcacttcagcctgggcgacagagcgagactctgtctc

SEQ ID NO: 556866 - DNA, 253 bp, Homo sapiens
ttgctgctcgtggttctacgtatgcatgactgcgcatcccttggctgtgggacgggtcactggggaaagagactagccctctcctcacttggtgatctggtgtgaaggagtgaggggtatccctcagcctaggtggctttagtttgtcgtgagtcccatatctgtctgcaaacctcactccaggtacccgtctacgatcccaaaagacttaagaatagccagggctataggattttcaagaagcaggaactgg

SEQ ID NO: 556867 - DNA, 384 bp, Homo sapiens
tgaggtgtcgtgaagatgcgggatagaaaagggtccgagttagcagtggacgtgtagggagaggaccgggtgcgaggacggacggagcgaggtgggaagggcggctcgatctggatgtatgggggtccgatggctggctatggaagtttgacccgaggtggagaagggatggtcatggggatcgtgcgggggtctggcgtctggagtgcgcgagggctgtaatcctctctcgggtggggatgagaggggttgcgggcgtggtatggggcgcccccctccacacatggactacaaatacgaaatacacaagccgattcacgtgaagcggatagtgtattactgtgcgagagtacattatgtcggagcagatcgccaatttgacta

SEQ ID NO: 556868 - DNA, 143 bp, Homo sapiens
gtagtacggcaaacagctggaggatggcgcgctctctcagactacaacatccagattgagtcaccctgcacctggtgttgcgcctgcgagggtggcattattgagccttctctccgtcagcttgcccagaaatacaaatgcga

SEQ ID NO: 556869 - DNA, 1350 bp, Homo sapiens
gggtcgtggggcttctggggcagctagtggctgcccgccgagctgcctgcgccggaccggtggcgggtccagtcccggagcgggccgtcgcggagagagaaataacatctgctttgctgcctgagctcagaggagagcccagagcccatcccgcagccagagggctggagcctgactcagaggtgctttgaagatgccggaggccccagactctgctgtggccagctgtgtatgctgggcctggtgctgctgcgtggtgctgctgctgcttcatgaggcactgggagcttggaggcctgtatgccatatacgggtggaaacggaggttcgatcctgcacggcgcaagttcgcacaacgcgtgcatcattggtgttgacaccgaagggaggcagccgcgatacctgaaagccatggtgcgtggacgcaatgcaggaagcgccggggaaagggcagccggaagcgggtaggcagtgcgaggcccaggtggccgaacccctaccttggctggccgcgcagacaagggcgagttgggcgccaagacaaagtttggcgacgacaacatgaacaggtgctaagaatcgagagggaccgcccaggggagtccaggggagccgagcagaggcaccatccggtggcgggagatggcggacgtgtagggaacactacagtttgaggggacgaagagcaaaggattagaggcagaaatcagacgcaggccaggcgtgtgatgaaaaccagggggagcggaagtggccaaaatcaagcgagatcggggggaatacaagagcagccgaacactgtgggccgcggacgagtctaagcgccaaggccggggaattaggtgcgacaatcatcgagcttaagcagagttgagaagacgcacagagggggcacaacgactatggggagagcaaggagagacggaccacaccgggagcaacaaatgccacgcaggtcgggaaacggaaggacagcaagaccagggtgagaacaccacatagagaaaacgtgggacgtacccgaaagcaggtgggagagaggcaccgcaagcagggacggggcaaaacgagaactaatgtgggaggaaaaggtgggccaggctgactgaacagagggcagcgaaaagacactggacgcaaagacagcgcgagcgcacacaggggatgaagagcaaagaagcaaaaagcaagaggcgaccgaggagagataaactgatggagacggacgcaagaacgaaagagaatccagtgataaaaaaggaagagtagaggaacggaacataaagagaagcagcacaagaaaaatgaaaggaagagcaagcgagggaaagcgaagcgtgcagacacacg

SEQ ID NO: 556870 - DNA, 434 bp, Homo sapiens
tgccagtcccgacagtagccagagctaagatggggacagtaggaggagcgtgagaaattctacattgtccaaatcgtgctctcttggcttcctgcagtggctctctcatgcctgtaatcccgatactttgggaggctgaagctggaggatcacctgaggtcaggagttcaagaccagcctgggcaacatggcaagacccctcacaccccccatgcacatctctacagataatacaaaaattaggtgggcattgtggtgcacacttgtagtcccagctattcgggaggctgaggtgggaggatcaattagcccaggaggtcaaagctgcagtgggttatgactgcatgacagcactccagcctgggtgacagagtgagacactgtctgaggctctcccatcagacctgcgagccacagcttcggctgccattggg

SEQ ID NO: 556871 - DNA, 242 bp, Homo sapiens
gtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgccctagcaattccactcctaggtacgtatcaaaaaa

SEQ ID NO: 556872 - DNA, 698 bp, Homo sapiens
tggctcacgcctgtaatcccagcactttgggaggccgaggtgggtggatcaactgaggtcaggagtttgagaccagcctgaccagcgtggtgaagcccccgtctctactaaaaatacaaacattagccaggcatggtggcgggcgcctgtggtcccagctgctcgggaggctgaggcaggagagtcgcttaaaccggggaggcggaggttgcagtgagccgagatcgcgccattgcgctccagcctgggggacaatagcgaggctttgtctcaaaaaaaaaaaaaaaaaaggggaaaatcgggccaaactgggtggtgctctcgcctggtaagtgccagcgcttggggaggctgaggtgggcagatcacacagggccgggatttaaagaccatccggggcaacctgggcaaaaccccatctctactagaaaaaaaaaaaaaaaaaacaaaaacaatgatgtgggggtcgcgcgcgccgcgcgcgtcaaaaaagaaagcttaacccacaccgatgggggaggggggcgcgccccggagagtgtacaaccgggagacgacgatggctctccaggagaacagtgccggcaagacacgcgggggtggctccccccaaaaaaagacgccggggaacaacgcgtgggcacacacccggggtccggagcggacagaggatacgaggggcccgggaggatataaag

SEQ ID NO: 556873 - DNA, 355 bp, Homo sapiens
gtgcactgcttcggactgtgttcggacgtttcttccttcggtgggttcgtggtctcgccggctcaggagtgaagctgcagacgttcgtggtgagtgttacacgctcttaaggcgacgcgtctggagattgttcctttcctccctggtgggctcgctggtcctgtatggcttcaagacgcgaagccactatcactgtggttgagagcactcacagacacacgtgggcttcttgacgactgtcttcctgacaaggcatgacgccttgaccacctggactgccgacccacgccctgtgcggcatccgacacgcacgttgccggggtacccgacgctcgaacttcgtacctcatggtca

SEQ ID NO: 556874 - DNA, 159 bp, Homo sapiens
cagcaagaatggcatatcaggttctctgggtaaccctgcctatgctgacccttgatgcttaggtgtactcctctttctgcactctgtactaaaggacgataacactattactgttctgagctgcaaatctgcacttgcactgatatgccattcttgctg

SEQ ID NO: 556875 - DNA, 655 bp, Homo sapiens
gtctgaacgaaagggtctccgactgactgagctcgaagccagtccgtttacctgtcgtcagactgaggcaaaagcgctcgcggcaccacgacgaggcgcgcgttcaagtgggaagctgtgagagcgaaaaggcatccggtgttcccgtaagcgtgtcagagccgtggagcgggagcgctaaaaacagcgcgctctctggggactgtagacgtggctggtgctctttcctccctgaaaggaagctagactgccgtctagcgtctaccctcggcactcgcttggtcgtcgattacatggcacgagtccacgtgtgacctggcacttcatagctgattgccttacttataaacgcgtgtgtttccagtagcaacaagtccttcatgacatttgcctatacttgacgcctgaggctgtcagggcgtactcaggccttatgaggagggtattgttacacaaaacagttgtctaggtgaagacgagcaagaaagaggggaaaggatcggacagaatgattgctggaacgactatagaaaaccatgagatctattcgatcttttgctaatgatgatcgccatgttatggtgaaacattcaacaatctatccatctccggaggaacttgaagctgttcagaactatggtatctactgttgaat

SEQ ID NO: 556876 - DNA, 442 bp, Homo sapiens
  misc_feature (33)..(33): n is a, c, g, or t
  misc_feature (40)..(40): n is a, c, g, or t
  misc_feature (47)..(47): n is a, c, g, or t
  misc_feature (76)..(76): n is a, c, g, or t
  misc_feature (98)..(98): n is a, c, g, or t
  misc_feature (163)..(163): n is a, c, g, or t
  misc_feature (165)..(166): n is a, c, g, or t
  misc_feature (172)..(172): n is a, c, g, or t
  misc_feature (204)..(204): n is a, c, g, or t
  misc_feature (267)..(267): n is a, c, g, or t
  misc_feature (396)..(396): n is a, c, g, or t
  misc_feature (398)..(398): n is a, c, g, or t
atacaacatatgaaagccttatcacaatggttngcacttnacaatangcatttagggttccatatatgtctgccantgacttgatgtctaatgctttnacatcatatacctgaggactacattctacaaccctgctataattgcttattaatgtcagcaggtntnngttatntagaattttctacaaagacaatcatgttattngagaacaaagacagttgtatttcctccttccaaatttatgtgcattttatttccttttttttnggtatcactgcattagatagcacttccagtacaatgctgaaaagcagtggtgtaccttgccatgttcctgatcttagtaggaaagcatttagttggaaacatcaaggatgatgctagatgtagggttantngtagtagttctttatcaaattgagtaagttctcctgtattcctt

SEQ ID NO: 556877 - DNA, 369 bp, Homo sapiens
atgatgtatgcggtagccattgtacgggaaacggggccgccctgactcaggagctacagaggcatgcccggacctggtggaggacttcaagaacaacatatgaggatgaaatcaacaagcgcacagaagcagagaatgaatatgtgactctgaagaaggacgtgcatgcttgcctacatgaacaaggttgaactgcaaggcccagggcagacaactactccacgagacgagatcaacttcctgagagccttgtataggtgaagagctgtccctaggatgcagaccccacatctccagacacaatctgtggtgcttgtccatggacaacaaccggaaactggacctggacagcatcatcgctagaggggt

SEQ ID NO: 556878 - DNA, 261 bp, Homo sapiens
tcgctatgattataccaagtagagaatgtcataaaacaagcacaggagaaactgggtccagtggacttgctggttaattgtgcaggaatggcacgtgtcaggaatatttgacagatcttgcaagttagtacctttgaatggttgatgatgcatcaattacctgggcagcgtgtaccccagccgggccggtgatcaccacctagtgaatgagcgccgggtgggctggatcgtgtttgtgtcctccctgaggcttgactatga

SEQ ID NO: 556879 - DNA, 167 bp, Homo sapiens
gtggcctgggattttatttaacccaatctgttgccaaagagttggctttgtttatttggttttggcggggagaggcgtggtattttatgctttctggggaccatgtaaccctaaacccatcatgttttttaaatgcccccaacataaataaaacataagcatattga

SEQ ID NO: 556880 - DNA, 307 bp, Homo sapiens
acacaactgccaccttactcttgaagtaaataaataatctttgactggcaggactatgctgaatctccttaggcactctaatcagatgtcctaggtcctcccaattcttagaccttttccatttagtttttcaattcatacaaaacatatccaggccatcaccaatcattctacacgacaaatgtttcttctaacaaccccacaatatcaccccttaccacaagatcttccattcagcttaatctctcccactctaggttcccacgccgcccctgatcccgcttgaagcagacctgagcaagccagg

SEQ ID NO: 556881 - DNA, 376 bp, Homo sapiens
cctctttcggcctcagtcagctagcggctgctaggtgcgggcaccatgctactgatccttctgctgtctctggactccatgtaataaccatgtacaagttatcaccgccattttacagatgagtgtagattaggaggtgtcacctagggtcacgttactgctaagtgagggagcccaagtcatgaagtcatgcgtcagcatccaaccctgcgcttattgtttgctaagaactagacagatgctgtggttacaaagcgaataccacaaaagctcagagtctagtggaagagaggcgacactaagaaaatacagtaattaccatttgttacaatattaaaagtgtgtccaaggtccagagatagcatgtaacactaac

SEQ ID NO: 556882 - DNA, 307 bp, Homo sapiens
taacgtttgattaatcccagtcccgtgaattcctcctggtttcccctttatggactgtccctagtgaaagaacaagccaaccttgatggtattgcccaaattataggttttatgcacatagcatttttgcctgttttggaaagtgcctttaattatcttggtgggggacaaaagcccttcccctatggtataaaagccttgggtttggggagtaacattgtaaagatttacctattttgcagctgcccaagaccatggttttatttgtaagctcccccaataaaaccccccagactgataaactgga

SEQ ID NO: 556883 - DNA, 575 bp, Homo sapiens
catttgccaaagtgaaggaactccagttatgatcgggggaggagttttggcctcacagcaagtactaggagttgcatggaactgagattacagggacagataaacgtttctgattctagatccatacttataggccggtgctgagagacctgcaagttagtttcggagaaagggcctggtgccggatggaagggcccagatttttggaacaaggatgctatagtataacttatgtcgttcctcagcgaccgaaatatgcattgaagacatatctgtggtaggtcgaaagactgccagtagagtggtgcttatcaaattcgtggaataaagaatcagtgtaatgtgtttccacattgaaatcctggttctagtttggagcatttgaaagttcagtgacctttttcaaaggttgtaagatactggaacggagaactgtacttttcttagacgttcctttcaataggctttaaagagacgaacagcatacacaaccagcagtatgataggcatgtacaatcccatgtgttcttgaaatggatcttcacttggaagaaaagttggcgtccttctcgcga

SEQ ID NO: 556884 - DNA, 967 bp, Homo sapiens
tacaggggaaaaaaataaatttttttccaattaataccttttaaaaaaaatcctccccgcggcccttaaaaactttcccataaccccaattccccaccccgagtgtgcaagttctgtggggaacaggttagggtgtttgaaccgtgctggcttgagaggctgtgttcccccaaaccccatctcctgtgacacttagggcccaactccgctccgtgggaaaagaagctatccttcgtgagagaggttgtctcccaccagagtttcagacacccaagtctcctgtgagacacttctcaaaagatatttgtgaggcgccccctgtttgtgtgcgccccgaagccccaccgagagacaccgcgcgaggaaccccagaggggcgccttaatctcgctctcttattagtaggctcccctttttttgagaaactcgccaagagagcggcctataaaaagagcgacacacagttgtgggcccgagtcgctcccatgagggaccaccccccagagcgccattctcaagaaacacccaatagctcccttcaaaatctctgtgggtgtgtgcgtagcagtgggcacacagacgtgtgcaccttgtgggccttataacagagacaccacacaaagggggcagcgacaagacggaataggagcggaacaaacgagcgccacaccaaagtacatggggacacacgaagagcacataccacacgggccccccccaccagtggtagaagccacaaaggaactccgacagaaaaaaaaagcggacacaaccaaagagaagaaagaggcaacaacagcaagggaggagacaacaacaagtagtcccaaagaagtagatatgagtgggagacagaggagatctaatacagcaggggaacctcacataagaggaggataattggggagacaacaaaccgaggatgaggcacacgaggagaagacaacggaggaagcaaaagcacaag

SEQ ID NO: 556885 - DNA, 169 bp, Homo sapiens
gagtgtaaggtcaagagactttgattctggcagattccttgatgactctgaacccaccaagaagccaaactcagatatctacccaaagccaaaaccaccttactacccacagcccgagaatcccgacagcggtggaaatatctacccaaggccaaagccacgccctcaa

SEQ ID NO: 556886 - DNA, 346 bp, Homo sapiens
cactagccggagtagaagtcttttacgcgcatgtctgcttaaggagaagaagtcctcttctacaggagtagggcggccatctcaggctgccggggactaccagggagatgaggtcaaggagcagacattctctggaggcacctctcaagatacagaagcatctgagagctcgaagccatggccagatgcgacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttcc

SEQ ID NO: 556887 - DNA, 368 bp, Homo sapiens
  misc_feature (95)..(95): n is a, c, g, or t
  misc_feature (170)..(170): n is a, c, g, or t
  misc_feature (242)..(242): n is a, c, g, or t
  misc_feature (259)..(259): n is a, c, g, or t
  misc_feature (350)..(350): n is a, c, g, or t
ggattttgtttgagcaggtgagtgggactttttttttttcttgagatggagtctcgctctgttgcccaggagaagcaaaagacaatacaaaaagntcccctcaggggatgcagatcatggagttaatggacatagactttaaaataattatgctcagtatgttcaagganataaaagatgaaattgagaacactggcacgaaactaagaaaaaaaactataaggcacgtggaaatgctagantcaaaaaaacataaaanttggaactaagaacttggtggatgggtttaacagcagattgagaaacacaagggaagaaattaataacctgggaaaatagatgaaaatatnccagactgcagtacaaag

SEQ ID NO: 556888 - DNA, 320 bp, Homo sapiens
cggtcgacctagcaggatccccgtccactgcgaatattatttatttagaatgcacactaacagacatgacgataaactgtcatcacaaacctgtaccaagaagcacgtaatctttaaaagtgtgttgtttcttcacaatgctaatttacagtatagcattattattatttggtacttgagtcaaagacgacatttagattcttcatctttgaagcatttagtaccatcattgtctagtcaggcagaggaaagaaattcaaaaagcacttactgtttcttctgtcagttcctttgcagtaagatccatattcgcacgtaga

SEQ ID NO: 556889 - DNA, 444 bp, Homo sapiens
aacaggaagaaagggaagaggagtggggaagggtatggaaaacacacagaagagaagacaatacgttaaaatcccaaatgcaatacaatctttatccttgagtggaaaaaggagtgagcaggggccgcacgctttgctcacatgtcagactccacatgcacataccctgggacatgcaacaaacatggacaccccagccttcctgcgtgctgggtcgtaatgcctggctttcttatgcttacagtctttgtgtttgcagatactgctctgtggcctaatcacgagaacttgccttttaccgttgttctgtgcgataggtatggtttgtgataaatctgttaaagattaacgtcccttgggaagcagcacttaagacgccaggtcaagtacgtttctttcttttaaattacttgtaatagctatacattccctgtggaagagtac

SEQ ID NO: 556890 - DNA, 244 bp, Homo sapiens
tagtttaataatgggggaaaaaagattaggttgctcctgaaactggctgtagagcatgtaaaatgattttactgggttttgttcccctgtaatcaatgaaaaagatggtcgttgtagacaaagttgcagaattaaaaaaagaaatctgcttttaatttattctttttggattaagaatttggataggttctttcccttttgccaaacagggttggccccccttattaaagccttttcaaaatga

SEQ ID NO: 556891 - DNA, 1121 bp, Homo sapiens
gggccggacgcggtggctcacgcctgtaatcccagcactttgggaggcctaggctggtggatcacgaggtcaggagatcgagaacatcctggctaacagggtgaaacccgtgtctctactaaaaatacaaaaaaatgggccgggtgtggtggtgggcacctgtggtcccagctacttgggaggctgaggcaggagaattggcgtggacccaggaggcggagcttacagttgagccaagatctcaccatgtgcactccagcctaaggcgaacagagttgagaactccaatctcgaaacatcacccacacaacaacacacatacaaaaaaaactgtttgggggctcacactagtggccctccgcaaaagcgtcttcacagacccacaacgggtagaggagacgaccggcgggccccacaacaggacaaggtgacacatgtggcgccaaacacgcgaggacacacaagagaacacccgggcacatgcgacagagggaggggacgaccaccgcagaaatataaaaaagacgccagaggagagaacaacgcgacggggctctgcgaacaacatctcccagaggtgagagcacggagagggagcaacgggggggcacacaccacaccgggggaaccacacaaggcgacccgggaatacacaataagccccagccgccggggtgagaacacacatccacaacaaacgacaacatccaacaacacaacgccccacacacacacacaacacagcacacaacacacacccgtcaccgagcacaaacgaaacaacacaaacaccgacacacgcacgaaagatccagactcaccccacacgtacaacaagaacccaccacaaggacaaaccggacgccacgacaccgcgccccagcgcacccagcaagttacgatctatcgcgtctgatcctacgcagactagcccggacgtccctacggcaggagccgtcatatgtaccccggcgcatcgctcacacgcttcactaccgcgcaccagagcaagcccacaaccctagcgccaagacgctggtacctcccagagaatgagtcagcactaccagctctgatgtgtggatcggaatagatggtcttctacaacgtgggagccttct

SEQ ID NO: 556892 - DNA, 264 bp, Homo sapiens
ccgacgttgctcagcaccgtggggttgccctggatgcccgagccctgcgtcacgccgagcaggcggtccttgaagtagacgacataggcggtgacggcggcttcgtaaagcttggccgtggtgcgccagccggcttcgaagttggtcgaggtctcggggcgcagcgaacccttgatggagtcaaagcccgactgggtggtggcgaagggcgtggagcccgtggcggcgccctggtaggcacgcatgttcttcgacacgctggtg

SEQ ID NO: 556893 - DNA, 529 bp, Homo sapiens
gcacgagcggcggtgctgtcagcgtctcgggtctctcggccgctggccgggccctccccgggttgaggcggcccatgtcgagtggcgcccacggcgaggagggttcagctcggatgtggaaggccctcacctacttcgtggcgctgcccggggtgggagtgagcatgctcaacgtgttcctcaagtcgcggcacgaagagcacgagagacccccgttcgttgcctaccctcacctgcgcatcaggaccaagcccttcccctggggagacggtaaccataccctcttccacaaccctcatgtgaacccacttccgaccggctatgaagatgagtaaagagaacctggcctcccccaggcaacaaagggaccacagcactggttttggacccttactctgtgtggaccacgaaaaccctttggatgctaagctcgtgtctcctttcctcagatggcgaccattactctgatcttccatcccttctgcttgtaagaggagatgccttaaataaataacttaaactcaaaaaa

SEQ ID NO: 556894 - DNA, 207 bp, Homo sapiens
  misc_feature (33)..(33): n is a, c, g, or t
  misc_feature (60)..(60): n is a, c, g, or t
  misc_feature (132)..(132): n is a, c, g, or t
  misc_feature (185)..(185): n is a, c, g, or t
aattcgcggccgcgtcgacacggctgcgagaanacgacagaagggaatagtaaggcagantatatttaggtaatttactttttgtgcacatgtaatttgtcttataataagattatcatagaaattagtagntaagatgtgttttttgcagtttgtttggataatggacttttcataaggagganaatcagtgtgtcttgtatcacg

SEQ ID NO: 556895 - DNA, 671 bp, Homo sapiens
cgatggcgaatcgatggaaggtcactggctgcaccgttgatgcctcacaccgcaggcctgcatcagtgaattcgtaacgttgaacccaatagaccggattagcccgacacgcgccagcgacttcatccgatcagcagggacgtcgtagccctgatcatcctcggtggtttcgtggaaccgcaatacgtccctgcgctgttgctcggtcagcaccagcggtacttcaatcatttgttcagtcataccgcgctcccttcagtgtcagtctctgcaactcgctcaaaatcgtggccgtactggtggcagttgcaatcaaccacgttcgtttcgccaaccgattcacattggcatagctgcgcaacaagcttttcgtacaaagtggcttccataccttcggcgacttcggcacgtgacagactgacgctgcgccgctcggtagtggatgggtgtttgtatgtgaaggtcagcgcctcccctcgtaggcgatcaagctttgcaaaacgtgcggcttggagttcggcgctacctgggctcagagacagcccccctaccgccttgctgtaaatgaacttgatctgatcccacgaaatcgtgtgactctggctgtactggccttcaccgccgcaaacctcgcagtgttcgttctggtgcggattcggggggtcctctag

SEQ ID NO: 556896 - DNA, 935 bp, Homo sapiens
  misc_feature (692)..(692): n is a, c, g, or t
gcttcccctagcccgccgtggcactctccccaagcctctgtttggcacagacgccagctcgtagcgtcgagatggttcgccatgcagtagatcgggaaccggtacctccgtgatgtgattggggctctgaacctctacccctccatgttctcaggccacccgaggctgcgtggtctatgcgctgccacgagattgggcgcagactgtcgtgcaaggacaacgtgtgcctatgcggagtcatgccatgtgtcatgccaatgagtacgattccactcgacaaatgtcctttggttggggaccaccttaggccaaagggtccacgcgaaagagtcaattaacaagaccgcacatgaacgtaggcctgacatgcctgaccgcctggcaacgcttaatagggtacgacttgattccccgattaatgcagcccatggggcgtcgttcgtcgcatatccccgcaaagatttcgtggtgtcccccggcaagtacgggataccctccaggggactcgtttccatataacgccctgtgaacgacaactgcctgcgcaaggcgtggctggccaccacgtcgggctttgctgcacaatgacttccatcttcatcaaacagggatttctcggtggatacctacgtgacatattatcacaggacaaaacctcacatgaaacgtaatcccattgtgtagttcgcacnccacttagcggtatgcgctgctccccgggggttaggcgccgctcgcaagcgatatctctaccttttggacgagcccttgcgcttctgtgggagcatccttcaacccgttagccttgtggacccacaggttcctcggcccaatttgatcgggccccttttatggtgtgagcggatcccccttgggacccttgagacccttgccacccatcttcgcaagaacaaaagttttttgccctatagtac

SEQ ID NO: 556897 - DNA, 126 bp, Homo sapiens
ctgggtatacagctctctaacttgcttttagaattaagaggtccacgaagttacttggtaccagaggataatcgtattcattgttcgtcactctgacccctgttgaaaatgttctccccaaaactg

SEQ ID NO: 556898 - DNA, 362 bp, Homo sapiens
ggcacgaggagagagagagagagagagagagagagagagagagagagagagagagagagagagtgagagattcagatcttgtttctcttgacattacagagataatcttctcttgcctctcctatacaaccattttcttgatggaactcttcctacatcttttaccaaatttctgtctttactagtataccctcattgtgtattcattcccccaccgatgaactcacaatgtcacccaccgtcttattctgttttttattttctaccaagacagctattgctcccatacccctcgtgacacgagtgtttcgcctcttattcttcagagacatctagttttactttacctgagttctgttgcg

SEQ ID NO: 556899 - DNA, 765 bp, Homo sapiens
agcgggattcgttcacgtcgcgagtgacggagctgctgtggccgtctccatgacgcaaccatgaagttgaaggacacaaaatcaaggacaaagcatgtcaacgctgtgtgcaaatttcagacacaagggaatcaaagttgtgggaaaatggaaggaagtgaagattgacccaaatatgttggcagatggacagatggatgacttggtgtgcttagaggaattgacagattaccagtaaggtctcccctgacaaggaatcccttccagatctcttctcaagaggaagcacgccaagagaaaggcacaagctgtttcagaagaagaggaggaggaggacggaaagtctagctcaccaaacgaaaaagatcaagttgaagaaaagtaaacacatgtagcaactgaaggaaccagtacccagaaagaactttgaagtgacaagatcctgagctggaagcccagtgagatgacatggttagcgatgatccggaggctggggacgatgacatcagacaaacgcttggtccaaactgctccagaaaaaggaagaaaaataaaagggaacacaaggggttggaggccttctcagagcacttgctgaccaagggtgcccaaaaaaaagcgaacgcacaattggattcctgaaggttcatgatcatgaaaagcagatgtgtcagccttgggcagggacctgtaatgtacccaggcccggttcctcccgaacaactcaagctttctaggattcatctgctaccacaaccaatccag

SEQ ID NO: 556900 - DNA, 1242 bp, Homo sapiens
ggacgaatatgttcctcgtgccatccatggttggatctagaacctgggtaccatggactctgtcacgctcagcgtccgttttcggccgacgatcgtttagaatccatgatcaaaccgtttggtacttttggttcaggtctggttagcagtgtaacaacatgggcctaaaggccgaatacacgagaaggcgtccgagtcgtgggttgagtctctgtccatgtggatgctggatacggaacggagcggcagagcaggctgtgactgtgcctgccagggttttccaggcgtggacccaggtcacatggagcgagtggcacaggggctcgtggaagtgagggcagcatcatccattgattcaggcgagagaactcgcgaggacatgacatgagcccttgaagtcgtcatattccagtggaaatacccttgtgcgagtagatgggctgcccctattccaacacgcgaagatagatggttcgtggaacaagccgataggttgcggagggccccttagcgagagttggccgacacacatcgtcgcgttgcgctatccaagttaggggatcaggaaggaacttacgtagcagtggaggaaccctttaatttggccacttttggagcacaattccaatgagcacccatccattagttgaacttaaattcttggccttatcgccagtcaagcgtccttagaaaaagaccgttgaacgcaatcaaacacaataagcccttaacagcgagggaactcccttggaaaacacaaaaccatttagtggtacggtcccaaagagaccgaaggcccccaaatcgatcaacaagttgaggatatgttgatatccacccaaacaaccactaggaggcggatcaactccgggatggatatatacacccacttagttagcgacacacgaaggtgccctatcgagaatgctctagtagcttggcacctactagttaccacaagtcaacaataggggttttggggagcaccaagatttcggacaggacaactttgggggattttcccccccagcgtttttttcgccgcaaaggtcgtgcagttcagattctccaacacgttgtagtacgtagtattttaaagatatggaccccagatgggaggacatcttttatgggaccacgccgttccattacaaactgccacagggacccgaggatagggcagaataagaggcgtcataaaaggagacaagtcgttaatttctggagaaggactttccatct

SEQ ID NO: 556901 - DNA, 299 bp, Homo sapiens
agctaggggtgaaagagagtataggcgttcggtacagagcttggcttgtccgcagggggggggggatcatatcactcttaatctaatatctcagttttgttctgattaagttggttgggctggcctcagaccttctattcctagacattaacatcttcagccttcccttcccgtttcagtctccttcctaaaaagagtaggccaggtcaggctaggatttgccttgacttcgagccagcacccagccatggaccaagtccctctatatggcatacagtatgacttgtcctcatgaggtg

SEQ ID NO: 556902 - DNA, 114 bp, Homo sapiens
accttttttccatatctttgagattactatgaggttgagagtttggccagagggttgaaagccctgttcagaatacttggtaagcacatataatttcctttgttcctgttagta

SEQ ID NO: 556903 - DNA, 898 bp, Homo sapiens
tgcactctctgaaagcactccccagaatagcatatttcttggggcactgtgttcacacactgggtaagacaaccctcccgggaaagactccgcggcaccactaaccggctccggattccccaacgcccgtattaaacttgtcgaacagacatatccccggtgcgcggcgctgtcccgcccccgcccacaggtttttttcccgcgggttcccatctgctcgatcaaacgggtcggtccccccggcccgcccacaggggaacatcaaaacgacgggcaacaatcaacctatcaggccccccacgtgggggtccaagcccccgcaattcccaccacctttggggagccccgaccccggaacatctactcggaccacaggagcccgagggtccacacggcgcccggggaacggggcgcccgtgaaccaccagcacctgggggcacaaaagcaccagaaacccacaagctagccccgccccccccccgcccgacaagaacatcctagagcccaaggatgcggggcggtacccagccgcccgccacagaacgtcgccgcagacttcttgggcagcgctagcaagtggagaggaaactccctgcacgcccgaaggtgtcaagagcccccgcgggcgcaaaggtactaaacacgcctcttcgccacggaggaccgccaaaatagcacggggacagagggcaaaaaaccgagggatacccacaagacactctagggcggcgtagaggtgaccaggaggggcacgcccctggacaccaaagaggcaccataagcgagctagggacactgtatcgttatcccgcccgccgcgagggctaaagatacactcccatcccgccagaagggcgacaaagagaaggggcaaaaaaaaaaccccacccacatgta

SEQ ID NO: 556904 - DNA, 380 bp, Homo sapiens
  misc_feature (38)..(38): n is a, c, g, or t
  misc_feature (131)..(131): n is a, c, g, or t
tgcaaggagggggccattttttgcattttttaaccccnaatccagtggaagaggggttcaaaatttgccccagaatttattcacttttttcaggattgggttaaagccttttaacaaagggaagggcagancttcccccaaaacttttttaaggaagtggagcagtttccccaggtggccaaggcctaccagggccgctattaggacttgggggcctaaaatttttccaggaaggggctggcccaacaaaggcaaaggatttttcaaaaaaaaaaaatttcaaaaaaggcccccgctgccccctccttaggaaaatttgggggccccttttttttgggtttgtataaatgtttgttaaaaataaaaccctgcccccttta

SEQ ID NO: 556905 - DNA, 565 bp, Homo sapiens
  misc_feature (302)..(302): n is a, c, g, or t
  misc_feature (329)..(329): n is a, c, g, or t
  misc_feature (336)..(336): n is a, c, g, or t
  misc_feature (344)..(344): n is a, c, g, or t
tcagagtgaatgtggatgtcttatgacaaggcgatgcacaacgacttgtaactgtcctgtcgacagtgaagcggctccagcagccaacgacagtgcaaatgcgtcaacagatctctgtgacccgctcaccacgatcgatgaacctcagaatctacaaccagcaaaaaactatgtgaatcggcacgtgtatgggggaaaggtcgcagtttgtttctctgctgatcaaacaaggaacgaagagcataccattcgaattgaagcggccgtctcctcaggaggtcgatcctacaactgggacgatnagatcgcgattcaggtgtcgaccaggnagttgcnatcggtcntggctacgctgctccaaatccagaacaagttcgaagggaaagggcacggtgcacagaacgaaaaatggtttgttttggaaaaccagcctgacaaagttttcctttccgttgaatgcaaatgggggctgctctgctagatctctaccgatcacaaccaggcgactgctatcaggtgatcactcttgtgatggagcagatgctgaagaatacattcatctgta

SEQ ID NO: 556906 - DNA, 397 bp, Homo sapiens
  misc_feature (20)..(20): n is a, c, g, or t
  misc_feature (74)..(74): n is a, c, g, or t
  misc_feature (381)..(381): n is a, c, g, or t
ttaagtgggtcccccacccnacaaaaaagccccagcaagcctaaagatcccactggcttgaaaattcctccgcngccagcacggcaagtctgaaagtaaacatggtatgcttccagcttggtgaggggaggggcatatgccattactgaggcttgactaggcagttttcccctcacagtgtaaacaaagctgcccaggaagttcggattgggcagaacccactccagccctgcaaagccactgtagtgagactgcctttctagatttctcctatctggtcagagcatttctgaaagaaagcagcagccccagtcaggggtttatagataaaactcccatctccctaggagagagcacctgggggaaagggtggctgatggnacagcttcagcagact

SEQ ID NO: 556907 - DNA, 145 bp, Homo sapiens
atggagaggaatgatggccctgctagagattgctcctcactctacagtgactgatgcttatggggctactatgtctgattcaaattcatttaccagctaacgagtgggatcttaaaaatatgattcactgtggagaacactgtgt

SEQ ID NO: 556908 - DNA, 269 bp, Homo sapiens
atggtgtggaccaccgaggcactgttgcataggaagtcacagcagcggaatggctgtacggcactgaatgatcactacgtgtattagttaactgctgcagtttggcacggctgacggtggctgacggctgcgggtaatgcccagccccaaaatcactctgacccattcgctcgtataagccaatgtaggcgtagctcgtcccggggatttcagccagctgcatgggtggggtgaagttagcagccatgttgaattgagccaactgctgg

SEQ ID NO: 556909 - DNA, 164 bp, Homo sapiens
aaaacttgaagaaaggagagaagagaaaagaaaagaggaagaacagagagaaattaaagaaggaaaatttagaggggaaaaactttgaaaagaaattgttggatttattaaaggaaacaaggaggaggtatttaccaaaaaggattcttggggggaaggaacca

SEQ ID NO: 556910 - DNA, 350 bp, Homo sapiens
  misc_feature (4)..(4): n is a, c, g, or t
  misc_feature (7)..(7): n is a, c, g, or t
  misc_feature (62)..(62): n is a, c, g, or t
  misc_feature (126)..(126): n is a, c, g, or t
  misc_feature (139)..(139): n is a, c, g, or t
  misc_feature (224)..(224): n is a, c, g, or t
  misc_feature (283)..(283): n is a, c, g, or t
  misc_feature (301)..(301): n is a, c, g, or t
  misc_feature (321)..(321): n is a, c, g, or t
ccgngangtaggtccggcctttcgggtggtcaggaagatggcggcctctgggcggacgaggntcctggtacaatacttggtgttacgaaaggatctatcacaagctccgttctcctggccggcggngcaactggtagcnaggcttgtcacgcggccaccggccttgcacactcaccgcgaccacccgcacacagccgcttacctccaagagctggggcgcatgnaaaagtggttcctcgaggccccagatgagaccaccctaaaggagctggccgagaccctncaacagaaggaacatttnaccacattgttttggttttnagcaaaccagagattattcgccatttgtt

SEQ ID NO: 556911 - DNA, 225 bp, Homo sapiens
gtcgagcatggttgcggaagctgtagtgccaatctctcaggaggcagaggttgcagtgagctgaggtcgtgccacttcactccagcctggcagtagagcgagactctcgtctcacacacacacagcactttaggaggccaaggtagggggtcacctcaggctaggggtttgagaccagcctcgccagcatggtgaacccagtctctactaaagtgcaaaattggt

SEQ ID NO: 556912 - DNA, 342 bp, Homo sapiens
ttattcctagaaccgggcgacctgggcctccttgaggttgacaatcgggtaggactcccgattgaagccccccttggtattattattacatcccaagacgttttgccctcatgagcggtcccccccttagggttaaaaacagatgcaattccggggggtttaaaccaaaccccttttcccgctacccgcccgggggtatactccggtcaatgctttgaaatttgtggggcaaaccccagtttcatgcccctggtcctagaattaattcccctaaaaatctttgaaatgggggcggggtttaccctatacccccccccttccccccctccagataaaggttcg

SEQ ID NO: 556913 - DNA, 133 bp, Homo sapiens
gtcatgagtggttgaagttaccaaatttttcttaatttatggagattggaaaaaatctgtgtagtatataatttaaatatgattttctttttaagcctgtggatgtgatgaatttaaccttgcgcacccgtat

SEQ ID NO: 556914 - DNA, 691 bp, Homo sapiens
tttttggttttatactttaatcaaactccccagcaaactggctgactggcatttccacacattaccaacaccggccaggacttcacagcagggtgacccgctaagcaagctggcctaggttcagcccacactggctgctaccttacttcttcaagaacatttagggtgtgaacagagaaggggaatgagggtgaccgtgggtttgtgaattgacccagggcccaagtgcacaagagagaatttggagtgtcaaattaggggtggcaaggagaaaacaaaaaagactcccaagcttatagagaacacagaaaaccgagtgaattcaacatttgcaaaaagcaatcatcaataagcctgaagaaggccacggactggtgcatccgctgggctcagagaaaggctggggcagccggaacagcagcttccggggtaaccaggcaacaatctcagcgccggggagtcagggctgcgcactccactctggccagaacacaaagggcatgggcacggtaagctctcagttacggtggccctcttttctctcctctatttctccaaagcttttgtgcgacacccagaggaacgtgagtggcaattccagggtgcgggcgggcaggaggggagagaggacaacgagagaataagatgagctaaagtgtttcgtgaaaagccaccggccatccgaaaagct

SEQ ID NO: 556915 - DNA, 753 bp, Homo sapiens
  misc_feature (26)..(26): n is a, c, g, or t
  misc_feature (81)..(81): n is a, c, g, or t
  misc_feature (104)..(104): n is a, c, g, or t
  misc_feature (106)..(106): n is a, c, g, or t
  misc_feature (143)..(145): n is a, c, g, or t
  misc_feature (147)..(148): n is a, c, g, or t
  misc_feature (188)..(188): n is a, c, g, or t
  misc_feature (193)..(193): n is a, c, g, or t
  misc_feature (199)..(199): n is a, c, g, or t
  misc_feature (203)..(203): n is a, c, g, or t
  misc_feature (262)..(262): n is a, c, g, or t
  misc_feature (384)..(384): n is a, c, g, or t
  misc_feature (415)..(415): n is a, c, g, or t
  misc_feature (417)..(417): n is a, c, g, or t
  misc_feature (472)..(472): n is a, c, g, or t
  misc_feature (494)..(494): n is a, c, g, or t
  misc_feature (499)..(499): n is a, c, g, or t
  misc_feature (506)..(506): n is a, c, g, or t
  misc_feature (514)..(515): n is a, c, g, or t
  misc_feature (563)..(563): n is a, c, g, or t
  misc_feature (606)..(606): n is a, c, g, or t
  misc_feature (628)..(628): n is a, c, g, or t
  misc_feature (630)..(630): n is a, c, g, or t
  misc_feature (682)..(682): n is a, c, g, or t
  misc_feature (705)..(705): n is a, c, g, or t
tgaacctgtcacgacctcctcaaggnaccagccattcctgtccccagtactgctagccacaagcctgggatccggccagantcagcccagccccacccctggcncnaccatgtcacgtgggccctgcatctgcatcgtccctnnnannacctggccttggaatctgctcctccaagacccagccaggntgggncagggnaggnttcccacacgagggcccgtcgacaggccctcagcgtccaggtggcgggatccagatganaccagggcgggctcccaccagcctggccagttcctgccgacactgtccctgtagtcgacgtagcaccgcctccaggcaggcctcctggctcctcagcgtcctgttcaccacagctgcccgcncgtcccggtcccctgctgccccttcctctcntntcaccagccggtgtggcccatggggctgggccgggccaccgtctcgctcccagcnctgctgtagagctcccagctcnttttnctcagcntcccgagnngcccgccgcgcggcactccactctggcccccgtccacagcctccggcnttggcctcccaggccgcccgcctgggctccgcagcctcccgcngctcctcctccaatgcctgcancncccgcactaccaggtccaactcgccacccccgcgctcggggacccagggcangaaggtgggctgtgaggctgcancaggcactccggggcacaggtgcccaagaccgtgtccatccaccgcca

SEQ ID NO: 556916 - DNA, 283 bp, Homo sapiens
  misc_feature (55)..(55): n is a, c, g, or t
tgttcctgtcggttgcatttctcgggagccgggcagaatgcccttggggtgaacnccgggcaaagcttagcaggagacaagaaaatgatggcaacctataaggagaagaaagcttttgtttaactgtttccatgctaaacatgatttataaccagctcagagctgaacataatttatatctaatttgagttcctctaaagatcttggttttccatgaatacagcatgtataataaaaattttaagaaataaatgttattctactttattaacaatatttgttt

SEQ ID NO: 556917 - DNA, 281 bp, Homo sapiens
ccccccgcacccgcacgctaagacacacacatcattctcatacccatacacacacacacacacacacacacactccagatacagccccactcttacagcacacgcacactccaaatacagccccactctcacagccccatgcagacacatccaccctctcatatatcatcatccagattcatcccatatagaccatggagatccactcaaagccccatgcctcaggatactcctcaatagccatcgctgtagtatatcccaagacaaccatcattcccccg

SEQ ID NO: 556918 - DNA, 827 bp, Homo sapiens
cagaagtaggcttcagaaggttgataataacaaacttatctgagctaaaggagcatgttctaacccatcgcaaggaagctaaaaaccttgaaaaaatattacacgaatggctaactagaattaccagtgtagagaagagcttaaatgacttgatggagctggaaagcacactacaagaacttcgcgaagcaaacacaagcttcaatagccgattcgatcaagcagaagaaaggatatcaatgattgaagatcaaattaatgaaataaagcgagaagacaagattagagaaaaaagagtgaaaagaaagaacaaaacctccaagaaatatgggactacgtgaaaagaccaaatctacatttgactggtgtacctgaaagtgacagggagaatggaaccaagttagaaaacactcttcaggatattatgcaggagaacttccccaacctagcaaggcaggcaacattcaaattcaggaaatacagagaacaccacagagatactcctcaagaagagcaaccgagacacataattatcagattcaccaaggtttgaaatgaaggacaaaaatgttaagggcagtgagagagaaggtgtgcgttacccacaaagggaaggcaatcagaataacagtggatctctctgaagaaacctaaacagaagagttagggcatattcaacatcttaaagaaagaatctcactagatttatttccagcaatagtctagtgagggaaataagtttaggaagcagtggagattgccccggtggtaagtttgggagcaatgtgaatgtccggaagcgtgtgcactgtaaggaggaagaaggg

SEQ ID NO: 556919 - DNA, 166 bp, Homo sapiens
tctgtacacttctttttgcaagacccgcgaggatgacagatctactttagaggaaaaccattccctgagctccacgctggcattgtaaacactgaagtcagcaaacttcacaggtacataaagccctgaactcattagcttccggaaaatagcttccagctcatcc

SEQ ID NO: 556920 - DNA, 278 bp, Homo sapiens
cgctgaagtttgagcaaatttcactttagtttctatgcatgttaaatggaagttattaggttggtgcaaatgtaattgcggtttttgcagttgaaagttaggaggccaggcgtggttgctcatgcttgtaatcccggcactttgggcggccgaggtggatagatcacttggcgtcgggagtttgaggccagcccggctaacatggtgaaacccatctctgctgggaatacaaaaattagctgggcgtgatggtcagtgcctgtaatcccagctactcg

SEQ ID NO: 556921 - DNA, 558 bp, Homo sapiens
  misc_feature (34)..(34): n is a, c, g, or t
  misc_feature (72)..(72): n is a, c, g, or t
  misc_feature (77)..(77): n is a, c, g, or t
  misc_feature (99)..(99): n is a, c, g, or t
  misc_feature (106)..(106): n is a, c, g, or t
  misc_feature (110)..(110): n is a, c, g, or t
  misc_feature (112)..(112): n is a, c, g, or t
  misc_feature (198)..(199): n is a, c, g, or t
  misc_feature (218)..(218): n is a, c, g, or t
  misc_feature (246)..(246): n is a, c, g, or t
  misc_feature (255)..(255): n is a, c, g, or t
  misc_feature (257)..(259): n is a, c, g, or t
  misc_feature (267)..(267): n is a, c, g, or t
  misc_feature (470)..(470): n is a, c, g, or t
  misc_feature (472)..(472): n is a, c, g, or t
  misc_feature (515)..(515): n is a, c, g, or t
acctcagtgaaaccggaaggaaagtccgagtcanaagtgtgggaagccaccgtggtgacccgcagatagtantggtnttcgccttgcgtgaggtttgcnaaaaaanaaancnagttaaactgctcgttcagctgttccagcaaggaggaggtgttgagaatcttccactggtaggactttagaagctcgttgtatttnntggtaaacctttaaggganttggagggattcgtggagctcccgccgnagtttagcntnnnaggggttnttggtggaaaaatcaacagaaaagatatcccggaatttgtaaaattggtctttcatccgaagaagcccgtggagttgtggcggatctcccggcacacagtccggtcatcgtcgccttctcgtatgaattctgttggcgggtgctggaaggccgggctgtggaagtggatgtccatggcctgctgagcctcgtgtatcatctcnangaagggctggaacatggcgtggaagttcaggggctcgtacggngagaagggcatcaagctgcggacgatgcgggacttgggaaaaa

SEQ ID NO: 556922 - DNA, 118 bp, Homo sapiens
tctactggtcgagtcatgttcttgtctgctcatctctctgatctgtccctaccctctgatcctgtactgtctctccacgggcctgtccttgtctgctctcattctgttttctctatat

SEQ ID NO: 556923 - DNA, 257 bp, Homo sapiens
cgagcttccgctcttgctaggtcttacccccaggcgggtggctccgtggcctcccttctaagcatcgctaatcgccctgtggtcctcatatgactgagacgccctctccaggggttcaaaaagatggtcagggatcttttacagatcatgttgcctcctcgggaccaggagcttactcctcaggcatgtgagccccagcaggccggccccacccctgtcaggctggactgggggctggggggaaagtcagtgcgtat

SEQ ID NO: 556924 - DNA, 761 bp, Homo sapiens
tctaaataacattgtggtgaatagaatattgaacgtatatttgaaaattagctaatgattttaattctaacaattcaaaagtgatagactatcaagaaattgaggtaggccgggcgctggctggctcacgcctgtaatcccagcactccggcgaggccgaggtgggcggatcacgaggccaggggattgagaccatcctggctaacatggctgaaaccccatctctactaaaaatacaaaacaattagcccgagctgctggtggccgggcacctgctagtcccagctactcaggagcgctgacggcagcgcgaactggcgtgaacctgggaggtggagcttgcagctgagccaacgatcactgtcatcgcccctccagcctgggccacacagcagcgaagactcacatctccaccacacaaccacacacacacacaaccacaacacggacccacccgcacacccaaccacacaccccagccaaccggccacaccactaccaacgccgtactcaccggacccggccacaccaccacaaccaccaccaccacttcccacaacacgccgacacaaggcacacagcggcccccacaccctagccacatctacccctaatcctgccacacaccaacctctacccgcgcgaccccacacaacacgagaccaccacaacccgcgcccaaaccaaccgcgcaaacccgcccacccgcgccacccaaccaccccggacacccaacccccaggaccacccgacacgccccc

SEQ ID NO: 556925 - DNA, 214 bp, Homo sapiens
ctcggtacctgcgtctttcaatctgcggttgtggtagaaatagcaagaaaactaggttagaagtggagtctgaaggtaggactgaattgctacaatctcatgataaaacttgaagagatgaggagttgatttttatggataagcaaagaaagtaggtttttgagatggcatctacgcctggtgaagatgctgtgaaccgcagttgaaagacgca

SEQ ID NO: 556926 - DNA, 105 bp, Homo sapiens
tgcacacttactgaactctcacacccaatggacatctatcaccctatagaagactaatgttagtataagtaacatgaaaacattctcctccgcatccagcctagt

SEQ ID NO: 556927 - DNA, 1429 bp, Homo sapiens
ggcaagaacaagcgccttacgaaaggcggccaaacacagggcagcccaagcaagcaaagtggttgcatcccattttcctcaagcacacagcattggtcatgcatgtgcaacagcaccgtgctcatgttcaatcatcaagcacacatcattggcacaagcacgctccgtacaccaggcaccccaaggcacacccaacacattgccatcctgcatggatctccaaggcgtccgtgctgtcttgcacagtgcagatcttgcctgcatctatgccagcacatgcatgcacagttgccatttcagcaacacattccacagctgcattcactgcacagcatgttccagaggtcaacacaactagccttgcactcacacttcccatggccataggcatctatcaccacgtgacaccacacacatgctgttcccattggtccaacaaacataggccagcacaatagcattgcacagctccactgttgcatgtcccaagcactcaccagcatggttcacttgctttccgtactgttcctgtgttagcgtattctactcaaacacaaccgccaaacaatccagcatcacggcacagcacctccttcatagctccagccaaccaacaagggtccgcccaagatcacgggcaagcaaagcatgcatagggacacatctatgaacccgcagcagggttgccagcacgaacatgcacttgcaacagcaagttggtcaaaatacaattggcattccccagcacaagcatttggccacaagcacatcaggacaaacgggctttgcccaacttctacttttattccttctcccactgcattggtctttccggtttacgcacactagtaacaaacattggctagcaaagacaggcccaaaggtcttggcacctcttgggcgacacacggcttcactggggacagccttccatgaggtgaacagggcaggtcacgatttctggggaacacaaagctcaacatggggcgcgcaccagacgcaccacgggaggcctaacacagcattgcaaacccgacgcttgggcctgggacgtcattgacaagcccaacgcaaggacccacaagacaatccgggcgatcacccggtagcaccgaacttcgcaacatcatgctgctgcacaccaaatacaaaaaggagtgccccttttgcggggccacacacacacacaacacaacaactggcgcggaggcagcccacacacaatacacacctaaagggagcaccaaccaattacaaacaccacaaccattgacaaccaagggcaccctcatactgacagctgaactaaacaagcacagcgtcgacgactatcacacaagccgccagcgaccagtaccaggacgtaagctcagagaccatatagtgctaacagacgcaaacaacgcgatgcaccccgcaccacccacct

SEQ ID NO: 556928 - DNA, 699 bp, Homo sapiens
tggcaggtgtgtgtctggggaagagacttacatgaagtggagttgctgagtcaaagatctaaccatgagctaccctgtgctatcccccgcccccaggtgtgctacccaccagctgcaccaggtggtggtccctgggtgagtgtgctgcctaccctcctcctgcccagcatgccccccatctggtgctggataactgtgtgccacctatgctggtggcagttcaaccagtgactatctctctgtggaatgtgcgtgccaacatgtcttgggacatttggaggagccaacatgcccaacctgtaccctggtggcccctgtgggctggctacccaccagtgcccccatggctggcattttgggcagccccacctctgcccagcagaactgttacctccctatgggatgtatccacccaccagtgaggaaacacacaccctaccaggatgcccacatatccgccatacccaaggagcccctgtgccgggccagcccatgccaccaccacggacagcagcccccaggggcctaccactgggcaggcacacagtgaactacacctggtcagcctccaaatgacaatccctgggcaagcagaagccaatgccggcataccatggatacccggggtcagggacagtaaccacgcgtgcacccaacaagaggaaccagagcacaccgaaacccggaagaccatcaaac

SEQ ID NO: 556929 - DNA, 416 bp, Homo sapiens
  misc_feature (377)..(377): n is a, c, g, or t
  misc_feature (402)..(402): n is a, c, g, or t
gaaactcggagtttgtgagtacaccaacagaagctttaatcatgagcaggtgtaggggactttttgcccattctccccaggcttggctcactgtgaagactcctgcatttgtcttctgtgctgggagactgcatgccagagcctacagaggacaccacccctgcaaaacaataatttgcagaagaaaagcaaacttgaagccagccatctactctttaaatataatctctaacttaaaagcaaaagtatgtcgcctttttctgaacatggtaccataggaatgctggtggctctgtgtagaggtgtggatctttaaacaagagtgtaaaagaaagggtctatcactttcattgccttggccaaccctgaaccttgangaaaatgagctccggtttgctggtngacataaggaaaga

SEQ ID NO: 556930 - DNA, 178 bp, Homo sapiens
aggtcatgacatgacagcccaaaatatgtctgtaggacagcagtatatgccattccaaatatgcctctttggcacaggattactttaaactgattattttgggaaacagacacaggagaagctctgaaaacagtaaaagttgtatttttgtaagagaaatttattttatacaagaata

SEQ ID NO: 556931 - DNA, 1005 bp, Homo sapiens
tgtggcggggcgcgtccttgcgcgcgctgtgtttgttcgagtgttcgtgcgtgttatgggcagagggtgcttgttgcgatgctcgcgtggcgttgcgctgtgctcagggtcgcctgggggccctcaatctccacggggagggttgtctccatggtgccctcctcatgggtgctgtccgcctgcctgtcgaggggagggcccacagctctggggccgtttctgagacttgggatcgagcgttgccgcttgggggcccgtggatgcgtgtgccggttgccgtgcgcgtattgctggtgcccggtgcacggaggggtccggtgtcggtagcggcgcatggcacctgggcgtcaggttgcagcgcggattcctggtctttgctccgctggtccccggtgccccagcctcgtcttgggccctcatcccctagatcccgggaccccggccccctttgcagcccttgggcccctgtaggattcgaggccctgggcctctagcccccagcccatccgtgttccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgaatgtccacagagttcatgaggctccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtcccaacaaaaaaaaaaggacggcgctcgcgactagaac

SEQ ID NO: 556932 - DNA, 239 bp, Homo sapiens
gtcatcacatgcagggtgtgtatcgtgtgcaatgcaggatttcatgttgtaaatgtggtgggtgagctgagcccctattgtgttgtgcgtaacatatgtagcagggagtatagggctgtgactcagtatgttgcgtcctgtacagtcaggcgagtgcatatttgaaccggagaacgtggttactagcacagagcagttctcccagcttcagcattcaactcagtggggggtacgcgcgc

SEQ ID NO: 556933 - DNA, 461 bp, Homo sapiens
  misc_feature (145)..(145): n is a, c, g, or t
  misc_feature (155)..(155): n is a, c, g, or t
  misc_feature (233)..(233): n is a, c, g, or t
taggccaagtgccgtagctcatgcctgtaaggccaaggggtaagaagatcacttgagcccaggaatttgagaccagccttgtcaacatagtgagagcccatctctacaaaaaaatttaaaaattagccgggcatggtgctatgtncctataatcncagctgctcaggaggctgaggcaagagaattgcttgaacctgggaagcagaagttgccgtgagccaagatcacttcantgcactgcagtctgggcaacagagaaaggccctgtctcaaaaaaaaaaaaaaaaacttttcctgtgccaaattattataagatggtatcataacttctctcgctataactaaatctgtgagctttttgaaatcctttcttgaattcttctttttaaaaaagtaattcaagttttcttctttttggactttttttccttgttgggattcaagcctgaaatcagttttag

SEQ ID NO: 556934 - DNA, 1119 bp, Homo sapiens
agaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaagggtctccagtatgatagctaagcagaaggaaagctgacaagctgcccacttgagccttgcccttcacctgccttagatggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggtttta

SEQ ID NO: 556935 - DNA, 137 bp, Homo sapiens
gagctgagtcacagtgtcagaagagacacccaggtctatctgtgactgagtagaacaccagtgccacggtggccgagaaacgacctatgacttcatctagctggggatcctggtgcattacctcaggatgtcgcatc

SEQ ID NO: 556936 - DNA, 1727 bp, Homo sapiens
gagtggcagtcggggttctccggagtgcctgtgtctctgccaacgccgtccggatgggttgccaaaacacgagagccagccgccactagcgtcgccgcacgcccgtgaaaggagctgagacgagcggtgcggcgccgcgcggggtccaggagggagaaaaggctacaggcagggcagcatgcatgacgcctccatgcaggtcctgcgcgataaaaggcgatcatcgtgccgtatcacctgacagtcatgacaaaactagaagcacccactggggatagccggacccaaatccgatgggaagacaagactggccaaccacgctactagttgacggcacccatggacgcgctaataacagcatcatcggacaaaggaggtcctccaccagcggtgagacctaccccgctcaagcaagggagggacaccaactacgagtgacagacgattaccccaatccagggacagcgaccaatggaaggactgcaaacacacggcaaagcgggtaggagaaacaaaagcaccaaggggaaacaaaacagatgactaggccacatgacgaaacacgaatcaccttggacaagcgggcacacacacggatggcgatactcaggaaccccatgggattactgggactgtggtacacaggagcaacccaacataccattgcggcaggcgtcacccaaatacccgaaggtacaggccccgtcccgagcagggcgcacgcacaagccccgagacgaccacattcggcacacagcgacccccgatcagaagcaacaaacacaacagaaatagaccatgggcccccgggcacgcgctaccatgcggaacacgaaaaacgccaccacaacacaaggacgcattagcgcgcaccagaaaaaggctaccaaccactggcacaacacggacacaccgacatacacaataccaacaaagagccacaggcgatcaacaagcaccacgccaacacaaggcggaacaggaccccactgtgaaagctacaacgagggacattagcaccaccaacgtaacgagtgagctccaccgatagagaagcaaacagaaagacgaaaaaaccaaaagacgagcaagagaaaaccgcaccataccgcacactggcgacagtggaaacccgacgacatcacaggggaacgacgataacacactgcgaagtagatacgacgagcaacacaacttggaacaagaatatacggcaacacacgcggcagcgcgacacgaccacgctaacgcggacacagtaggcaaagacatgtaggctcaaagcgtacaaagggaagcaacgatgacagcaggcacgtatgacgaacaccccgatgtgacgcaaatacttaacgacaccacaaccacccaccaccagcacaagcgaaccacagaacaaacagaacaaccccaagtctaacgagacactcacggacgaaccgaaacagagcacgatagacaaccgcgacacgaatagcaggcgacggagatacacaagaagcaagaaaacacaaggagcaacctcagagagcaatcaacgaacaacagcgcaacaaaatcaaacagcgatatacatcacgtagacatcgcggcggaacaaggagaagcaccaacaaacagagacgaacaagaccaacgagctacaagggaaccgacacaaaacaacaacggagaagtacgaacgagacagcagacaggcgatacacagaccgcagcaggcagcaggg

SEQ ID NO: 556937 - DNA, 1129 bp, Homo sapiens
agaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggtttta

SEQ ID NO: 556938 - DNA, 264 bp, Homo sapiens
  misc_feature (94)..(94): n is a, c, g, or t
cggatgcttcctcctcaaccttggcacccacctccttcttactgggcccaggagccttcaatgcccaggagtctggtcaaggcagcagagcggngccccctacggcccctacccctggggatgggggcccagggacgccttccaaggtgacctgtttcctcccaatggatcctgccaccttctggtgcaagagacctgaaagtgtgggcgacctggagctaccaggctccacagtcatcagggtccctcccaacactaagactt

SEQ ID NO: 556939 - DNA, 894 bp, Homo sapiens
  misc_feature (2)..(2): n is a, c, g, or t
  misc_feature (26)..(26): n is a, c, g, or t
  misc_feature (72)..(72): n is a, c, g, or t
  misc_feature (80)..(83): n is a, c, g, or t
  misc_feature (88)..(88): n is a, c, g, or t
  misc_feature (92)..(92): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (129)..(130): n is a, c, g, or t
  misc_feature (136)..(136): n is a, c, g, or t
  misc_feature (142)..(143): n is a, c, g, or t
  misc_feature (147)..(147): n is a, c, g, or t
  misc_feature (152)..(152): n is a, c, g, or t
  misc_feature (162)..(162): n is a, c, g, or t
  misc_feature (165)..(166): n is a, c, g, or t
  misc_feature (181)..(185): n is a, c, g, or t
  misc_feature (187)..(187): n is a, c, g, or t
  misc_feature (190)..(191): n is a, c, g, or t
  misc_feature (194)..(194): n is a, c, g, or t
  misc_feature (196)..(196): n is a, c, g, or t
  misc_feature (199)..(200): n is a, c, g, or t
  misc_feature (202)..(202): n is a, c, g, or t
  misc_feature (204)..(204): n is a, c, g, or t
  misc_feature (211)..(213): n is a, c, g, or t
  misc_feature (215)..(215): n is a, c, g, or t
  misc_feature (219)..(219): n is a, c, g, or t
  misc_feature (226)..(226): n is a, c, g, or t
  misc_feature (229)..(229): n is a, c, g, or t
  misc_feature (232)..(232): n is a, c, g, or t
  misc_feature (235)..(235): n is a, c, g, or t
  misc_feature (242)..(242): n is a, c, g, or t
  misc_feature (245)..(245): n is a, c, g, or t
  misc_feature (247)..(247): n is a, c, g, or t
  misc_feature (250)..(250): n is a, c, g, or t
  misc_feature (264)..(265): n is a, c, g, or t
  misc_feature (269)..(271): n is a, c, g, or t
  misc_feature (276)..(276): n is a, c, g, or t
  misc_feature (278)..(278): n is a, c, g, or t
  misc_feature (280)..(281): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (311)..(311): n is a, c, g, or t
  misc_feature (316)..(316): n is a, c, g, or t
  misc_feature (327)..(328): n is a, c, g, or t
  misc_feature (332)..(332): n is a, c, g, or t
  misc_feature (357)..(358): n is a, c, g, or t
  misc_feature (365)..(366): n is a, c, g, or t
  misc_feature (380)..(380): n is a, c, g, or t
  misc_feature (388)..(389): n is a, c, g, or t
  misc_feature (401)..(401): n is a, c, g, or t
  misc_feature (415)..(416): n is a, c, g, or t
  misc_feature (423)..(425): n is a, c, g, or t
  misc_feature (437)..(437): n is a, c, g, or t
  misc_feature (439)..(440): n is a, c, g, or t
  misc_feature (452)..(452): n is a, c, g, or t
  misc_feature (474)..(474): n is a, c, g, or t
  misc_feature (481)..(481): n is a, c, g, or t
  misc_feature (542)..(542): n is a, c, g, or t
  misc_feature (544)..(544): n is a, c, g, or t
  misc_feature (552)..(552): n is a, c, g, or t
  misc_feature (555)..(555): n is a, c, g, or t
  misc_feature (568)..(568): n is a, c, g, or t
  misc_feature (571)..(572): n is a, c, g, or t
  misc_feature (575)..(575): n is a, c, g, or t
  misc_feature (599)..(599): n is a, c, g, or t
  misc_feature (634)..(634): n is a, c, g, or t
  misc_feature (646)..(646): n is a, c, g, or t
  misc_feature (649)..(649): n is a, c, g, or t
  misc_feature (701)..(701): n is a, c, g, or t
  misc_feature (885)..(885): n is a, c, g, or t
tnggttgggtgtggggggagtgaggnttgtggggggggtgggttgggggtgggggtaagatggggagagagnggagggannnntaagnttgntgtgggggtgggtgtggagggagngnttntgggtagnngagaangtgagnngggntgatntggagggggnggnngagggctagggttannnnngnggnnggnanatnntntnggtgttnnngntggnggggggnatnttnttngtgaggntgntnttngagggatttattgnnaaannntgtgnantnngtattggnatngagganagtggtgcttatnagggncaacccaatgnnatcnttgaaaaggtgttcatatgtattannaagtatnntgataagaaaaggntggagggnntgtgaaagaagntggattggaatgtnngaaaaannnaatggtggtttngnnatcggaggaatnaggacaagcccccaacgcttantaaattntgtgaaagcatgtggagattcacattttatttatgtatattctgctatggaattagatttntntggtcgtnacnttggttctggganatnnganagtgctggcataactatccatttnagcctctttcaagtgggctttatcactattatatnatggaattggcnttntattggtcccttatgttttctcagtttacagacattaaaagaaaggacttcntgatcatgtttgtgcatcacttggtcaccattgggcttatctccttctcctacatcaacaatatggttcgagtgggaactctgatcatgtgtctacatgatgtctcagacttcttgctggaggagccaaactggccaattatgccaagtatcagcggctctgtgacaccctttttgtgatctcngtgctgttt

SEQ ID NO: 556940 - DNA, 1260 bp, Homo sapiens
agaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctaaaa

SEQ ID NO: 556941 - DNA, 955 bp, Homo sapiens
tgggggtcccaacacctgggaaaattgggggcgtttttccccaaaaaaaaccttgttttaaaaaaaaaaataaaacgccaacccaaaaaaaaaaaaaaggtggccccaaaaaatatccccttgcatcacgaggaagaagatgaccaagagctgcgtggaattcattcatacacccgcgcttcataacaactaaatacaatgataggaggggcacagaaaaaacaaaaagtcgtcgaaaacaaagcctgttacccacccccgagagtacaataaagggggggggggcagcagctgaagaggggaaaaaaaaacactacccgaccagaagacaacagggagaaacgatatgggcgaaacgagctcgcgcgacacccgaaaaagccctcgttgtatttgccagcccgtggtgggtggagacacacccccccgagaaaagctggaggctgccccaccatatccacagaacaactagatagaagaaaccaccaagagagggggtaggacagcacagcaaaaaagaccgccacacaacacgaggtgggtcatgcacaacaacacaaacactagcaacacaggagggggcgacacccgacacaccagcagaagaaataggggggccaacacgcacagcttattcacccacagagggggggacaacaaaatttgctgcgaaaacacagcaaaaaaaaaacgtgcgacagataagctgaccgcgcgtgcggggcacacaacaacgagggggagcacaacagcgcggccaatcaatcgagggccgggaacgagctaggaaaaaaacaaccagcagaaagaaagacccgcggcacacacgaggggaggagcacattttgctgcgtccaccaagaacgttgccaccacagaaacctctggaagaaacatctcctgatataagccgcacatatgcccaggaaaaagacacaaagtagtgcggtgcagc

SEQ ID NO: 556942 - DNA, 1079 bp, Homo sapiens
agaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaaacgtggattgtttaaagaagctctccaggccccaccaagagggtggatcacacctcagtgggaagaaaaataaaatttccttcaggtttta

SEQ ID NO: 556943 - DNA, 174 bp, Homo sapiens
ctaggcatcgctgattcctggacccctggagacactggaacccttacctcccactttcctagtgggcttgtcttgaaactaccccaagaaagacagtgctctcttgccctgggccctcagtgtgagggcactctgtgcacaaaatcccactgaggaccaaacatgcctgcagtg

SEQ ID NO: 556944 - DNA, 104 bp, Homo sapiens
ttgcagcagtaggagttgagtagcgcccaggcatcgcagacagggcgacatcagctggggacgattggcctgagctagggctggagacctgaagcaagccagga

SEQ ID NO: 556945 - DNA, 333 bp, Homo sapiens
  misc_feature (63)..(63): n is a, c, g, or t
catgatccaggcgccataagcgatgtgggcagcctacgcggtttaccaccgtgggactgggangactgctccagcctgggcaaaagagggagagactgtctcaaaaccaaattaaaaaaaattaaattcaggggctgggggtggctcatgcctgttatcccagcactttgcaaggccatagtggatggactgtttgagcccaggagttggcggctgcagtgagtcatggtgccactgcattccaacctgggggacacaggagaccctgtcttaaaaaagaaatttgagaaaaaaaacccaggggagagtaaatttaaagggttctaaaattta

SEQ ID NO: 556946 - DNA, 227 bp, Homo sapiens
  misc_feature (45)..(45): n is a, c, g, or t
aaaagccgagatagcttccttaaacgttttaaggaaaatgttccnaaaaaaaaaaaacccccaaaagaaagggtcctgggtttaattaaagggccagcctgctccccccaaaaaagcccccttttttaaaaccaatgggaaggagccttagctgttggaaccttttccctttgaatttatggcataataggtgtttaaaaaaaaaataaaggccctttggggtccca

SEQ ID NO: 556947 - DNA, 185 bp, Homo sapiens
aagatcagtcatttgagagcaatctgatatttaagagacctaaaataaatcctatgtagggaagtcagtggaaaatgctcgggtggtaatggatttagagtgcgttcatttgagagggctagtatgttaaaagtagaaatcaaaatctggcaccgaagcatgtgtaattgtgtactggacctggt

SEQ ID NO: 556948 - DNA, 428 bp, Homo sapiens
  misc_feature (22)..(22): n is a, c, g, or t
  misc_feature (30)..(31): n is a, c, g, or t
  misc_feature (36)..(36): n is a, c, g, or t
  misc_feature (40)..(40): n is a, c, g, or t
  misc_feature (52)..(52): n is a, c, g, or t
  misc_feature (54)..(54): n is a, c, g, or t
  misc_feature (66)..(66): n is a, c, g, or t
  misc_feature (180)..(181): n is a, c, g, or t
  misc_feature (254)..(254): n is a, c, g, or t
  misc_feature (274)..(274): n is a, c, g, or t
  misc_feature (335)..(335): n is a, c, g, or t
  misc_feature (337)..(337): n is a, c, g, or t
ccttgttagtgggcctgtttanagggtctnntcagngagngtgtcatcaggnangacctgatgtgnggggtctggtcagcagggacctggtcaatgtgggctgctgagcactgcttggataagccaggtgcaatgtgcattattgaaggccctgtggacagctgggatagcccagtgatnnccaagggcctagtcaaaagtggacaaagcacgtgtttggatggacctgggagatcctgctcagagattctganaggacaaaggtaaaggaagngccagagtggctgcagagatggtcacagtctatgggctgcacaggatgaaggaggccaggnancaggcagggtgggcagttggggttcagggagaggcaggtgcatgctgggaggtcagaccctgtgagggcttcgggggcgtcaggttgggta

SEQ ID NO: 556949 - DNA, 600 bp, Homo sapiens
gcttcctgtagagaatatgccccatccaacgaaactcagcttcagctatgacaccatcggtcgggtaagcggactttcggtagctggccgggagtgtgtgccatcacagccgtagagtgttggtagtgggcaccaggcaatggtaccatccagccgtccccgctggtacatgggcactagttacactgacgggagagagatgagagtccactgtctctctgcaccagtaactataaagcctcttaccttgctaccgtcgacagtgcaaggctttttgccagcgcatccgcctggccccgtcccattcattactgtgaatacaagcctctgatcttccatctcctccagcgaaaaaaatgaggagccctggcccctccaactttcttcagagtaatagcacttaattccttccctatctccttaccaaaagtacaagttacatctattcaccaccttttctgcaaatctaggagtctacctgttcattcctttatcaaagaaaagtatctacttcctttctagacataagagtactagctctcaccctctgccctttactagaacaggagtcttcattctttttatgcctcatcagagaag

SEQ ID NO: 556950 - DNA, 558 bp, Homo sapiens
  misc_feature (505)..(505): n is a, c, g, or t
agtccctaatcattaattatcaggtaaaatgctcactagaattaatcctacttccagaagagttctcaaaagagaaacctatatactcaactctgatgctcaagtctgaccaatccctagatactgctgacctattcatatattcatattctatcactgatatgggaagctctgtttgaaacataaacttaaaaaggaatctctatatatgaactatcagtgctatcagacaatgctaacattatgaacatgatgaggatataacccttgttttcttagaaatgcccacccacatttatgctgtttttagtttattactcttgtcaaagttgccatgcagaatgtctgttggtcagttgggcacatctgcacacatttacaatatctgccacctcttttaaccctcaaccccgccccacaaaatgagtgatggtgcttgttgatttgcagattcacagtctggtgagacaagtttgagatctcatattttcagctcatccttganaacctttcttcgatttgactgaccttgatggctccctggaatctcacctacat

SEQ ID NO: 556951 - DNA, 156 bp, Homo sapiens
ccttagcttagtgtcgaaggaattgtcaggttaacagcaacacaaagacatattcaaagacctaataggtcagaagaattaaataccaggccaaaaacaaatctgtatggaaatctagaatcatgtgcatagaagaagaattttcatgtaagatta

SEQ ID NO: 556952 - DNA, 629 bp, Homo sapiens
  misc_feature (33)..(33): n is a, c, g, or t
  misc_feature (81)..(82): n is a, c, g, or t
ggcgctttgcggggtgagtgaccaagttccggncagttcgacctcgaggatccataggtggagacggtactacctcccagnntctgttttccatccccttcaggtccttcctcgggaggctggcgaaggcggtccaccgctgcgcgtgatcctttagttgctctcggtccccttgtgcaccctcactcgtgcccgtgtgtggaaagaccttactcctccctccaccccgatcgaggagctatgatcggctggacgcaatacggtgtagcgaatcatcattggccgacggtgccagaaatctgagaccaccacgtgcctaagaggtaccctgtacttcaccgtcgtcttgtagcttagtgccggaggaagggccattcggacaggtctttcccttgaatggattcttaactcgacaactcctgaggcacgtagagcattgtccccctagaagtaagagatcgtgaagtaactctcgtacagatttgaggatggttcagagtacaacaagccggcatgctagagggcatgcccctgtaagggagaggtataaccggccctctgttgactctggtgctcgcttttgctaaatgagctggtgacgccatgatcatgggctggggtcgtgaata

SEQ ID NO: 556953 - DNA, 234 bp, Homo sapiens
  misc_feature (59)..(61): n is a, c, g, or t
ggagttgtaatacgaggtgacaccctcgagtcacttcctcactcagctgagcgcctccnnngctttgggttcgttctgcagccttcgccccgttcctagcctcagggccggactccagcgcagagcccagcccagcgcagcttgccagaagccacccagccgcccagtcgcccaggcccgcacgtaacccggccagagtttcttagcagccccgagcctcgaccaccgcctttt

SEQ ID NO: 556954 - DNA, 364 bp, Homo sapiens
  misc_feature (204)..(204): n is a, c, g, or t
  misc_feature (206)..(206): n is a, c, g, or t
  misc_feature (272)..(272): n is a, c, g, or t
  misc_feature (317)..(317): n is a, c, g, or t
gaaactggaaaccatcattctcagcaaactattgcaaggacaaaaaaccaaacactgcatgttctcactcataggtgggaattgagcaatgaaaatttttatttattttatttttttattttttgagacagggtcttgctctgtcacccaggctggagtgccgtggcgtgatctcggcctgctgcagccttgacctccctgggntnaagcaatcttcccacataagcctcccaagtagctgggactgcggacatgtgccaccatgcctgggntaattttgtttattttttgtaggaggttggggtctcactatgttngctcaggcttgtctcaaactccgagggtcaagtgatccttccacctt

SEQ ID NO: 556955 - DNA, 207 bp, Homo sapiens
  misc_feature (29)..(29): n is a, c, g, or t
  misc_feature (83)..(83): n is a, c, g, or t
  misc_feature (94)..(94): n is a, c, g, or t
  misc_feature (99)..(99): n is a, c, g, or t
  misc_feature (146)..(146): n is a, c, g, or t
  misc_feature (153)..(153): n is a, c, g, or t
ggaaactaagaaataaatgcctcatcccntactccagaaacgagaacaacggaggcagaggagctgaagactccagtatgcanactgactacanaggangacacgaacggctgacggccggggtgctacgagaacccttgaccgtnactgganattcacgattgacgcccccacggagctctgctgacacgacgccctcgaggtccc

SEQ ID NO: 556956 - DNA, 329 bp, Homo sapiens
tcaatatgtgtcaggaggtctccggcggctttgacccaggtgccgagctcatcttccacaggagaatgaacgtcctctcggcaggcgcttacagaggaacctgtgcttattcattgtgaacaccagccagagcttattcattgtgaacaccagccacagtgtgtagcctccctccggtatcaccctgcgcattaacgctggattcttgctcgctgcgtacttgggccgctgggccccgatactgctcaagctgtggcgcgccttaaagccagcgaatcaccctctaccggccccgaagctctcgggctatgcgccctctccctgctcct

SEQ ID NO: 556957 - DNA, 777 bp, Homo sapiens
tgtgcccacgcctgcctgcttggctcttcctgtgtgtgctgtgcgttgcttcgctgggcttgtgatgttctgctgcggcctgcagtgagtctggatgcctgctgggcctcgtgacctgtggtgtgccccgccgtgactgtgtgactggtggtgctggctgttgctgtgggccccgtgactcctgtcggctgcacatccccgtcccagcgcatgagatgccaccccatgtgaaaagccctggctggactgaggtcatggctgccgctgcccttacaatgcctgtccaccagccctctccttctggtgggccccagttgcagccttcagcccagagcctggcctggagccctggaagtgagtgccctgtgtgctgtgcccccagtgcagctacatgcatgcagcatgcaacagtggagacttggggatggtgacctgtgccatgtgaccagtcctctccgtccatgccctgtcagccccaactgccccccgattgcagcccactttctgtctggggagcccaccctgagaacaaaggaagagcccggcccaggtcattgttccagtgtctgtggaaggagctgcggggaagtgtgcctgagcacggcgtccggcgattcaagaggacacaatccgcctgggttgcacctggtgaggcatggcagcagccttgatcagaagtgatggtgaaggaaggacttctactacacacagagcctgggatgatgggtgtggacaccgcataacggactggctgccagcctgactacagagtttccc

SEQ ID NO: 556958 - DNA, 188 bp, Homo sapiens
ctcaagcccaggaggtcaaggctgcagtaagccgtgactgcaccactgcactccagccaacagagtaagactctgtctcaataaataataaatatcaatagtcacataagatggcagagtagaagctgtagtgtagagatcagtcccttcacttgagcaccactgcgctagaagagtattggatcagc

SEQ ID NO: 556959 - DNA, 354 bp, Homo sapiens
ggggtgggattatgactgaacgccctggtaagaatcaggacatacagaatggagcagccgctattaaaggttagaacgaacaacgattaaagacactaacgagatctgagttcacaccgaagcaatccaggctcggtttctatctacttcaaattccttcctgtccgaaaggacatgagagatagggcctacttcacaaagcgccttcccccgtaaatgatatcatctaaacttagtattatacccacacccatccactgaacagggtttaggaaaccctatatgttccagacacaatgactgaaccaggtcggccgcttaggcccattcgcccttagattcgagcatcgttta

SEQ ID NO: 556960 - DNA, 343 bp, Homo sapiens
  misc_feature (285)..(285): n is a, c, g, or t
  misc_feature (333)..(333): n is a, c, g, or t
ggcatgaggccagttttcccaaggagcttttattggctctgtaagtcaactttgattccttaaagaagcctgtttatatttgaaagcatgccatttcagtcaaagccttggtaaaataaccagtttctccaactgggccctgttacaaaagaaaacagattcttactgtacttatgcaaataattatattgccataaattacaaatacaaataatttccaaattctggagaaatcagatagagagaaagaaatatgcttcaaattttgtttacaggagtacactntacccaattggtgcaaaagtagttgcaatttcagactatgaattttanatcgttataa

SEQ ID NO: 556961 - DNA, 589 bp, Homo sapiens
  misc_feature (494)..(494): n is a, c, g, or t
atcctcctttaagcagattcccccagcccctcccaggccagactttgaggcttcaagggaaaagctgcagaagttgggtgagggcaacagctccatcacccgggaagaattctccaagatgaagacatgagctagaagcggaatacttggccatctttaagaagactgttgcgatgcatgaagtcttcctgcagcgcctggcagcccatcccaccctgcgtcgggaccacaacttctccgtcttcttggaatacagccaggatctgagtgttcgagagaagaacaggaaggaggtcttgggagggctcctgaggagcatcgtcaggtctgcagatgaagtcctcatcaccggcatatcaggtctcaaggaggtagatgacttctttgagcacgagaggaccttcctagtagaataccacacccgaatccgagacacctgccagagggccgaccgtgttatgcactcccacaagtgcctggcagacaactatatncctatctctgctgcactgagcagtctcggaacccaggaagtcaaccaactcaagaggagcttcctgaagctggcagagctctttgaacggctgag

SEQ ID NO: 556962 - DNA, 144 bp, Homo sapiens
gtcgcatggctgagctgcagcagctccgggtgcaggaggcggtcgagtccatggtgaagagtctggaaagagagagcatccgcagatccagggtctcatgttccctgcagcgcacttttgtgaggacagccacgcctccatgag

SEQ ID NO: 556963 - DNA, 390 bp, Homo sapiens
aatgtacctgcagtatacctgtctaccaactaggttggtaccgaatcagcttaaatacgaagttctctctactaagcacctgaaacttaatatgtccagacaccaaaattctggacttcttcacacaccagtgctgtcatctcccataccttcccctccatagagaaggtaaccatcatccttccaggcgctcctgccaagcaggactcggaatcaggcttgattcctcatttttctcatcccactttcatggtcatgctccaacactcccaggctatccagaacctgagtggctcccttcctccatgatgaagccatcatcacttcttgcctggattgttgcagtagcctccaaactgttatactgattcagatctttactttctcaca

SEQ ID NO: 556964 - DNA, 254 bp, Homo sapiens
tagttacaaaaaagggcacaacaatatatatatatatgtaggtcaccaagaaactagggtcccggtaaaatactattagccagatactagtatataaaaggtgaagtctgatatggtatacttttttgggaaataaaacaaaatccaaaaccattttggtaatggtcaaaagtcaaacatgccaggttaacttagctatggccagggtcaccaagtaaagccatacccgactaaatgtgctgaggggtacggag

SEQ ID NO: 556965 - DNA, 209 bp, Homo sapiens
tccctccgcttactatactcttccttattttgctcctagacgggtgtgcactttaagctgtacttaggtagctcgtctggtatcgggggtctatagctttggctctccttgcaaggttatttctagttaattcattatgcagaaagtataggggtcagtcctagctatattattgcttggttataattttacatcttaaccctatgcgg

SEQ ID NO: 556966 - DNA, 516 bp, Homo sapiens
ggtaaatggctaggaaaatatagaggtgtagactgagatcctagtgtcctgcatggtttggctaggccagtgctggtacacgcatactatggttgagctgcggctactccagaacgttgagcttgatgagtaccagtctccatccttgtcaaatgcattataagctctgagcatgccctccatcctaacgaatcagcagatgaaactgtcaaagtcgatgttcatgtttttgtctgcgttccgcatggtaatgatgtcatagagctggctgttgaggtggaatcctgcgtctttgactgcttttcgcatctcgtatctcttgatggcgccggactggtctgtgtcatattttttcgtgagttttctgccaggccttaatcttgttccagaggtggtggaactcctgcaggttgagctttccagagccatctgtaatccatgagcgcaatcatgctacggcaggactccagtgtgaacccgtgtgtcttcaggtccttgtgtttgttcgttccattt

SEQ ID NO: 556967 - DNA, 1302 bp, Homo sapiens
ggcttgaagaggatgcagactcccccggagacctgaccaccctgccccagaatctgcgtggagcagctgaccactgaggccctctcacctccaaagacacccagcctcctatccccgcgtgggtttatcgacagtcagggccgccagggctgactcacccagcgcccatcctttgacatccaatatcccacccgatcaacatttggctgagaggctgactccgccgtggctcgcaatcacagtgagtaccaagcacacgtgacatccgaggtcgcctcctaactcgctttcatgggcatgagacggcgtagcccgaaacgcccaatggccacgaatcatgtcgcacgtcgacctcggtcacctcaagggagacaagcttgcccgtgtggtcgggaacgacccaggacacgagcgctctatgcccttgcctacgatccctaggcgcagctcgcatgtccgggctatctggtcaggcagaagctcacctaaggttccaaggggtccattgtttgctccggctgacactcgcacatgagtcggacagagagaacagggcctcgccagaagcccgggctgagcccaactttgcgagggtacggagcatgaccaacaggtcgtccccttccccagcatccctctccctggccctcacaacgtatactaggctagacgatgaatacgatggccgaaaaacttgtacacaagacgcctgttgcttcagccaaagaggaatagcgcgggggcaaccattgggagtctttgtcgtcgctcttggtggcagcttcgcctatccctcgttttgcctcttcaggattgcctaggccacccttgcactttgaacatccgctcgcctcgacttggcgttgccgggggccctcatgaggaatgttgtcccccggggtcctttgtctacctgggtgacccctgggtgcccgtcgtagttctctaccccatccctagggtttagctgggtcctaccaccaagttgctaggcgttgggtgagcgccacgtccaccaatcggcgggcaacgaatcttcctggccttgcaggaacaccatcatatgcttatattggcgcagactgttgggggatattcaaagtccaaggtcggtctagagcaagtcacaacagagggaggtccacagtgtgcgccaaactggagggcacatggctataccaggaccacaggttcgccccgaccttccacaagaggccgcgtataagcctctatatactggaaggcgacacactaaaagaccactcattgcctggggcccatgcgtgattaaacacacaagag

SEQ ID NO: 556968 - DNA, 205 bp, Homo sapiens
gaaaagactcgcgggcgcgtttcgggtgctggcggctgcagtcggagttcatatctaagcagctggaaggaaccatggccaagtgtgagcgtaccttcattgcgatcaaaccagatggggtccagcggggtcttgagagagataatattaagctattaactgaggctgaccagaggggaggaccccccctttaccaccccatgca

SEQ ID NO: 556969 - DNA, 192 bp, Homo sapiens
caaatgttctcagtcagtgcacccttcactgtcggcagttacttcatacgtggtaaagttctccagtatgggtatcattgatcttaattctctcctttttcaagcgaaaagttgcagacctgactctgaagaggagcttctcttcagtcatatcttaattttccatttagcctacagctgcatgcacgtagc

SEQ ID NO: 556970 - DNA, 920 bp, Homo sapiens
cttcggagcgggagtgttcgttgtgccagcgagtaacaaagagaattcagctatggatgatgtcgagaacggcgaggcaagatctctggattatgaatgtgttcccgagtgccgacaccgttgcaaagaggggaggtctaaggcagcaagactgggcgcaagatctccatggtctctaggcgcggaagacaggtcaggccccgtggataactcttacacagagcgcgcaagtaatgaacggaaggcatcatctggggagaggatacactgatggagtatgcggagaatcgccaagaagtgacatccctggaacaaaaaatgagtcttggtcggcattacgaagaaggaagaccgggcggacttaatagctgatgtcaaaaaagctactaatgagtaataataggccactgccttgatttattacaagagcagaaatgtctcatgacttttctatgtgtaccatcctttaatagatctcatacagcggaattcagatcatgaatgactgagagaatatacgtgggcagtcctgatgtaaaactaagatggcttgtggtctaaactgaatatgtgcagtcccggaaattttcatagtaactcctacttcagtgaaaatggtatcactggtttagccctttttaaagatttgattcaggattccgttaagtggatgatcaagttttcacacacagtttggtgagtgcccatcttaatacactttgggagtggcatatattgagaatggctaccggtatcgcgaaatttttgcccacgggggcactgttctccgtgtttaacaccacatccggtgtgggcgagacctgcctcaaggcgggggcaacaagggcgggcgaatgcgcacgacccaacatccgggaagatccactcgcgagggggaaaacaccaatccccgaacctct

SEQ ID NO: 556971 - DNA, 263 bp, Homo sapiens
tctagagaatcccctttccagagctgtaggagaagcttttatgtgactcggagaagaagcaggtacagtacaccttctgcagagcaaccaaccactgtgaggcctcctaacaggctggcagtctctgctgagcatgtgcttgtcatacttccacataaagatgctttgactacctgaccagaatctgaaagaacctgtcctgcaggtgagcaggtttattgtgcacctggcacacttgctatgcacagaacatgagacttgca

SEQ ID NO: 556972 - DNA, 352 bp, Homo sapiens
ccaggctgagtaaggtttacatatccaaatgaggagaaacaggtttgcttcttctcttattgtctaaaggtgtctgaggactttggcaagaatgtcatggaaatccttcagatttttgttttgtgcagagggatctgctgggtggtgttggtttcatccgccttttctggtttttcgttgtgtgactggtcatttctttttgggaagatgggtctttgaaactactttcctgtatttgaagtggtcttttcatgcttttttgtctgaagtttttcaaatcgccattaaattatgttttctgaattacagataaaaatgcatgttaggtcctaggaattaaaccctgattggg

SEQ ID NO: 556973 - DNA, 1064 bp, Homo sapiens
gaacccaggaggtggagcttgcagtgagccgagatcgcaccactgtactccagcctgggcaacaaagcaagactccgtctccaaaaaaaaaaaaaaaattgggcttgggcattggtgttggcattgttgccgtgttagttcccagccacttcgggaggctgaggcagaagaatttgctttgaacccaggagttcggaggtttgcagttgggccaagattcattgccacttgcacctccagttctgtggacgacagagttgagacttcgtgtctcaaaaaacaaaaaaaattctcttttttaacaatgtgagtgtgtttaattaacacttttttaaacccttgggaacattttgaaggagattgagggtctctaagaagtgttattaggggttatgtgttttcaggaaacagggcaacagggggtggctcccaggaacgccatttttgtgtctcgtgtgcaaaaccgaagaagggtgtgagtgttctttcaacacccccgggtggggggacatctcgttcaaagacacatacatttgaggccagtgtgtgcacctgtgtctcgggacaccagcgccttgtgggtaacgctctcaaccccctgtgttttacttccctatagcccactttttggcggagaggcggcaaggggtcaacagagaggggagtctccaccttttgagagcgccccgagggagattgtctcgtgaagagacccacaggcctttagtggaggacacatgttggcgggaaaatattcgcgcccgcttctttacagaaaaaatattttcaccaaagattttttccccggggaagtgtggcggggaggcgcggttccctgtgtttggtgtccccccgggatactcctgtggggggggccacacggggggggggggagcggggcgcttcctcgtgagagccccccgcgggagggggggggctgacagcggggtccaccacggtcgtggagcaccctgtgggtgtcgcaccccatttagtatggggtggtacttccccaccggccctttagttgtgtggaccccgcatgtgttggagacaacccctcg

SEQ ID NO: 556974 - DNA, 185 bp, Homo sapiens
cgctttctacgtcactgtcctgatagtattcctctactattttaaaatctgagtaaaacgaattcttcaaaatgaattcctaggctgggcatggtggctcatgcccgtaatcccagcactttgggaggccaaggtgagaggatcacttgaggccaggagtttgagaccagcctgcgaacctatga

SEQ ID NO: 556975 - DNA, 201 bp, Homo sapiens
ccatctgatgtccggcgtcctctctacaagaacattgtcctctctggtggttcaaccatgttcagggactttggacgtcgtttgcaaagagatttgaagagaactgtagatgccaggctgaagttaagcgaggagctgagtggtggtagattgaagcccaagcctattgatgtacaagttattacacaccatatgcagcgg

SEQ ID NO: 556976 - DNA, 126 bp, Homo sapiens
gcggccgcctactactactactgctcgaattcaagcttctaacgatgtacggggacatggttttctatgttacttccattgtaacattagtaaagtgactttcaataaaagatttatgttattttg

SEQ ID NO: 556977 - DNA, 1378 bp, Homo sapiens
  misc_feature (400)..(400): n is a, c, g, or t
gctgacataccatatcactcagatagcatggtcctggtgaaggtccaagtcgatggagcattggagcagtatggaagctgcctggtcagcaacggagcctgtgttgccaacttgcgtagcgcttacaaggtcggtactactttgttagcgcagtaccaactgacacctcttctcattagagccgtcaaagttgacaagtggctagttagcagtgttgtccaagaatattgatgcgcatccgctagtgggagcccagattctcattggacagactcgtgtctgaggtcgtagcaggacacagcggcaagtgcctttggtctactcagacagtgtgacagagatcccgcaaatctcacctcactcagttcacagaggtcaggcgaacagtctccttctcganaacatcgaagttgtcgtgcaagatggcgtatggcctgcgttcgtacgtaaccgtcgcgttgcgcatgctccccccatcttggggccggtcgttgcggatccccatccgtagtaaggcacgcagaatgggcctcgcgtggcttctcactatctgcgcatgggcgttgggggcatgcgccagcccaggggggtccatccgattcgtgcttgcacaccacatcttagcgtagaaatcgtccccctacagattgctatccgctcttagtcgggttattggcttgcaaaagcttagtgcagccagatggtttattcgcccataggattagagcccggtcacatacggcatctgattcaagagcaagaagatcgctcgttccccttgaattatctaagcacaaaggtgcctataaagagaaacccacctggggggccatatggggttcgaggtcacttattggacggacatcgtttattgaggctcagtcccgtggttgaagacctggtcctttcaagttggagttccagcaaaggttcgccatttggctccaattcgatttaggctccacgttccaatggataagggtaccttgtcgttgattcggagcgcgcttgccccgtgtgtgacatacctttgctcgcgctttttgagttggcccacgttgtgggaccttctttccaacggataggcagtgcgaataccgcatgtggccttcctatagaggggggacgacgatacccgaaaaagcgttgtaggattggggccataggggcgcaaatcccccgatttaacggtaggatactagttggaagcgccgacacactcgagaagatgtggcccatcaccggagatagcccccccaaatagtcgccaaagcgagtattagcaacgtaataggtatcgctccgaaacatagtgcgggtgattatagcactaatacagcgctgccaccacacttatgttggcgcgacccaccatgag

SEQ ID NO: 556978 - DNA, 202 bp, Homo sapiens
ggtcctcgatagggtcaagcatagtgaggtacatcccagttgggtcttatctatgtgtgttcagatatttttaagctactttcgtcagtctattacgtgtcaactggagattttgtacaactcaggtgatttctagctttattggggagggggtgatctaaaacaccctttacgccggcttctattgacttggcttatcgag

SEQ ID NO: 556979 - DNA, 924 bp, Homo sapiens
agacagagagtgaactagtctcgagtttattgtattgttttttattcggatcttatctatttattgaagaaaccaatccgggggtaaagaaaaaagggaatgcggtttggggacagaggtgctgggggtgcgagaaaagccccagcccctgagaggggcggaggcgggagaggaagaggaagggatacactaggaacaaactcatagcatccggacaacgtacctaactgtgaatagacagacactaggaaatagctataacatacaaagtacctagggaccaggcacaagagtacgacgagtatacatcaggagaaaacgaccaaaacaatacacgaacagtagcagtgacacaacttagacgcgacggaagaagccacggggaacagccgagacaacaactcaggcagacgaccgtgccagaccgacgcgaaaaaaccatgaagaaaccagacaacaccgaagccccagaagatggcgcaaaccgacaaatacccataccatccaactttagcacaagagaagagaacgcctatagaggaccaacaactcaaagatagagaggtaaaacaatacatccccagcagtgcgaacacccacacatagacggcgaaaacaaaaataaagacgacaaactaaaagagaaaaaaaatccgagaatacgagaattgcgaagaggagccacaccagaagacccaccagaacggagacttacgacggacactgccaaccaagagagaaaaagagaacaagaacacgaaggccacaatccacggacaccacctcatcacacaacgggcgagcagacaaaacgacaactaacacccccatagacagacgacaagaaatccaccaacagcacagaaaatcaaaaccacacccaaacacaaagaaacatcaccgatacaaccagcacatcaccgc

SEQ ID NO: 556980 - DNA, 167 bp, Homo sapiens
atagataagccaccttatgtgattccggaggccttttaatctttgactcctcactttcatgcttgtgcctgggaatgggctccccaagcccagtcccccttttccctctgtggagggaaggtgtgtttgctggtaggatcaaaccaccactgactcttgcggggggt

SEQ ID NO: 556981 - DNA, 707 bp, Homo sapiens
ggtacacaatcaattggagtggtcaggctactgaaacattaaaatgtgaatccccaaattttcttttgggttggtcagggaaaagaaaaatatctttataaagaactcttgggacaatcaggagacggaatctcagggtgggttcaagtcagagctagttccccaacagaaagatcattgtgaacccagtttttatcccttctctttccttccctttccctaaatcaaatcacatattaatgtgcgcctaatttcacttaacatagacttgaataaattttaagggaaagcccctataatgaatccagaaatcactacaagcagcattacgcctgccgtcgggacatatcttgtgagaccataaaacctgtgatatcatcctgtgtcatatccgacctgtacccccggaccatcacagtgtaactgccatatatgtaatatacacaaatcaattagcatgtgtaatggccaaattgcattcccccatgcttttctgtctccaaaccaacgtggacacaccaaatcaattctaaatccccaaaagctgcctaaatttaggagtctgaccctccaatctcactgtgtggtgcatgggccggtgaagtggtggcagatgcatgtgcctgaattgtgtgaggcctgggaagggactctttcttggagatactgtaaataccagtcaccatttaattaaggctgcaataacc

SEQ ID NO: 556982 - DNA, 143 bp, Homo sapiens
gagtgcaccgtattattcaacacagcaaaactctttcagtgtctgttaacaaaaagtctctataagatagaggacaatacagtatcctgcagctattaaccccaagagctagtttagtaaatagaccttatgggcccatctat

SEQ ID NO: 556983 - DNA, 291 bp, Homo sapiens
aggatccgtactttggacgcataaatgggggacggagacgtggctacgtagagagtgagacgcgagattcctaaaaaagatgcacagagcgtccctcagagaggccaagaaagatggtgcgagggtagggaaggagagggagagagagagagagagagagagagaagcagagggactgggttgcactggctgcggatggtggcggcgccgtctcactcccttcctaatgtctatcgatcaataacgagggaagacaggaggacagggagctgatgggcgtccaaaagtcag

SEQ ID NO: 556984 - DNA, 426 bp, Homo sapiens
  misc_feature (48)..(48): n is a, c, g, or t
  misc_feature (76)..(76): n is a, c, g, or t
  misc_feature (100)..(100): n is a, c, g, or t
  misc_feature (187)..(187): n is a, c, g, or t
  misc_feature (206)..(206): n is a, c, g, or t
  misc_feature (279)..(279): n is a, c, g, or t
  misc_feature (320)..(320): n is a, c, g, or t
tctgtcaaaaggtggagatgcagatccagcctgcctctccttattacntaatcattcactagacatatattgactnacatatatatatatagcttgactnctatttttttcttggttaggaaatttaagcccggagaggtgaaagtagccatgaatgtcagaaatacaatctcggccgggcatgggngcacgcctgtaatcctggncactttggaagctgagggaggagcgcttgagccaaggagttctagaccaacctcaaccacatggtagccccgntctacaattaaaaaagaaaaatcagcctgcatgatggtganacctgtggcccagctctttgagctagacaggaggattcttaacccgggagtctgagaggctgcagtgagccgtgataacaccactggattccagcctgggtgacag

SEQ ID NO: 556985 - DNA, 154 bp, Homo sapiens
gccagctacttgaatgcctgacgcggccagtgtagaagcggccttgcgtcgcgaaaggggtgcgaagcgcccccaggatctcagcttcgccgcgtacattgcaggggccgctttgcggccctatcgcgacgcaaggccgctcctacactgagcg

SEQ ID NO: 556986 - DNA, 346 bp, Homo sapiens
  misc_feature (37)..(37): n is a, c, g, or t
  misc_feature (66)..(66): n is a, c, g, or t
  misc_feature (107)..(107): n is a, c, g, or t
  misc_feature (125)..(125): n is a, c, g, or t
  misc_feature (316)..(316): n is a, c, g, or t
gtttaagtatggaaaatcttttatccaggggaaatangccatatttgtggccctagccttcctganttgtggacgaagattgcccttgttgatgatttcccacaagntcccaatgactattaaanaaaattacagactgatggagggactgggttttcaagtcgtaaaatttagtaactaaaacctctttcaaattgaaagtcttctttagtgctgacaactcttcaaagtacatctacttggtatttgggtatttagtcacatactacatggtatttcatttattattcttattcctagaatcaccaaaaaaaanaaaatcaaacactaaaagataggtggaata

SEQ ID NO: 556987 - DNA, 149 bp, Homo sapiens
agtatgagtgtgaggcgtatataccatagccgcctagtttatgagtactgcggcaagtactatttacccatcgatgggggcttcgacatgtggctttagaggagtcattagtggagtccgtaaagaggtatcttcactattaatgcttt

SEQ ID NO: 556988 - DNA, 498 bp, Homo sapiens
aaatacaatacgccgcagtgcccctatcgccctatactatcatagcctaatacacaaacttaattatagatataacaccgctcacagtagaagggaggcgaagggatcctgcgacatacaccatgtatgacgtaccagagcactaagctatctggaccctcctatacgagccaacgtacgtagactagaacaaccctaccgggtaagtgtggagatcaatcataataaataggccaaggttcatagatggcaggagtaatacagaggtgtacttgtgtagtgataagggtaggagaggtaaaaggagccacttatataagtaaatgttgatagtaaaatgatggctagggtgacttcatatagagatagtaagggctactgcttcgcaatgcgccgaatcagggcgtcataagagtatgatgctcaccctgatcagaggaatatgagtaaacggctaggctaagaggtggctagaataaataggtgtcctaagtcgag

SEQ ID NO: 556989 - DNA, 255 bp, Homo sapiens
  misc_feature (44)..(44): n is a, c, g, or t
  misc_feature (185)..(185): n is a, c, g, or t
  misc_feature (230)..(230): n is a, c, g, or t
gttatttaataaattattggcccaaataagtgaccttatttttngtgattttttaatacaagattttgaaatgtttatctagtcaaatatgcctctccctatttttaaaaaatggctcctaggttttaaaaaattttattagagaaggtctttccaattctaaacccccaattctaaatttcctncttttattgcatttaaatccatttgggattatttgcatatatggngcaaagtgaaataggagtctaactt

SEQ ID NO: 556990 - DNA, 861 bp, Homo sapiens
agcggtgatggcgggcgctactcgggaggctgaggcgggagaatggggtgaacccgggaggcggactgcggtggtgccatcgcggtcatacggttccacctcccgggttagtgatcctcccgcctcagccctcctaagctagctgggactacaggtgtgtcgccacgcctggctgggtttctcaaattgtttggtagagtcgaggtctccctatgttgtccaggctgtttgtagttttcacatgagttgtagactttaaggatcagtctgagaattcccttatagtcacacttacacgctttgaacgtcatttctgacgactagtttatgggcctgtccttggggagttcaacgctccgggacatgactagtcagggaacataactgtcagagccaaagaacagtaaccctgctatgaacaaaactacgaagcgatgggtatacagaggctcctgggcactctcggcattttgacggagtaaacccgacttcacttctctcattgatctgtcctgtattcacctcgctgagcctgtacaataaggtatttcccggactatctgttccacagaatcatcactcgcagtcgacctctacacaattgtgagacagctatcccaaaggcatgaggctcatcagtcgcttgtacagcttcaggctcccagttcgtgattaacatgacgcagagatttttcccccttatgggtatttgagcacgttcgcacgttcgattaccaatgtgcgacagaagaccctgacaatcgacacggggagctacatctcttgtgcttgcgctcggtgtgaatatgctaactagacgctagtactacagtgtgttgttgctcgagtagagacacgaat

SEQ ID NO: 556991 - DNA, 982 bp, Homo sapiens
cgctcgagcccgggttgggagtgggctcctctcgccatagtggcgtgcgtggggccggggagagtgcggggtggtgagaccggctctgcccctgcccggtggaaagcgcctccgaggtggaaatggtgaaagtggggggacggggacgaacaagaacaagaaaataaataaataacagacacgggtgaaaggggggaccaaaatttatcaaaaagcgatacagaggcgcttgccgctgtccgctcgcggggaatggcttggggagcggacgtgggacatgatgagggtgaagggacggaagaagtgccggctttcctcggttccggcccgtcagcgtggaccgagtttccttaagacttcggcccacttccttttgtaaagcgtacggcggagactttggtctttcaccctttccgttgttccttcccctgcctgcctttcccgggtccaaacggaagatgtacagtgaggaatggtgctggcggaaaagggagacgggctggggaagtcgttggcactaggattggaaggagggaggacgttttctcgtggctaagaaaagccgaagaatattaaggtcgcaggcggcagggatcttgcattgttttcacccttcttatcccgtgtgttttaaaaggctctcaagtatttgaccaagttaaacaaattctggtattaaaaccgttaagattggcaaaattcgccggcttgctgttggaaacggcttgccttttccggccatgggttgtggggatatccagcaggaagggggtttttctcgtgagaggaaagttgacgtttttagacggatttgaggaactttggaaagcgcactttggggcaaagaggaattggattaccaagggccgagaggtgaaggttattgttgagaacaggtgctccggaagggcttttagagagaccgtttctataaaaattcttcttgaaaagcgctaggtgttgcgttggcgccttcgggaag

SEQ ID NO: 556992 - DNA, 155 bp, Homo sapiens
tcatgaaggaggcagactgctcccaagacatgggcgtagagaagcaccttgtaacctctatcccctctacactagcaggcccagtgggtagtagacttggtcccttatgccatttccacaggcgtcagggccaacgcagtcgtacgcaacccgga

SEQ ID NO: 556993 - DNA, 281 bp, Homo sapiens
ctgtttcccccctaaaaatctaagtatttctgggccttcaatttggaggagggcataagttgtaagtacgaagtgttattttaatgtactattcagctgtctcaaacaaatgcaaatcacttgtgttgtcatattaatagttcatagtgttgatcactcattaataatttgactctaacggcttttattaagaaaacagcagaaacgattaaatcttgaattaagctctcggcgcgggatatggccgactgcagatctgaggattttaagggggaacacgg

SEQ ID NO: 556994 - DNA, 626 bp, Homo sapiens
  misc_feature (59)..(59): n is a, c, g, or t
  misc_feature (142)..(142): n is a, c, g, or t
aagggtccactttatgtcacatgtgcgcacctgttctgtaaccttcactcagttagatnttaaggagagtgactatctcctgtcaaggtcagtgtgaagtatcgagcagttcaccatcagatgcacctggttatacattaantagccgcatttcataggatagttagcgacgtttatacatgcgcaagtatgtgcttaagtatattattaagccggttcacatgatcgcatggtgactgttgatatgctaacttggaaaatcaatgatgtcatcatcagtgtctgggtatatagattgtccggtcagatatggcctatgtaagtcatggcttatagtctaggatctagcagcttggaggaggcatgcaatctcaggttggcatgagtgcactcctgtgccccagagagccctgttatgtatgtaagcattcatagcagactcgatgcgtggaagacacaagccacttgtggagctggaccatagtagggtaccatagagacagtgcgcagtggtcagatataggcatccgcttctcagtcatgaagatctggatctggtggttgaccctgacaatcctagcactttgatgagacaaggtggacggagagctttagtctgggagttc

SEQ ID NO: 556995 - DNA, 966 bp, Homo sapiens
ttaacaggcccagacgcgattggagcccagtcgcctattgtccgcgcgcaagtccgtatccatccggaccccccgatgtaggtccaccatggagccgcggtgccccgttatagtaacacttggcgacccttggagaattttgcccccccacggggccgaatttggcaccaccattcgggggcccccaacacacaaccaagggcggcacacacgacagagcagaacatgcccgcatcccccggtgggacggggagcagagcacacttatcttcctcggggcgatgtttccaccgtccttcacatgcaggccaggttctgcgttgccgccgcaattatgtacaccggcggcattctttgtagccaacacctctccctgtatgtcagagttctgccacacagccggtagattaaatgttcgcgggtccccgccaattttggttgggcccactgcccactacacgatggggggaccccgacggccccccttaatttttcgggctggggcacccaaaaccttagagtcttgcgggcacgatcaatctcccgcaggaggtccgccctggtcgctggagtgggtcctcgtcggtgtgactcccggccgtgcttggttgaaagcccctctttcccctgcggaagcattggcccgaacgaacagacggtgcttggcggtctccccaaggagaagcgcggagatgtctcccccgagggtagttttacgccagccccacctgggtccccccactgagggagagtccccacggcagatgtttctacccgcgggaaatatgtcgccggagccccccgagatagaacgcaccccgggggctctacacaccaaggggatacacacaacaaacgagtgagacgtgagtaatgaagcaccactatgggcgccccaagcatgaagcccccggggccctcccatttttaaacccaaaaagtagccccgttttccccaacaaaaaa

SEQ ID NO: 556996 - DNA, 781 bp, Homo sapiens
  misc_feature (30)..(30): n is a, c, g, or t
  misc_feature (54)..(55): n is a, c, g, or t
  misc_feature (99)..(99): n is a, c, g, or t
aaggcattggacccggccccctcaagcatnagttaacagttctgcatggtctcnnctatgagtgagctaaggccctcacgatagatgagacattcaganatgtcatgcgtcatgtgcaaaaccctagtatcagacgtcgtcttcaaagccagagtcatgtctggatccaaagtgacatatcagttgctgcatcaagcagatagtgagaagagctcagccattaatgacgtaatgtctgtgcaagcgtgtgtctacacataatgttgagccgtatatgcgctcggagatggtgaagggagtctcacagtactgtgacgcttgtcagtagggtaaaatagagtctactagactacggtgagctcacgcagtagcacctcctgatgcgagtaatcgtgatgtgtttaggagtggcactttctaggggatttagcgggctcatgcctgttgcgggccagtgcccccctagtcgggtgggtaggggctaggatgcagtgtgtaaaaggctcagaaagatcccgcgaagatatattcttatgaggtaataaatagtactatcctgtatccaaggcctttttgcacaggtggtgtgtcgtcacctaggtatgtgctctctcgtgttacatcgccccatcattggtatctcccagtgtgttggttagccggcatagtatgaggagcgttatcgagtgccactggcatcacatggccagtccggagagtcattaggaggcctcagagggcccctggtagcggtcatggggtgggcttacccagatgatag

SEQ ID NO: 556997 - DNA, 156 bp, Homo sapiens
  misc_feature (44)..(44): n is a, c, g, or t
attttggtccgggatcctcctatatagggtgtaccaaggctttncttttgggttagtatttgtcctaatatatactttttctttttttcactttcattttatttttttattttatttttgtgttttgagacagtcttgccctgttgcccaggctgg

SEQ ID NO: 556998 - DNA, 101 bp, Homo sapiens
aaactgctgggtatcttaacaccatcacctactgagttcagaatgggcatctgaccccccaagccccatctctccctcacagcgtccgtagcggcctgggt

SEQ ID NO: 556999 - DNA, 133 bp, Homo sapiens
tcggggctcattcaggtactttactggagggtacatgagaaggtgcggtccctaggcccctcccctcttcaaggggtctacagggcaacggtgaggaggggagattcaggggggggggggacggagggtggca

SEQ ID NO: 557000 - DNA, 135 bp, Homo sapiens
acgtgccttttattcaactggtctcaagtcagctgtacagtagcctggctgcctccacccactcccaggtagaccaaatagccttcatacatctcgaagttgggggacacaaaagggggcagggggggcacgaag

SEQ ID NO: 557001 - DNA, 152 bp, Homo sapiens
atctagaggactgtatgttcgccaacaagcagtactcaggcaggaagactattacggggacactacagtcatggtggacaagtcctcagaaggcatgaaccagcaatattaccctgatggtcataatgattacggttatcagcaaccgtcgt

SEQ ID NO: 557002 - DNA, 335 bp, Homo sapiens
atgcgtgaatggccggcattcacaaagaaggtggcccgtgatcatcgtgcatttctgtgtgatccgaggaggcggaacaatgttcacggattccctgctggccaacgtgcatcggctgaaggagtaccgctccaaactcatcctcttccccaggaagccctcgttccctacaagggagacagttctgctgaagaactgaaactggtcaccccgctgaccggaccggtcatgcccgtccggaacgtctattacaagaagaaagctcgagtcatcactgaggaagagaagaatttcaaagccttcgctagtctccgtatggcctttcaacgcctccg

SEQ ID NO: 557003 - DNA, 765 bp, Homo sapiens
  misc_feature (379)..(380): n is a, c, g, or t
  misc_feature (461)..(462): n is a, c, g, or t
  misc_feature (464)..(464): n is a, c, g, or t
  misc_feature (614)..(614): n is a, c, g, or t
aggctggtgtaaatcggccgaggcagcttccatcgctgtgtgcggtcaacaagtgcgggcctgctcagcgcggggtgggcgcggagacctgcgaggcgacctgggagcggctgggttcccggctgcgcgcccttcggccaggcctgggagcctgcgccagtctggagcccccgtgcccagctgtggtcctgcctccctctcggctgtccaccttgccctggagtacttgccagctggtgcattgacctgaccacaccatgtggtgctgcctgcctgcctgtgctgctctgcagtgcctgctggatagaagaatgaaaaccctggctgcctgctctgaccctggagctgagtgatgtttgaccctggagctgatggatgnnttgaccctgatgtgatgtgaatgctgacctgtgatgttgacagagtgctgaacccatgatgttgatgtgatgtgcgaccanngnctgaaagataattggagccagtgaggtgacccgggacgaggagtcgacccggacgaggaggtaccaggaggaaatggcggcagctgggctcacctgtgactgtcacccacagcaatgagaagcacgaccttcatgttacctcccagcagngcagcagtgaaccagttgtccaagacctggcccaggttgttgaagaggtcataggggttccacagtcttttcagaaactcatatttactgggaaaatctctgacgggaaatggaaacaccgttgtcagcacttgaatacaagatggttgcg

SEQ ID NO: 557004 - DNA, 892 bp, Homo sapiens
gggcggcggggcggggggtcgaaagcggagtgaaagagggaggcaggagccggaaaagcggaaccggagtcgcagcggggaacccctgtgcggtgcggagggggcggggccccgattctgacccgcgcgggggttggcccatggcgggagatcagcgacctggacggcagatcgagcaagctgggtcgctgcgaagctcaatcaaggagaagcgaagtcaagggccctgggccgctaagggccagaagaagatctgtgctagacggagagcaacggtgcaagagggttgcactcgccagtccaacaggtgttggggcagcaccattccattgggacatttctatgacctcaaaagagcttgtcagagtttcggtatccgtgatcgcattcacaattgatcgggggcaaccattgagaagtctggcagattaagcaggttttatggtttctacagattgatttgctggacaaagtaggttcggtgcaattgtgttgcgctaactgaaagtgagatttttgataccttaagccgtgtagcaattatcggatggaaaatcttctggcgtgcaggtggcttttcccttcatcagacgtggatagattggaaatcggccgaagcaagagtgctcatgatggccatgttgtgaccttctctggttgcccaggaagaaccatgttggggttagcccgagacaggtaccatttggaatgggtgtggcagttaagcagcatgattgatgttgcgtccccactgtttgacgtacatggatcagaaaggcatgtgggacacactgcgtgaggccatggggagtcaatattgggccaaggccacggtaaggcacagtaacaaaaggcaatgctctctctatccaaaatacaagaaagaaaaaga

SEQ ID NO: 557005 - DNA, 547 bp, Homo sapiens
  misc_feature (547)..(547): n is a, c, g, or t
agtggccattacggccgggggccggggcgcggtggctcacgcctgtaatcccagctctcagggaggctaagaggcgggaggatagcttgagcccaggagttcgagacctgcctgggcaatatagcgagaccccgttctccagaaaaaaataaaaaaaaaaaaaaaaaaaaaaaaaaaaactttttggggcgcggccttgggcccctggaaaaagtttttaaacaccaactcgtggtgtgggcgcgcgcggggggccccagatggtgtaacgggtgacaccggggccaaaacgcggggtccccaaagggaagacccggggcccagcgaccaaggggctgtgggattctcccaccaatgtaaaaagagcgccgcggggggtgtgaacacaccgggggcgcgtcttgtggaacaccacagtctccaaaagaggggggactctccgggagggacatcataacgggggcgactcttatcacaagcgggaggagtctcacgagcgcggcgcccgcaaaatttcaaattttaggcccccggcttcgggggggtn

SEQ ID NO: 557006 - DNA, 242 bp, Homo sapiens
tgactctagagtatccccagtcgatcatcaaagtacggacacatcgtgatcagtggttggggagacggggagtggtaagaccactcagctgacgcagtacctgcatgaagatggttacacgtgactatggtgatgatatgggtgtacccacgccccggccgtgtagcatgccactatcagtggccaacgagagtcagtgaagcagatggggggaaactcttggcgagtgaggtgggcgtatg

SEQ ID NO: 557007 - DNA, 840 bp, Homo sapiens
gcaatgtctggagacatttttgtttgtcacaacaacggggatgcaactggcatttagtaagtagaagtcaagaatgccactagacatcctgccatccacagtacagcaacaaagaatggtccaaccaaaattgtcaatactgtcgatcttggaataaagaatcatttcaagtagaaggaagaatattcacaaaagcaaggcttatgtcctttgggaaattctgtgtggtctagtttgcctgaggtatagattatgtgaaagagcataagataagtgaaggctggaaggatagtttatgaatggatgcggacagatgttgatgtcagattaaagaattgtattttcttatttgttggcttcccaataccaactaataaaatatttcactggatgtaatgcaaattaaaagaaaaaattttattattcagtgttatttcaaatattcaatagatttggttctttttaaaaatttctttccatctcagtgtaaggaattaaaagggcctttggaaacatatacaataaatctttagaagaatattcctattatctgcagtttccttcaaacttacttacacagaataagagatcacttccttagataaggggctgggatttcttctaactttaagacctttccttgactttcctccattaaatgtttcactcatctttcaagggcatttccatggattaatttttagttacgcattaagtagtacggtaatatctaatatgggggtaactaattgtaatgggtcaaatttcgaaaggcggaagataaagtatagagggtgattatttttattgtcaattaactggttaaaaggttaaggaaaa

SEQ ID NO: 557008 - DNA, 367 bp, Homo sapiens
tcagcctcctgagtagctgggattacaggtgtgcacccagctaatttttgtatttttagtagagacggggtttcaccatgttgcccaggccagtcttgaactcctgagctcaaatgatccacctgcctcagcctcccaaagtgctgggattacaggtgtgagccaccgcacctggcctcctctagtctttagtggctctccactcctgactaaattaagttcaggctgtcatcagtgtggctcagcctaccttccagcttttctgcttctgctttgctttatttatttacttattttgagacagggtcttgctcagagacggtcccccaggctggagtgcacaggccaatcatagctcactgcatcc

SEQ ID NO: 557009 - DNA, 615 bp, Homo sapiens
gctttttttccttttcttttttaggattctaaatcacagcctaagcttactgaaacctccacctcttggggaactaattggctctcctggagggataggtaattgtacctgactacacaagctgtcccgaagctcccttggaaagctccagtaagcttttagtgttagcagccatcaaggatttcacaggtcaggcatcggatcgatacagctaaaagcagcagggactgtaatgtctacagcaggtttcaaaaaacgcttgaagggccaagttgttcctttttatgcagaagcttaagacagcttaaattgatgcttggctaaaaaccaattattccaaaagctcgtgactgtgcccttacaggcctttattggtgaaaccgataagaaaaaaaacctggtaactggccaacggctgaaaattccaattttcccccttttaatggctcgtttcagttaggggaggcaaagaaaacaatagttttcgggcggatgtggtcctcaaggacttaagaaaaaaaaatacctggaaaaaccaagaggggggaacaggggtccttaccttaaaccttggcgggaaaaaacctcaaattaaggcattttaaccccctcacg

SEQ ID NO: 557010 - DNA, 331 bp, Homo sapiens
aaagagcttgagaggctgaggtgggaggattgcttgagctccaggaggtagaggttacagtgagccgtgattgcattactgcactccagcctgggcgatagagtgagactctggctcaaaaaaaaaaaaaaaaaaaaaaaaaaaaacaaaaaatgggggagaaaaacgggaggaaaaaaagtggaaataagatgttaccttttcacatcacaatatatattgtttaatagtcacaaagtggtcctggaactgttcctgtaataagcaagggaaatcactttggggaatatgggtaatacacagaagtgtaaaacacactccagccccaatc

SEQ ID NO: 557011 - DNA, 232 bp, Homo sapiens
aacacgccgtaaagtcatgtggggccagttcagccagttctgcaacagggcagcccagctcacattttctcagcacaccacggtccaccacatcaacagctgcccagtgtcccaggcaggcacattccatggcatgctcgttacgtgcatgcgtgtcaggcgttcaggcaatgcaagcattttcattcagcattctcggcactcggcaacacacagccaacacagcacactt

SEQ ID NO: 557012 - DNA, 245 bp, Homo sapiens
cccgctcgggtactgtgactactagtttcagaatgttagttagatgatgcttgtgtgaactactcgttgcttctagtagcccttataattaaatcccccagcttgtgtttgcattatcagcttagagtgttaacatgtggtagaatgaggacttatacatcgtataaatgcgcatagcattttatctacttatgagaacaagtgcagtcagaagaaaaccaactggactctttattccacacttt

SEQ ID NO: 557013 - DNA, 795 bp, Homo sapiens
aaatggcgatactcttcggttctaacacatatatgttgggaatattaaatgtgaatctataccatacatgcatgtattaagatgcgacacttgagaaaactatacatgaacgcatggtaaccgcagcatatatagacatggatgctgacctgacgcaacaaataggcatacgattcctactacaaggacgccatctcattgctattggcatcggccaatccgattgagagaaacgattaaccattgtgacactagatcataattggtctcggtgcctttatggctctggctattatagctaaactacatcgacatgagtatccaatgagttcctaatccatataaagatcatcagtcctacatctgactccgtaatgatacagggtacataactctccctgagtggatagtcgttctcaatatatgcccgaggataatattaagcatgataatatatattccaagggtcactagatggtagagcagttcacacgttattccacaccgagacagaggcacgcgactacttggcacaactgtctagccgacggccctcgatgggtaccagagcaggacttctccacgcaatccaagtctcgccgaggagcacagataagcagaaggcaaggcgcagacacaacacagctaacacgagaggactcgggatcaagacaaggggatgggcaccagtcggaacaagaaggcgcccgaaaaccggccctcagtgaaaagacaagctgaggcacaagaggctggaagccaataacgggaacacacagacaaaaaacgcaagag

SEQ ID NO: 557014 - DNA, 987 bp, Homo sapiens
atgatataccgaacagcagaactactaattatatatcatccttctacataggtcccaacgattagtaaagcaactacgtattaatatgatccttagctgatgccttagaactcttaaaccaaacgagcctcctaaatacctcagcttaattggaattcaattaaaccctttttaaaattcaactgggcccggcacattgttgcgcatcttactcaatgcggatactcctactataataatgagaaccaacccttctacacttcctctatacctaatgctccactatacaaatcctcctgtaatttataatacattcctaatgccacatgatatgtacattcaatagtttaaatactcttcttctgaatacacgagcatgttatctccacacctttgagattattccaatcatgcacgagtggaggccatagcaaggccagaaacgccctgacacgtcaggctactttacgttccctaattactaccatccccttagttacggattcaccttccaccttactacagtcggatctattctttacatttcacaacatcattaggcatcactagaaacaattctaagtatctacaactctgcacatggaccgaagaattgatcaatactcctgatgcaacctaccttaatatgagtagcttacagaaatagcttttgtacgttagacaatagctcctagtacggactacacttaatgattcaactatgagactatgtgaaggcccatcgatgtgttcatagtagttgccgaagtaatcttaaactagggggtatgtatcataagcttaattatataatccttgagaaatgactgggtaccttcgtgttagtcctagaggatatttaaagccatgcggagagaaagataacaagtctggagagatataagacaggagagagtacagcaattcaaacatagagaggcgaaagaatagaagggagtcaaaataggaaaaaaggcgaaaagtaag

SEQ ID NO: 557015 - DNA, 433 bp, Homo sapiens
  misc_feature (13)..(13): n is a, c, g, or t
  misc_feature (35)..(35): n is a, c, g, or t
agtggggcaaagncgcaagctagggccgggggaantcgggatgatcttgaaacttgtccagcttcctgcttggcttttaaaagttatccccaggccagatagatgcctggtgcacgcctgtaatccccagtgctttggggaagccaaggccgcaggattacttgagccccaggagtttgagaccagcctgggcaacgtggcgagacccccatctctacaaagattaaaaaaaaatttagccaggtatggtggcgtgcacctgtggtactagcatcaaaaaaatgcaaaaatttgctgggcgtggtggcatgtgcatgtagtcccaactactcgggaggctgaggtggggggattgcgtgaagcccgggaggtcgaggctgcagtaagccatgattgcaccaccggcactccagctgatagagatcctgtctca

SEQ ID NO: 557016 - DNA, 143 bp, Homo sapiens
ataaagcctcacgtataaagccgcgcgaccagggccggaacggggggacgaaagcggagcaggcccaggggcgccgcccgaggggctgggcaaccttgctggttaacacctcccgcccaccccttagcgccctatacgggccg

SEQ ID NO: 557017 - DNA, 853 bp, Homo sapiens
  misc_feature (470)..(470): n is a, c, g, or t
  misc_feature (613)..(613): n is a, c, g, or t
tctgcaattcatgttgatgtgacagtgtacagtaaacaaatcatcttggcacggaccaacaagaacactggatagcatgtccatgaattctacttggcattcgagtatgatttatccacaaatagctaagagtaatgtggttacgagatacatgtataactcggtaattatcacaaaatagacaattgacatgaattgtgctgtggtcattcaatagaacttattatgacatattattagtaagttgaccttactaattatcgtatatatcgaagaactattcgtaaactatgtataaattcagtgtttagataggtgaagtcacgaagtatttctaaggattctatatcagtgcggaatgaggtcagtcaatgtctcttttgagaacactaatcccattgaattagcaccgttatatacgatctagagcattttaggttgagttaatgggctaccaccttcttcaaacnaatataccaaatacattcacttttcgtatctagaacggtgataagcgacataattctatctcatagaatgatacttctttacaaacaatgtcataagtttccaactcgacagactgcacttactatactaagggatcacttgntaacccattatcgaaaattggccattcatgatatttgaccttgatatatactggatagagactttaaaatgatacgttactcacatatacaaaaaaggttctacactcatcatatcaataatgcgtaatacagctaatgtgattctgtactacacagtaacggacttacgggttgtcgatttatcaccactattgcacaatcgttgcactttatggactgcaagtttcaaagttaccaaa

SEQ ID NO: 557018 - DNA, 143 bp, Homo sapiens
gatatatcatggattcgaagatgaatatagtggcatccatcatcaggatcactgctatgcccttatccagaatcttcactgcccctttgaacacctgctgataattataacaggcagccaaagtggcaatggctatcaaccag

SEQ ID NO: 557019 - DNA, 864 bp, Homo sapiens
  misc_feature (45)..(45): n is a, c, g, or t
  misc_feature (77)..(77): n is a, c, g, or t
  misc_feature (97)..(97): n is a, c, g, or t
  misc_feature (105)..(105): n is a, c, g, or t
  misc_feature (109)..(111): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (147)..(147): n is a, c, g, or t
  misc_feature (150)..(150): n is a, c, g, or t
  misc_feature (154)..(154): n is a, c, g, or t
  misc_feature (161)..(161): n is a, c, g, or t
  misc_feature (164)..(165): n is a, c, g, or t
  misc_feature (178)..(180): n is a, c, g, or t
  misc_feature (190)..(190): n is a, c, g, or t
  misc_feature (219)..(220): n is a, c, g, or t
  misc_feature (224)..(224): n is a, c, g, or t
  misc_feature (230)..(230): n is a, c, g, or t
  misc_feature (244)..(245): n is a, c, g, or t
  misc_feature (271)..(271): n is a, c, g, or t
  misc_feature (299)..(299): n is a, c, g, or t
  misc_feature (339)..(341): n is a, c, g, or t
  misc_feature (343)..(343): n is a, c, g, or t
  misc_feature (345)..(345): n is a, c, g, or t
  misc_feature (348)..(348): n is a, c, g, or t
  misc_feature (350)..(351): n is a, c, g, or t
  misc_feature (359)..(359): n is a, c, g, or t
  misc_feature (363)..(364): n is a, c, g, or t
  misc_feature (367)..(367): n is a, c, g, or t
  misc_feature (385)..(385): n is a, c, g, or t
  misc_feature (395)..(396): n is a, c, g, or t
  misc_feature (404)..(404): n is a, c, g, or t
  misc_feature (413)..(413): n is a, c, g, or t
  misc_feature (418)..(418): n is a, c, g, or t
  misc_feature (420)..(420): n is a, c, g, or t
  misc_feature (432)..(432): n is a, c, g, or t
  misc_feature (446)..(446): n is a, c, g, or t
  misc_feature (460)..(460): n is a, c, g, or t
  misc_feature (462)..(462): n is a, c, g, or t
  misc_feature (472)..(472): n is a, c, g, or t
  misc_feature (478)..(478): n is a, c, g, or t
  misc_feature (486)..(486): n is a, c, g, or t
  misc_feature (500)..(500): n is a, c, g, or t
  misc_feature (530)..(530): n is a, c, g, or t
  misc_feature (542)..(542): n is a, c, g, or t
  misc_feature (549)..(549): n is a, c, g, or t
  misc_feature (626)..(626): n is a, c, g, or t
  misc_feature (841)..(841): n is a, c, g, or t
ttttttatatctaaaaatatatcttaataatctttcactcaaaanataaatttattaattatatttcattttctttncttttttttccacctttttnctaacttntttnnnacactcctaaaaggtcatatttccntncnatcaaanagncagncccgcanccnngccatgggcactnnngatggccgcngttaataattcaaagcggaagaggccccnncctnggcccnggcagccccgctcnncatggctcttttgcttttcccctcanatcctggttcatttactttttgagcatntaaaaacctctcccatgacagctagaactccacccccacnnntncnccnannggctctcngccnnctnttcccatcatttccatcncctccttctnnatttctcntttttagtntcctntnttcctgcctttntccacttcacattnagcacacgctatananccgcactgcnttttcnagctcatngcacgttgccacanctcttctatcccgactccacggtggctgcnttacggctcacnttcactnttaggacacttgggtttctatagacagtgcttgggcaaccctttgcctacacaaaatattctaataataaacaagantttccatcaactagcggtgatatgttaatacgtctgccgcactcagaggcctgacagagagcagacacgggacagttacagccgccgccgaatcaggtggtagaacccatgggtgcagggacacagggttgggcgggcccagccgcaataggtactcagttctgtgaggaggggagggacatgtttaaccacgaaagggccacactgcaggacanatacagagggcctttgctgcaga

SEQ ID NO: 557020 - DNA, 86 bp, Homo sapiens
  misc_feature (49)..(49): n is a, c, g, or t
gatcttccagagaagggaacatctgtcacagacaatgactgtatctgtntagatatttcttatttaataaagacgatttgtcagtt

SEQ ID NO: 557021 - DNA, 320 bp, Homo sapiens
  misc_feature (118)..(119): n is a, c, g, or t
  misc_feature (126)..(126): n is a, c, g, or t
ccagtttggtccaaaaaaccgggtggggccgggccgggatttccggggtttttttgccccccggggtccaaacccccgggagggggtttgtgggcaaacccccccgggcccctttttnnctgggcngggggttaaagggtaacccccccccctttcttttaacccagggggttttcaatccctcccggcccttttttggggggcccccttagggtggtagccccttaaaggggccgggactttttttttggggggggggggtttttaaatggggggttgcccccggtccccccccaattaaaacctttttcttttttcca

SEQ ID NO: 557022 - DNA, 343 bp, Homo sapiens
aaaacggggtttccctcccccctggggggggggggggcctttttttccccccccccccggctttggggggtggggcttgggggtcccaaacttttgggggttttttaaaaaaattttttggggggttttttttttttttttttatcccccgcttttttggccttccccctttggggggtttttggggtacctttggggggtgggccccccccccccgggggttcccccccagggtttaccccccccgggtgggggccctttttcccccgggcggggggttcggggggttttccctttccccgttttcccctggtttttttaaaaaaaggggggtttggtttta

SEQ ID NO: 557023 - DNA, 300 bp, Homo sapiens
ggggggggggggggccccaaaaggggccctggtttcccccctttttggcccccgggtttttttcccccccccctttagccccggggccccggggggttttccccctttgggtttttcccccccccccgggcccattttagcccggggggggggggggggggggggggccccttccccccccggggggcggggggtttttcctccccccttttggggggttttttttttttttttaaaaaggggttttccccccgggttttttttttttttttccccaaaagggggcccggggcccgggga

SEQ ID NO: 557024 - DNA, 270 bp, Homo sapiens
gggaagctcggacactctcgccgagctttccgtgcacctcgcgatgtctgcagtatcctccgcttcctctcctaggcgacgagacccatgtgcgctagaagttccaccgtgtctttatctctctacaggatccgatgcctgggtagatcgtttggactctcgcgcggaatccacggttgttcgatgcgttcgatctcttcatctcccaaacggtctctctccaggagctgctcgtgcccgagctggtgcttcgcacgtggtgatctactc

SEQ ID NO: 557025 - DNA, 1120 bp, Homo sapiens
  misc_feature (29)..(29): n is a, c, g, or t
  misc_feature (59)..(59): n is a, c, g, or t
  misc_feature (62)..(62): n is a, c, g, or t
  misc_feature (66)..(66): n is a, c, g, or t
  misc_feature (78)..(78): n is a, c, g, or t
  misc_feature (134)..(134): n is a, c, g, or t
  misc_feature (148)..(148): n is a, c, g, or t
  misc_feature (151)..(152): n is a, c, g, or t
  misc_feature (193)..(193): n is a, c, g, or t
  misc_feature (195)..(197): n is a, c, g, or t
  misc_feature (207)..(208): n is a, c, g, or t
  misc_feature (213)..(213): n is a, c, g, or t
  misc_feature (215)..(216): n is a, c, g, or t
  misc_feature (225)..(225): n is a, c, g, or t
  misc_feature (227)..(227): n is a, c, g, or t
  misc_feature (247)..(247): n is a, c, g, or t
  misc_feature (256)..(256): n is a, c, g, or t
taaaaaagtaagcctttatttcctggttnggcaaataaaacgggctaagtgggtggctnttngggngattagtcaagnagaccaaatcccatatcctcgtccgactcctccgactcttcctgtggttcaacctnagcgggggctgcancanncaacaggagcagctggtgggtggcagcagccacgggggcangnnnccacaaaggnngagtngnntcagccaananggcctgaccttttcagcaangtggggaangtggtaatccggctccaggagacaaggccaggacctcgttggatcacccgtgtgactgattagaactggggtacgtgatgcaacagctggggatagccaatcttgcagaaccgacccgtggcaacctttgcggacaccctccaggaagcgaaaatgcaaagttacctcgtgggatcatcaagcacttcagggtggcaacactgctgccatggtcgaacacctgctggcatgaccagcccaaaggacaacagggggacgcatcgttcgagcagtgtcagccacgtggctcgactggctcccacttggcctccagacttgatcagctgcccatcaaccaggatccacacggtgccctggagatcccagcggtgataccctaaagcctggaaaaacggaggctcacccgggctcgagaacaagtgtgcaggcctggccagatagatccccatggggcaatggcccacgacgcacacacgctggcacttatggccaccacaatgtcccgattccggaggccccctgccacaccaaaagcccactatcccccgagatatgagcacagcttaccagaaacgggtcggtccaccagggcccccggaagtgcgtaccccaaagggtttcgccctaaaacccagccctcccgagagacaaaggcactccgcctctcggtgagaccccactgtggcccccacgaaccgggagaccccaccgcggaccacgcaccacaccaacacgcgccccccgacaccagcaacagcgatcgcccgcaacaatccaccaggaaaacccctcgcgcagaaagaagccaccccacggacacgcagaataccgaccaccgcgcaccacacgcacgcacacacacaa

SEQ ID NO: 557026 - DNA, 412 bp, Homo sapiens
  misc_feature (20)..(20): n is a, c, g, or t
  misc_feature (53)..(53): n is a, c, g, or t
  misc_feature (108)..(108): n is a, c, g, or t
gggagagctagataggggcntaaatcaatcgctgctacttgataacttgaagnccatcttctgttctgacttccatagatcaacttatatattgtctaagaaattgtncattgtataatttgaaacgacatgcagtgaaaagtaagaacaaaactatttgttttatctgtgtgtgcatgtgtgtatagtgttaaaagttgtaatgtcaacaggtcatggtggcacgcacctctactcccacctactcaggaggctaaggcaggaagactgctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcc

SEQ ID NO: 557027 - DNA, 384 bp, Homo sapiens
cggcggcctcctcaccagccaaggaagaagaaatcaggacaaagacgcataacagagggaagaccatgggaagacacagtagatggccaagaagagacccctcagaagaaatcaatcttggtggcgcgtggtgcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaatc

SEQ ID NO: 557028 - DNA, 172 bp, Homo sapiens
tccccctactggtggggtgtgtgtggacactgcaacaacctgcctttgtcagcactccaatactattttatctgttaatctcaccaggctcgggctgcaaactcgacggtgagctccgtgccaagtgtgtaggcaatgtatggcgccagtaccaggctacaggctttctttg

SEQ ID NO: 557029 - DNA, 1423 bp, Homo sapiens
  misc_feature (111)..(111): n is a, c, g, or t
  misc_feature (181)..(181): n is a, c, g, or t
atctgtaggacgtgctcaagagggaatactagaggattatcgtatataaattcagagatgatactgttcgaaggatttgattggagagaacttggtagacaaatgcatggntgacgcaatgagtcgcatgagaacttgcggaaagacatgctagcaaggaatagtgcatggaggtatcggngtaggaaatggtattaggggagtagagaggcattgtaggagtaggataaccttgggataagagataatatcctatgttaggattcaactctatggatttacaaatctatttattgtatatcgaatcctgtcgatacttgcattgggatctctgtaattagttaggtcgtccctatcacttagttatagagtttgtaaaccgttgtcatagaattgacacacttgttgatacagacacgatacacttttagaacacaaatgggttccacgagctatgaggactatatctggctcatcgacataggggggtgctctattgccgagcaccaataacatgtgctctagggggtgcaatccatctattatttttgcgggccacggttctactataggtatcctagaaatgggttacacaccaagaaatgtacgtagtatctaatctagaaagagttttgggcaagtaatttggaggaggatatttgcacaagggagatggcgaaacaaaaaaaacgacatggtggggacggcatattaaatatctcaccttagtgggttcttttagaccatattttaacgttggggaacttattggcaacagttattatactaaaggttggtacacgaacgggaccatttacaacgcgaatctataaggagtggtccaacagaccacccgcgcaacaattattggtggttattcccaaaggcaacacccttcaaatctgcagggggaaaaaacacttctccccataatttttcacaataaaggcacacctctttccccctacagttggtaagattaaagccaacactttggtcctctttagcagcggggggaacatattcaccccattggggaaagtgtggccttagaattccgtgattagacacaatgcccggcgaataggcattaggagatgggagtgtggtaaaaacccccatataaacgcgcttggtggagcggacaggggttaaagccccctagggatcttccgcgtgacccaccgcgaatataagaccaaaacacggttggtgaggtatccacgctttcctgggcccatataacgacacaagtgtgggagcaggacggaactacttctcggcagaatatggttgcccaccactgttgtcctcggcgagagggtatcatcacaaagcagtttattcgcgcgctttacacccctcaagttttggggtgtcgtccccccacattttgtggcataaccacaacagttccacttgg

SEQ ID NO: 557030 - DNA, 436 bp, Homo sapiens
  misc_feature (17)..(17): n is a, c, g, or t
  misc_feature (126)..(126): n is a, c, g, or t
  misc_feature (129)..(129): n is a, c, g, or t
  misc_feature (182)..(182): n is a, c, g, or t
  misc_feature (195)..(195): n is a, c, g, or t
  misc_feature (199)..(200): n is a, c, g, or t
  misc_feature (257)..(257): n is a, c, g, or t
  misc_feature (284)..(284): n is a, c, g, or t
  misc_feature (326)..(326): n is a, c, g, or t
  misc_feature (331)..(331): n is a, c, g, or t
  misc_feature (335)..(335): n is a, c, g, or t
  misc_feature (373)..(373): n is a, c, g, or t
  misc_feature (391)..(391): n is a, c, g, or t
  misc_feature (425)..(425): n is a, c, g, or t
gtatgtttcgaaggggntttggttctttttgcttctgttttcttaaacatgttttcccctcccccttgggccttttggaagctggtcagctagcaggttttttgggatgtcgggagacctaaatgnccntatcgggggcaatactagctaaggtaaagctagaaacctcccctgtccctttnctgagatttttgngganncttttcatattgccttaatgtagcagtaatgggtttatgcctttgtttctttgcccngcccttttgtccaatattaaaactctncttttttatggcccatattagcatataagcctttattcccanagggntttnttttttcccttgtaaaaaaataatgtttccccgtaaanaactctgttatatcctanagggctctgttttttatattcgggataataaagnctttaaagcca

SEQ ID NO: 557031 - DNA, 130 bp, Homo sapiens
actgccaccggagaagggagggttcgatccttggcctcgctcagtgggttaaagatccggctctgccgtgagctgtggtggaagtcgcagacgcggctcggatccacactgccttctccggtggcgtggt

SEQ ID NO: 557032 - DNA, 282 bp, Homo sapiens
acacatctgtactcccttctcacatcctcctcccaggcaacccaggtaaatcaggctgggcaggtgaggttgaggggactgagcttcaggcaggggccataataataatgatgatggcagaagtgtgaggctgtaggacacacgggtcagtgctggagcagccctgcagggggaggggcaagggagggctctggcacttgggaccctggcgctgtcactgttccccacacttggacttctccatgtgcacggtcatggtgcggaagcagagatgccttccct

SEQ ID NO: 557033 - DNA, 350 bp, Homo sapiens
ctgtatttcagactgtgcaacacgagcgaaactccatatcaaaaaaaaaaaaaaaagtgtaatctttaaattgtgcatctatatcctatgacttcaaattttatttatcactctccttaaaggctgaagaaaatgattaatttactatagctccaaagacaacacagtcccactgtcataacatttagtatgaagtgccactctcctgtttgaattaagaacaggccgtatcaaactggcccggaatctgattgggttcctgggctcaaaataaccgtgggtttgtgaatacacacttagacacacaatttctctgatgtgtgtatctatcttacacagcgctttaccgg

SEQ ID NO: 557034 - DNA, 221 bp, Homo sapiens
  misc_feature (109)..(109): n is a, c, g, or t
gggttagaaatgagatggaaggaagtggaaggcagagggcatggcggagttgtgagaggctacagcgtggacgcgagcggggcgggacgggtgtgggaggtggtctcanctcttgggaaaactgcttgggaccggtcgtcgcgcctgaacggtggttctgtaccctgctccgaggtgtgcttagcgattggcctggaaatcccggcggcgccaggccattc

SEQ ID NO: 557035 - DNA, 267 bp, Homo sapiens
gtctccaaaatgggatccatgatggttacagatgaatgaccactcactgctttatattaaccatgagatagcagagaatacgatggcacttatactgatgggcagatgaccagatgaacatcatcatcccaagaatatggaaccaacgtgctggcatcaatagattgttcccatgtgatgtaggcattcctgccatccatagggcacattggcttcagcacacaggtaggccaaacaaggacatactagcccagtccaaaccagtac

SEQ ID NO: 557036 - DNA, 362 bp, Homo sapiens
acgaggaggacaggggcggggggcggcatgattgtaacctggattgactccgagaacccagatggttcacatattctgaccagctcgcctgcatggtggattcccttgtgccactgcacatcatgctcgagtgacactatcgtctgagccgccgtccagcctgttgacactgtctactattaaatgaatcccatatatggactatgctaccgtgactgatatagcattaatcactacgctcgtctgtaccatggactatgtcagctgcatggcatggtcgtctgatcaccatcgcattgcagcctttactcactatgctacttactgaggtctactcttgcagtacacattagtgcttcagg

SEQ ID NO: 557037 - DNA, 437 bp, Homo sapiens
cgagagagtgggagaactcgcggaaggtccccgttcccacagcagagtctcatgaccccacagacttcagagaagcttcttttccccggcaagcagaagatcttgcaaggctgccctctttctgacccacggagctgtgggatagcacatgggagacaccccagtggtgagggcacctatggcagtagtggacatagacgcagaagcgatggaagcgacgtctctctgcccccttctctcctctgttcctgtaatgagcacatactagttggtgattcttcttatatctgtaaagttccaagtgaatatactcctgagtcacgtttcatatggtgatgcactcgtaacatggctaatctaagttggaatctctcccctaatatgttcttcccagtactactatgtataaataaccgactctgacaaaataataaaac

SEQ ID NO: 557038 - DNA, 410 bp, Homo sapiens
gaccgattgatgcccaacgttggctgacatatttagtctgtcaggccaggagattttgtcgcctgcttctggagcacattaagaggatgctagaaaaatcaagcttgtccgcttctgcatgcccagcttgctagatgcaccgaatttaagagaatcggggacttcaagttaactacgtagatgtgtagttccaaatgcctctagcctcgacatgaatcccacctttgcccccttcctgttagggctgtttaaaagaggtggctgcatgtcactattacccccctccccgaatgagaaaaggatcaggtttccggaaactggatcagcttctcctcagttaaagaggaaacgggaagtgggcagctggccttctgaccaggcacccgtttgaaccggcggtgacggcgtga

SEQ ID NO: 557039 - DNA, 644 bp, Homo sapiens
aaaaatgaaaataaaattagccgagcgtgatgcctcagcctctctagaagctagaggattgcttgagtccaggagttcaagattacagtgagctatggtcacaccactgcactccagcctgggtgatggagtgagactgtctcaataaaaagacaaaaaggctggccaggggcagtggttcatgcctgtaaacccagcactttgggaggcaaaggcaggaggattgcttaagcccaggaatttgagatcagcctggacaacatggtcaaggaagcttttcctgatccactaactaaggacaatcaaacccttcatgatctagaatctggagactgtgtcttctgggaatagtatcagagaaagactgcccttactgcccacatgtagcaaaactttgagacgttgaattatgggtccataatctcacaactcagaggggcacctctagactcttggaactgtatatctattggagactttaaggtaaagctgaacagagagacgtttttctccagaagcagacagcaccatagtcatggacagctttcccaagatcacagatcaagacttctctgccgtcatgagactcataacctcttaattttttcttgcttatgcttctgtgaacaaaaaaaagaaaaaag

SEQ ID NO: 557040 - DNA, 317 bp, Homo sapiens
tacggagtaggtgtcatttcatcatgcccatttcatggattaagaatggaggcacagggtgtttaagtaccttgcccaaggtcacagttggtgagagcggagccaggattcagccccaggccgtctggctccaagtccacgtgcttaaccaccatgccacattgcctctcctcatcccacagaagcaacaatctgtccttttaggggcagccgcaggagaaggggtcccagcccttccctggaggagtacgggggagcagctggacctcaggtgacccatcctcagcacaaagcctgtcttcagtgccctctgtctg

SEQ ID NO: 557041 - DNA, 661 bp, Homo sapiens
gatcagctcgtccatatggtggacgagtatggtagcttggtgttttggaaagtgctaacaagcccataatctctaaatggactgtggtgtaatgacggaaatataaacagcataaagtattatagaaataacactatctaaatgggatagtcaaagcttttaagacagatgtcagcaattctgtaacctgggcaatcattacatacaagtatactttatatgctggccagactattaagataattcagtcttagtgtagccattcttcatgtatctaatgtacattaacacatgacgggggaatatccaagatatctagaagctagacccaaaacagtcttaagctactctgagacaaataccacaaacagaagtgcccagaatttctagtgatgtctcggcctaatgaaagacctatacagttaattgaacggtctctaagcccttctcagaaggctgattttacccagattaaatccaaatccaatatggtgtgactctttatatcagcccagaatttagagtaatggattggctttggtcagtaacagagttagcagggtgagtcagcagcctctgaacccctcaggtaggaagactgtcgaaggtacttaaaaaagcctttattactagaagactgaatgagattaacttaaaaaaa

SEQ ID NO: 557042 - DNA, 408 bp, Homo sapiens
  misc_feature (302)..(302): n is a, c, g, or t
  misc_feature (305)..(305): n is a, c, g, or t
acatacccatcatcccctggctaattatatttattttttgtagagacagcgtctcactaatgttgcccaggtcagtctcaaactcccagcctcaagtgattctcctgccttggcatcccaaagcactagcattacgagcatgagtctccatgctcagccctatttagatgtctttatcttggtttatcaatgctgtctcctttgcctcctagtactcgttcttacgtctctttatgctggaacaaattcttcctcccatgagggctcgcagaacaccaaatgctgagaactgtttctccatnctntctcgctttggactttgaagactgagtcctcattaattgtactcctatagctctagatatctgccttttaaattgttaattacttgaaatttaaagaggtttc

SEQ ID NO: 557043 - DNA, 105 bp, Homo sapiens
gttacagcagtttgcagataatgatgtgtcaagattcaaggcagttaaggctcgttttgcaaaccagtatatccaggacaaactctacaaatgagatgtggaagg

SEQ ID NO: 557044 - DNA, 286 bp, Homo sapiens
cgtgaacgcagcctgctgagtagctgggactacaggcacacactgccacgcccagtttattttttgcattttagtagagacggggtttcaccgtgttgcccaggctgttctaaaactcctgaactcaggtaatctgcctgcctcggcctccccaagtgctaggattacaggtgtgagccaccacgcccggcctttttttttttgtgctttttggagagggggtttcactctctttccccaggttgaagtgcatcggcggggcctaagttaactgaaacctgtgcct

SEQ ID NO: 557045 - DNA, 337 bp, Homo sapiens
catgtacattttagaataggtttttttaattcatgaaaaatgagattgctattttgataggagtggtggtgaatctatagattgctttgggaagtatggccatttttatgatattgcttcatccaatccatgagcaggagtgtttttccatttgttgtgttatctgtgatttctttcagcaatgttttgtagttatcctcctagagatctttcaactccttggttagatgtattcctaggtactgtgtgtgtgtgtatatgtgtgtgtgtgtgtgtgtgtgtgttttgtttcagagacagggtctcactatgttgcccaggctggcgtcaaactcct

SEQ ID NO: 557046 - DNA, 176 bp, Homo sapiens
  misc_feature (161)..(161): n is a, c, g, or t
gtggctgtagcacacacgtcatgaaccagccaggcataggccactgcgagatgtgatgctcccagactatgggctgctctgctgtatgactgggccagccagtccttctgaagccagaagcgtgctgagtgtgttcctgtaactgccccaaagtgggcagncctggaggaacaagg

SEQ ID NO: 557047 - DNA, 538 bp, Homo sapiens
  misc_feature (456)..(456): n is a, c, g, or t
  misc_feature (467)..(467): n is a, c, g, or t
agaattaaatgatggtcactccattcctgtcctgggctttggcacctatgcaactgaagagcatctcaagaaaaagtctatggagtccaccaaaatagctatagatgttgggttctgccatattgattgttctcacttgtaccagaatgaagaagagataggccaggccattctaagcaagattgaagatggcactgtgaaaagggaagatatattctatacttcgaagctttggtcaacttcccatcgtccagagttggtcagacccagcttggaaaattccctgaggaaacttaatttggactatgtagacctctatctcattcatttcccagtgtctctgaagccagggaatgagcttttgcctaaagatgagcatggaaacttaatatttgacacagtggatctctgtgacacatgggaggccatggagaagtgtaaggatgcagggctggncaagtccatcnggggtgtctaactttaaccgtagacaactggagatgatcctgaacaagccagggctcaagtacaagcctgt

SEQ ID NO: 557048 - DNA, 325 bp, Homo sapiens
  misc_feature (8)..(8): n is a, c, g, or t
  misc_feature (10)..(12): n is a, c, g, or t
  misc_feature (31)..(31): n is a, c, g, or t
  misc_feature (240)..(240): n is a, c, g, or t
  misc_feature (259)..(259): n is a, c, g, or t
agctacangnnntggggattgtggatgtgtnttgacacctgggtccctgtcccccagtgatgacaaagagcaaaggcacctgctggcccacgctggacacacatgtgagaaagacatgcatctgtgaagtgctcagctgctgtggtgtggggctgtttgttacacagcccagccaagcccagcctgactgatacactccctcaagcatgaatagggctctgctctccaatgaggggagtngggcccagggctgtttctnaacgatgtccagaacaccttactcctaggtgccccagaagcaatgacaaggaaacaccacaggagg

SEQ ID NO: 557049 - DNA, 160 bp, Homo sapiens
  misc_feature (68)..(68): n is a, c, g, or t
ccggccacctcagacaacggcaaagacggcctggcctacttctgcccctgctcaagaatgagctgctnggtgccggcatcgagaaggtgcaggacccgcagactgaggaccgcagcttgcagccctcccacgccctgagaaagaaggggtctgtttcacg

SEQ ID NO: 557050 - DNA, 598 bp, Homo sapiens
ggggttaatgctcatcccgcgggtctcctcctgtgcggtcctgcagtactttgtccccgggtacgagggatcttctgcagaagatagcgctggaagctagagtgaggcctgagtacggccttggctacgtgatggctagagcaagttaagtgaaagcacagccctggatgcccaggctacagaagatcagatggagcttcgtggtcataagaggtggagggaagcaatgaatgcctggttgttcccagtagcccggatctgggtatctgagggctcccgcgagcgcttccgaggcttcgcggtagcgccggaggctgcgggcccccgcgatggcgcgtgagtcgggtcctgagatgctctgccgacagtggttgcatgcctgacgatgcccatgcatggctgccagttcctggaggctgcgtggtgctgggggctagttcctggcgcatcctgccggggattctgctagagctgggtgctgggatcgggatccagatggcggggcaggaaggtgcgggtgctagagggatgtttgtggatgagggcagctgggttagccggggaagcgtgttgcaggtgttgaccagggcaacaaccg

SEQ ID NO: 557051 - DNA, 697 bp, Homo sapiens
aggccccagacttaataccatgtcttcaaacaacgatgtggacaactgaagcagcaagagtgccctgcaatgtagatagtttatctcccttggtggacctatcagtgccacgtcgccagtttctatggcataggctgacaaaggtacgatgtgcaaaaccttggaaatccacagagcacacatatagggtctcagccttgacccgggaatgcctaatcacgcaagctgatcgcagtgcacagacacgtattctagtaccttcatcgatcgatccatacactggagactgggactccttcacactacttggacctgttatcgtgggtcttaccaaacacattcttggaaacagcgtgccttggcttaccttcgacagattaccctaagcccatactttctcagtgcatgggacgcaacgtggttggcttactgccaattccacacacgcacacacccgtgggtaggagccattccgactacagcatgtggccccgaccacttgaagctccaactactttaaagccttaactatagagcagagagcagagcttaacacgtggttagccccatgcaacacagcatcaataagctaaatcgacgaggcacaacaggtgataccatgatgagttagacgccacatacccacaccacccttagccaccagaacccggaacggcgctgggcgcacgcaatattt

SEQ ID NO: 557052 - DNA, 161 bp, Homo sapiens
gctcatagaggatctcaggattcgtagatccggttgggcgactcggagcagaaccacactccgagcagtacatgctatgacttcaccagtcaaagcgaactacatatactcaatttgatccaattaactttgaccaaatggaaacaatgtttacccctagg

SEQ ID NO: 557053 - DNA, 435 bp, Homo sapiens
tttcccccgacagtagaggactccccctcctgttgtcccaacacgattgctgtgactcaaactctccctaatgctgcttagtataaccgtctatgcatatgctaatgttagcttgcaaagaatatggacatttgctgtggatcacaatggattgcgggttatttattcaactgaagtccagcactggcaacatggtgattattatactcaatgacaccacacttcaggtgctaaacacttggtataccatgcagtataaaccatctgcttctaacgcctccatggtatgtgcggttctgtatgccacccgtactatgaacaccagaaacagacagagatttgttactattatgacacaaacacagggaaagagggcaaactagacattgtaatgcataagatgcaggaaaaagtgcagcacattaactataaccc

SEQ ID NO: 557054 - DNA, 155 bp, Homo sapiens
  misc_feature (155)..(155): n is a, c, g, or t
cggatccttcgtatatgtatcaaaacactgtactctaagctattgaataaaatatatcaatttaaaacttataataaaatatataggtcatatactttattatttcatgagtaaggcaaataatgttatgtggatatcatgttacatattacggn

SEQ ID NO: 557055 - DNA, 474 bp, Homo sapiens
ccacgcgtcgccccttgaagaggggaggggcctacgtggagccgcagcttgtcatgtaccatcaataaagtaccctgtgctcaaccaaaaaaaaaaaaaaaaaaaaaaaaaaaaaaaaaagacaaaaaaaaaaaaaaaaaaaaaaaaacaaaaaaaaaaaacaaaaaataaaaaaaaaaaagaaagaagaataaacatagacacacatacgaagagaaatagaggcggaggaggaggggccgcactattatggtctcaaccgggaacacgacctaatcccaaactccacgcaccatttttaggatgacaaagtagacacagatctcgatgtgcagtgtttataaaaaaacagacaggcacacaaggagaccagaacgatcattaacaccatgtaggctaggccgcagccacgacatactaccgcagacggacaccgacagtcagatagcgacacacaccatcacatccaagagt

SEQ ID NO: 557056 - DNA, 231 bp, Homo sapiens
  misc_feature (231)..(231): n is a, c, g, or t
gtgaagatcctggtgtcgccatgggccgccgccccgcccgttgttaccggtattgttagaacaaggcgtacccaaagtctcgcttctgccgaggtgttccttatgccaagattcgcatttttgaccctgggcggaaaaaggcaaaagtggataagtttccgctctgtgtgccacatagtgtcagatgagtatagagcagctgtgctctcaagcgctctgaggctgtcccgn

SEQ ID NO: 557057 - DNA, 1072 bp, Homo sapiens
  misc_feature (190)..(191): n is a, c, g, or t
  misc_feature (194)..(194): n is a, c, g, or t
  misc_feature (1037)..(1037): n is a, c, g, or t
  misc_feature (1039)..(1039): n is a, c, g, or t
  misc_feature (1049)..(1049): n is a, c, g, or t
agcggagtggctccagcaaccacgcggctggggtgcgccgggaagggagctggatgttttagcctcggggcgcacgctgcgggcccttcgtgttccggacgctaaacaccgagagcaccccgtctccggggcctccggagaacgctgtcccatgaacgtgcggggagcggcccccggcgtccgcgcgtcnncgngtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaggaatactgcaatttgaaaatgtttcttatggaattgagcctctggaatctgcagttgaatttcagcatgttctttacaaattaaagaatgaagacaatgatattgcaatttttattgacagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagattctacagtggtgaaggcagatgaatttttgcacaaattttagaatgggaanancttattttanctaaagggctgagattgggatat

SEQ ID NO: 557058 - DNA, 949 bp, Homo sapiens
  misc_feature (190)..(191): n is a, c, g, or t
  misc_feature (194)..(194): n is a, c, g, or t
  misc_feature (914)..(914): n is a, c, g, or t
  misc_feature (916)..(916): n is a, c, g, or t
  misc_feature (926)..(926): n is a, c, g, or t
agcggagtggctccagcaaccacgcggctggggtgcgccgggaagggagctggatgttttagcctcggggcgcacgctgcgggcccttcgtgttccggacgctaaacaccgagagcaccccgtctccggggcctccggagaacgctgtcccatgaacgtgcggggagcggcccccggcgtccgcgcgtcnncgngtccctggcaattcccgacttcccaacggcttcccgctggcagccccgaagccgcaccatgttccgcctctggttgctgctggccgggctctgcggcctcctggcgtcaagacccggttttcaaaattcacttctacagatcgtaattccagagaaaatccaaacaaatacaaatgacagttcagaaatagaatatgaacaaatatcctatattattccaatagatgagaaactgtacactgtgcaccttaaacaaagatattttttagcagataattttatgatctatttgtacaatcaaggatctatgaatacttattcttcagatattcagactcaatgctactatcaaggaaatattgaaggatatccagattccatggtcacactcagcacgtgctctggactaagaagcctgaaagaacaaccaatggatgacaacatttttataagtgaaaaatcagaaccagctgttccagatttatttcctctttatctagaaatgcatattgtggtggacaaaactttgtatgattactggggctctgatagcatgatagtaacaaataaagtcatcgaaattgttggccttgcaaattcaatgttcacccaatttaaagttactattgtgctgtcatcattggagttatggtcagatgaaaataagattctacagtggtgaaggcagatgaatttttgcacaaattttagaatgggaanancttattttanctaaagggctgagattgggatat

SEQ ID NO: 557059 - DNA, 1051 bp, Homo sapiens
cttcccacaacactttctcggccctatccggaatgccccgacgttactcggactaccccgactgcatacaccacatgaaacatcctactcatcctgtacggctcattcactttctctaacagcagtaactatcaactacattttcactgactcttgcacaacgcccttcgcccttcgacacgcgcaaacagctccctacatacgctacaagcaacccctcccatacacacccttgcgcagctgacctactcctgcgcactgccccccacacaccttcaccaccaccactctcgcacagcaacccccgctcctacactacaacactctagcaccaacacacacagcgacagcgaactcgacaccacccacacaagcctggctcctcaaccgccccaacccacccactgggcccctcccactgcacccttcccccgcaacaccacacccaccaccacaccccaccaccaccacaacccacacaacccccccccgcccccccccccccaccccccacaccaccccccccatccccaccacacccaccctatgaccctccccctccccaccacacacccaccccccctctactgcccccacaccacccccccccaacgcaaccccccccccccccccaccccaccccccctacacatccccacactacatcctacccatcctctccccccccccacaccccaccccttccacccaacccaccactctacaaccacacaactccctaacaacaccaccaccacacacctctccacccccaccgcccccaccccacccaccccccattccaactctcccccccacaccctatccacccccccccccccccccccccccccccccccccccccccccccccccccccggccacacccgcccccccgccgccactctccaccccctcctctacgccccacccccccccccaacacacccccaccccccccaaaccccccacccctccccccctccccccaccccaccccccccccaccccacacccccaccccccccacacaccccaccccaccccccc

SEQ ID NO: 557060 - DNA, 187 bp, Homo sapiens
tgttccatctatcggctactacaggtgctcacccatgactagcgagccatggagagttcgccagaaggagcactatggagctgtttttgacttccatctatgcaaaatctttttgcagcctccttagacataatcttactgtcccccactgagtataatcgctccgtatccgcagatcacagaatcg

SEQ ID NO: 557061 - DNA, 487 bp, Homo sapiens
ctttctctgggtgaggcttggcaagagatctctctgctcaagcacagcagaatcatgccccttttccatgattgggaacttggtaccggttaagtatccctatccctgaaatctgaaacaccttgtggttcccaagcattttggataaggcaaattcaaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggaggttgcagtgagccgagcttgtgccattgcactccagcctgggcgacaagagcaaaactcttc

SEQ ID NO: 557062 - DNA, 199 bp, Homo sapiens
  misc_feature (13)..(13): n is a, c, g, or t
  misc_feature (18)..(18): n is a, c, g, or t
  misc_feature (46)..(47): n is a, c, g, or t
gtacaggtgttgnccccntttcgtcattaaggtttgactatattanncgtgaggcaccaatgcgcccgagcattatggcacgtaccaccgctgcaatacccacaccatatgcgcctgtcatcttacggcattcgccatcgtgttcgacaacagatttgggggagacaataaaaagaaatgtaaggaatctgtggaaaaa

SEQ ID NO: 557063 - DNA, 1295 bp, Homo sapiens
  misc_feature (312)..(312): n is a, c, g, or t
ttggtatatttgttgttgtttgatacatccgcctgttcacatcagccttcctgtcgaccccgcccagggcacctgggcacagatgtgccaggcaggcgcatgccattatacccttgcggggcgtcccacttgggccaatctctcctgcgttgtaccctttctgggcccgccggtgttcccaaaagagattgaatgttaccaggcacctataccacttgctaaggtcctcttctacgagcgggttggcccctcggggttattctatatcaacgggggatggggctaaattggccaactagccgcagctcgacncacaaacactccgttcaaagtatggtgttccgcaagtgtcctataacctagggttgggaaacgtatgctgcatgtgattttgctgaccgcgatgtgcattctgcttctctagggggcattggatttccgtcgatagttccgtccccgtggaacctagcatcgcttgaagcgcgcgtgtcttgtctagacttgtctgggcggggtctctgacccctatgtaggttgccttcgagagaagtgcattaagtggcactgttagtgcccatgctggcaccacgggcccatgaaaactctcttgcgattatccagtgaaatgtattcatacctcatgtccactattaagctgtaacagtacgtaataattacacacttgtgccaagggcgggaattgagacagacatctgtagcatggtattttcatcgatctgaggccagcaccatgaatatcctgacaaaggagaattggttagaggcttaccttaatgggcagcacagggcacactgttgagtcacactcagtatgacacagaggtgtaaccctctaggaccagcggtgcaatcatcaatggacaagtatgccgagaaccaacattagctgtcatgcttgctgcaccttacataggtaagagcggaaatactctccttagtcactaggacatgaaagccggtttcaagaacacacatatggagaacacataagaaggctgaggcacagatgaagctcacggccgtgtaatcccagcacgtttgggacggccgaggcacggcagattcacactgaaagtcagacatttgggaccggccataggaccaggatggtgaaactctgtctctagctaaagatacagaaattggctgggcgtagtggtgcgtgcctgtggtcccagctatttgggtggcctgaggcaggagaatcgctttgaacccagggtggtggacggtggtcagtgagctcgagcattagcaccattacactcagcctg

SEQ ID NO: 557064 - DNA, 1239 bp, Homo sapiens
  misc_feature (112)..(112): n is a, c, g, or t
  misc_feature (311)..(311): n is a, c, g, or t
  misc_feature (314)..(314): n is a, c, g, or t
  misc_feature (318)..(319): n is a, c, g, or t
  misc_feature (322)..(323): n is a, c, g, or t
ctgaattcgagctcgtgaccccacaagacctcccctgttgtaagcgtgtgttgtggtgctttattggacaacctcccgtggcggtctttttactctaaaggtcttttttttnttagttaaacaatcattttattgcttgagtacacagacaaatttatgcgaccagggcagaggctgtagatgattcatatttccaattgggagggaggactcgcttggtcttataatatcgagccaaacgggtgaatccggctctctattagaatcagacggaatttagcatccttatcctttctgttcctctcaagaantgntttnnaannagcaagcggcttttcttaattaaagtgggtagagaatcttcgaggaagaactcagggagcaagtcccttagaacttaagaaattcttaaaattttatgtggcctggtcacaaaagcgtactgtgtgtgcaacaccagtgtgtgaatctctcgaggattacaccgatcgtggtgaaggagttaagggcccttctgggccagttgggtaaatcgtggctccttcagcgttcgctcagagtttcaacttcaaccaagtgtggggacgcgtgggttcgaaaaacaaaaaacaaaaaaaaaaaaaaaaaaaagaaaaaaaaaaaaacaaagacaaaaaaaacaaacaaaaaaagaaggcggggcgcgaccccaaaagaactcacctcccgggggaggccacccaacttcaagagcacaccagcgtgttgtagcacaaacgcagagctcaccccaatgggcgccacgtataaataaaaacaccgccaacacgcgacacgcagaaaaaaacacacaccccgcgaacggcaagaacaacacgcaacagagagaagaccattagagagaaacaccccaacaaccagggaggggggagacaaatcgtgcgacacaacaccccacgaaaaaaatccaagctcctgatgagaggagacacctacacacactgcagcagggggttgcatagatgggtgcacaacaacagcaagcgactatcatgcagagggcgagagaaaagagattttcaccagcgagggagtatagttgagccaatatccgcggagggatgaccgtcagacgatcgacaccaagcccagcacacaacagagcgatgcgacaggaacgaaaaacacaggggcacgtagcggccacagaacgacgaagacgcagatgaagcggcacgacagcaaacacacaaggctcac

SEQ ID NO: 557065 - DNA, 162 bp, Homo sapiens
tattattaatatcagtgatttgaagaagccttcgcgtcgacgcgaaaagtcctaatagtagaaggaaccctccataaagcctggagtgactatatggatgcccccacaccgctaaccgtcatctgagagaacgcaacttacggcggtgatctctcgtacgat

SEQ ID NO: 557066 - DNA, 294 bp, Homo sapiens
acaggtgagtgcatggtgtgatctcatctcgctgcagcccccgcgtcctggattcaagcgattatcctgcctccgcctcgagagtagctgggattacaggcatgtgccaccatgcctggctaattttgtatttttagtagagacaggatttctccatgttggtcaggctggtctcgaactcctgacttcaggtgatccgcctgcctcggcctcccaaagtgctgggatgaaaggcatgagccactgcgcccggcccccatgcatatttttatagttgacatcataatgtttata

SEQ ID NO: 557067 - DNA, 951 bp, Homo sapiens
  misc_feature (7)..(7): n is a, c, g, or t
tcacccncccagatgtcggtatagacaagattagagagggctcccgctggctgtgtttctcctcattgacgggtggtccacaggaattggggatcctttctctatggcgccccccaatatggcccggtcaccctacacagttttgggctggcactgtggcatgtaatgttccgcttccaggagtacagggagttttccctggtaatcccgcaagtttgctttccttggcacgtttacgggccccctgcgaagtgtcggcgtcctttgcgaccgctggtaacaagtccgtccaggggccactctgagattcatggcccctcattgcgcggagaatacaaaacagtgggaatctctgggatccgcaattaataaccatcttttctcgggcacaaaggccctttccaagcatctcttccgcggtcctcttctcctgcccgctttgagcgggacgcaacgttgatgtcgttggcctctgtaacatcacccgggcctaccctacgtgcctcaacccaaggcaacctcgacacgggggtgtttttcacacccggagagccatggaaagcaacgtagtttccacagactctccccagagcctcttccttggtggggaagccctcctgtactccccgagaataagcatcgtgtgaataggcgatgtggtgcaccagttaacccaaaagagagggagatatgatagacgaccggcgtatcagggcctcatttattcccgtgcagtgcccccccttgggagaaaactatgttctcaatgtgccacggagaaatgatgtcaacttttaaaataacgggcacacgggcccgcagcaacattgttgagatccgcagaagcacccaagcaaactatgggaggacgacgacagttctatatatttaaacactgtggggcccctctttttcaaaacaacccttaaattctgggggaaaatcataaca

SEQ ID NO: 557068 - DNA, 190 bp, Homo sapiens
tcggtgagagggaaaggaggcaggatggcaaaacaggtgctacttgtctgcctgtcgtgccttgttgctgataggctagtgataagtgtaaaggtagggatttgctggataaaattctccactcccttctccccagccaaaaattccaaactttcctcctagaagcagagaagccccagacagaatagct

SEQ ID NO: 557069 - DNA, 1524 bp, Homo sapiens
gtacctcgagtcgtcgatgactgccatggcccagtggtaggagatgaagtaaatggtgctctcggacgcgcctgatggtctgagtacatcccagcttgctggacggattgtcatcaactacgaggttcctccggacaatgggtcaaactctttcgctgacagcgcgcgttggagccagttgatgtgcatcgcggtcgtggctcgacagtggctatctagcgcatagctccattgtgtggtgtcgcgccttgaatgagaagtctcccgtgacgcttgtcgtggaatcattgcatcgcgtgctatccattggagtcgcagctcctctcgacctctcagccctgagcactccattcaatggatgcgcctcgagggtgtgtgcgcggtgctgcgattgtgcgatttgctgggggtacgtgtggttgcacgagcattgaaggtgattggggttgggaactgagtgactgggagcacgctcggggtacttgtcaagaggctttcgccttgtggatgggctgtaccgactttgtgtatggcctaactgggtggtgtcctcttgagtccccctggtgggttttgacctaggaatacaccagcaccccaagtcgacggcctacgattaatagtatgacagcattcaaacatgacccacatgggcatggcgcgccttcctagccctttgaaagattcaccagttcaacatggacgggtggcgccaatgcggacgaagttgggaaaccgtgtcgtgtagggggtgcattgggggcccgttgcaaaacacacacccttcttttccgagggccttccaggctggtttatgggaccgggaccggggatggtgtatgcattggccaaagcggggggcttgtgaaagcgcttgggagttggcaccaatggcgaattcaaattgaaaccttacactgggtacacccgggcgccgaaccttattcttttttggacggaatcgaaatatagccgttccccaaggccctggaggaacaccattggttgccagtgcccaggtggttgaattggcagctagccaaaatgcaaggtgcatgaaaggtgacactggtaagtgggccaaattctgaccccggattttcccaagagcaagggtggacaaggaatggggaggctggggtaagtgaaggcacgacgtggagaggtgcgcccaagggtggtgccccaaagacccatgagaagccagtaccgagagaacttggagcgagaaaaacgcatctctataaaaggacgtgacagatacagcagccgcaacaaaacttgtttggcggcaaagtgtacccaagaagagatgggaggcacgaaaaggacgacgttccagagcccacagcggagaccagaagaggcagggagaagagccatcgaaggtagcaagaagacaacactacgcacgggccaggatgatcaccagaaggaggacgatcaaaagcgaagagggagaacacagacgaagaggagccacgcacagctggcaaacaacaagcgacgagacaaacagaacca

SEQ ID NO: 557070 - DNA, 335 bp, Homo sapiens
agcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaactcgtctttactaaaaatacaaaaacaaaaattagccaggggtggtggtatgcacctgcagtcccagcaacatgggaggctgaacaggagaatcgcttgaacccgcgacagggaggttgtgatgagccagggtcatgccactgcactccagcctgggagacagagcaagactccatctca

SEQ ID NO: 557071 - DNA, 708 bp, Homo sapiens
tttgtgggcaaaggggggggtttaataaactttgggtagtgagcatggcccccaggcatcgggggggtctcgggtcccggtgacgcaagcggtaaaaccgggttcgcaatttagcgccgaggccgccgggggagaaagcccggagagcctggagggcgggggccacgggagccactttccggggggctggggggcgggaaaacccaaaattctccagagggagaccaacgcctaaccgggggcctatcacacggcaccggaggaaggggaatctggggtcagccctccctccaaagggagacagcaggggaccctcttttgggcataggcgctcggaggggaaggtatcttccgcccatattcaagatgggtgtgccgcaggtggcatttgggagacaccggtgtgggagtcctcggggtttgttggacgcgagggcccctggggagggggcgcggagtttcccctggcccaagtgttccgatcccaccaggactgggcagaactcgggtccagcgggagcttggccgcatcttgcgttgctgtgcccgcgctcttcgggcgaggagagtcccttcgtaagggggtccaaaactcgtcgactcatcctcgggagctcggggccatagcgctgtgctgcccagaggtgggggggcgcgagcgcgatcggtcccgagggggtggggttcctccccatcctttggtggacc

SEQ ID NO: 557072 - DNA, 978 bp, Homo sapiens
  misc_feature (688)..(688): n is a, c, g, or t
ctagttcctcctgtcttctgaccgccgcctcccgccgatcatgactgccgcaaggttcctagcacttgtcgaggatgtgcgtcagtcgagggcaaaccaaaatcaggcgcgcaacatgtttggagcatgtgcttagattcatgtgagaagtacatcgatgtaccaccaacatgcccaccttacacatggagaacagcatgaagcatgcatgcattggacaacggcgatcctccagatgtaacgtgacgaatcgaagagacccacctgtgcgggcaagatttctgtgacgccacgcgaccgccgtctctgtgtgatcgtggcagctcctgccaaccaatgtccactgcgcagatgtcggcgtaccgcgggcaccgttcgtgccacagaatcctttcgcggatccggaacctccattacgtctcatctgggctcaagagtggtgctgcattgctatcgcaactggggccctaggggcaacatatccacgagaacaccgcgactcgacgactaggcttggacgacagcctgcctgtccttggtttgctagcaagaaacattggaggagctgtagtagcctcgccggaccttgcacatgatagagtgttattcaccaagcatcacctctaattgctccgtagtggatagtagagtgacctgtggtctggaagatttgattaccccgatctantctaatacagtcatttgaatccgaggaaggaagtacccattgacaggtgaatcaatgaaaagccgtacatattgtggtggcctttccaccgcacaatgtagtcgcaatcatcgcgtcgttggcaagcccataggactggctctacctctcacgacgtgctagcaagctgcgtcacataatgagagcggactgagccccttacatggtttgaataaacggtcactcatgtagtaatattgaacatactgaacccctacgatgcggaccaactgccaccttagttggtggct

SEQ ID NO: 557073 - DNA, 841 bp, Homo sapiens
  misc_feature (237)..(237): n is a, c, g, or t
  misc_feature (579)..(579): n is a, c, g, or t
  misc_feature (585)..(585): n is a, c, g, or t
  misc_feature (617)..(617): n is a, c, g, or t
  misc_feature (776)..(776): n is a, c, g, or t
  misc_feature (782)..(782): n is a, c, g, or t
  misc_feature (841)..(841): n is a, c, g, or t
ggagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggctaagtggttttatatcgcatcggcctttcgaaacgaggagtacaataaggtcggttcaggagatccaagcaaaccnttcttttacttcacccccgaacaagacagaggacacgatctttctcagagagtaccaggaacccgatcaggaccagtgcatctataacagccacctaacctgaatgtccagcgggcacaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccaggagacgacccaaggagcaactgggagagttctacgaagctctcgactgcttgcgcattcccaagtcagatgtcctgtacanccgatnggaaacaggataagtgtgagccactggagaangcagcacgagaaggcagaggaaacaggaggaggggggaatcctagcaggacacagccttggattcaggacacgagcacttgggggccatcctgccctgcaacccgacatgtgtacctcagctttttgccctcacttgcatcagtaaagcttcctgggtnggacancttaacacaaaaaaaaacaccgaaaaacacaaagcaatctcacacaaacaacacaaaan

SEQ ID NO: 557074 - DNA, 353 bp, Homo sapiens
ctctgacgatcccttactcagtgatcctcaggaacggggaggttaggatagtggttaagagatcaaggctctgccgggcgtggtggctcatgcctgtaatcccagcacttcgggaggccaaggcgggtggatcacctgaggtcaggagttttgagaccagcctggccaacatggcgaaaccctgtctctactgaaaaaaaacacaaaaattagccgggtgcggtgcaggcgcttgtaatcccagctacttgggaggttgaggcaggagaatcgcttgaacccaggaagcagaggtagcagtgagctgagatcacgccactgcactccagcctgggaggcaaagactccatctc

SEQ ID NO: 557075 - DNA, 917 bp, Homo sapiens
  misc_feature (234)..(234): n is a, c, g, or t
  misc_feature (379)..(379): n is a, c, g, or t
  misc_feature (655)..(655): n is a, c, g, or t
  misc_feature (661)..(661): n is a, c, g, or t
  misc_feature (693)..(693): n is a, c, g, or t
  misc_feature (852)..(852): n is a, c, g, or t
  misc_feature (858)..(858): n is a, c, g, or t
  misc_feature (917)..(917): n is a, c, g, or t
ggagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggctaagtggttttatatcgcatcggcctttcgaaacgaggagtacacatcaccttcggcttcacgtgcaggatcncaatgcatatccttacttcttacatttaccctccgcgaatcaagtacagagtgactacgtaatcttatctctacgagtaggtcaccagaacctcgtcccagaatccatgtgctctctcataatcctcctagtgtaccttgcatantgtccaagtcggcgtatgcaattgggtaccagtcatcccatgcatacagcagggcatggccagatgatacattgtctgctcacgctcgcatgttcgcttcagcggactaccgatagacgccttgatgttctggtttccgtaccttggcacggaatgagaagaactgggggctgtctgtctatgctgacaagccaggagacgacccaaggagcaactgggagagttctacgaagctctcgactgcttgcgcattcccaagtcagatgtcctgtacanccgatnggaaacaggataagtgtgagccactggagaangcagcacgagaaggcagaggaaacaggaggaggggggaatcctagcaggacacagccttggattcaggacacgagcacttgggggccatcctgccctgcaacccgacatgtgtacctcagctttttgccctcacttgcatcagtaaagcttcctgggtnggacancttaacacaaaaaaaaacaccgaaaaacacaaagcaatctcacacaaacaacacaaaan

SEQ ID NO: 557076 - DNA, 107 bp, Homo sapiens
ggcattttccttccacaggataatctgcaaagatctcaggatgtgctttccaaaagtatagaccgcagaaagatctctcgtctctaggactggcgaggctaagggat

SEQ ID NO: 557077 - DNA, 437 bp, Homo sapiens
agaggtccacggtcggtgatggtgtgtggtggtgatgctgtggacatatgtcgacatatatcatccatagtctcccagagcccgtcggtgatcagagcctgagacctgtgcttatgagtagcatcattcccctgaatatcagtctgggctcagagtgtgacaagcttccagcatccattcgattatctactgtggcaagattcagtgttaaaaccaggtctttcctgtccgctgcttgtccatttctttctgacgtgcctgggaggtcccccaggcaaatgcctgcttgactctctaactttctattccgaagatctgtaccacaactgcttttgggaggattatgaccatgatcatcgtcttcatcttcctctttgagggcttcaatatctgcaatgtcttctgactgtacctcactgccagggctcccagctgag

SEQ ID NO: 557078 - DNA, 589 bp, Homo sapiens
caataattagctgttatcagtattcgggtcgtgggcaagttgtacagattggcatgatcccccgggtttagactcgccaattcaggattagacgctttggcctaaccttgtggtcctcatgtgcctgtgcagcacatcaagacctgcataatcttggggtagcccatgccaggaactatagtgtaagaaaatgcggtctggtgcactatctctacgaattgatgcacttcggtcagcaatggtaaacatggagtcatgatggatgtacagacctggggacactacttttgaattaggcgttcgagattaccttagtcgtgtagtacgacgatagagctaggcagtatggttggttccatgaggcagattttattgcttggtatggagaatggtgtctagatgtaggttggcgtgaaaggcaaaggactaggtggtgatgttccgtttgaatatgtgagatacaactgtaccatctgaagtagaattgacatatgctgcatccgtctcatgacatataagggtccgtaaacgagtactggtcattctgatctaccccgcagatgagcctgtgccgggacctgcgtgcagg

SEQ ID NO: 557079 - DNA, 410 bp, Homo sapiens
ttagggcatgagtcaccagcgagcctcagttttccctactgggatgcttccgaaaggccagtgctgtgcagtgggcgagacacttcagggagcggggggctccaaggacagagcttttaaagcagcagcagaagcctgggatgtggaagatctctgtctactctcctattcctgatgggagcagtcgggcaaagcacaccgctcttgactctgctctacaggccattcacataacagcaaattgctgggtttccttcatgtccctattaggaaagcaaaacataccacaaagtataccctttctcactaaccccctgcagtggaccttaaaatgacctgaaggactgaaaaggtcatagaaaaaacatggtgcttctaggtaatttctgattccttgaagtcagtcagtc

SEQ ID NO: 557080 - DNA, 289 bp, Homo sapiens
ggggggggggggggaggggggcctggtttcccttttccccgcccccaaggtggttaagggttttgttttttccccccaaagggggggggggaacccccccggttttggggaaggcccctgggaaaaaaggttggttttttttttttggggggatttttccttttccccgggggggctttttccctttttgccccggttccctttccccccggggggggggggttttttgccttccccccccctttggggccggggtgtttttttttggtaactggaaatttttggttta

SEQ ID NO: 557081 - DNA, 413 bp, Homo sapiens
ttctttgtaagctgagtatgtatgtcacctcaggacctctgtgacaattgtgttaactgtacaaattgattgttgcacatgtatttgtccactatgaactcgaggcatcttgaaaaagaacagaatcgcatagttcttcaggcaccaatgataggcacccatagggtctaactgcttgcagggttggcaaaaacggagccacatatgtcttgttgcacagagcctataaacggttgcgcaagtaggggatatattctttcattctttgcctagcagggaatatcaacaattaatatcctgagaaagtatcgcattggtgggggaggtctacaaatggttgctctcagagtgtctgtgttatgcatttgagctacgctctcacatacgctctgatcgcatacagtaccgtctct

SEQ ID NO: 557082 - DNA, 1300 bp, Homo sapiens
ccgccgggagaaccagtgtcatcggtcggttcccgtgaaaacaaaaacaatcggccgctgccgtcgctagtgcacccgaacgtcgcgagcggggcctggtgtgactgctgtgggccgagttgcagctgatgctgaactgtggatgcatgctgtgctgactctgccatgtggtgtgcatagtggctgcctatgggtgcatggctgtgtgcttcctgtgctttgctgctgtggtgctttccccctgtgtctgcctgctgtgctaggtgctgccctgcctgcactctgtgcctgctctccatgccttccctgctgcctgccctgcgtttgggtgaaccgatgtgatgcatgtgactgcttgtgccttctggctgtgtggccctggtgcctgaagctggcttgctgtgacaaccttgtggtgctgcccgatggatgctctgatgtctgcctagcctgcccttcctggtgcattggactcatgttgctgttgactggttgtgagcgctgatgctggagcgacaggttgcttgcagcaattgttcctcgtgtggctactggggcacgcttgtgctgagctgctgtgccatgtgagtgagcctcagtctgacatacaaccggtgctggatctcagagcagcgaggagtccttgccagaagccactgtgccaaacgattgcttgaacttactcacggggaccagcctttcaacgtttgatttattggacacatgttgcttcgtacacacacgaacttacaacgcgataccttgtttcaacaacattggggcctcccagacccagcgaaaagaccattccacaagcagttgtaattctcaggcgttgggcacaaacagcgcattagaatacagggatttcactgtagaacgcaggattttgggaaaaactccttccccttttggcaaattggatcttccccaatcaggaaggattgcaattttatccacgttgtacgtgaaacaggcctggcctcaagaactggggcccaagaaacctggtcctggatctctgtgtcatttgtgaccggttcaggaggcaatcttttccccaacgcaagggtccgtgcctgaaaacggtaaagctattatcccaaaagtgggaacacgtctggggcgcccccaatctacagaattgttccctttcagggagatccagaaaccttagtggtgtgatacatcaattaacgggaagtgtatgatagcgtttagcatccagcacgtcacatgtttcgtcacccattctcgaagcgactaatcaaagagggtgcaaagacatgagcaaagggaa

SEQ ID NO: 557083 - DNA, 172 bp, Homo sapiens
gtaatactgttgggactcaatgatcaacatggaatgaacgagacgtgaaagtgaaagtgagcaaagtatggattctgaggagcctggacagccggggaggctcccctcagatggatgacatcaacagtgttccagacatgacagttttacggaacacatacagctggggcaa

SEQ ID NO: 557084 - DNA, 210 bp, Homo sapiens
aaagaagccattatgtgaacaagacacatgcacacacatagttatagtaacacaatttgcaattgcaaaaatatgaaaccaacataaatgcccatcaaccaacaagtgggaaaagtcctatatatatacaccatggaatactactgagccataaaacaaaatgaattatggcctttgagcacttggatgggctaagggccattctcttag

SEQ ID NO: 557085 - DNA, 352 bp, Homo sapiens
gattcatggattcatatattgttattatttaaaattgatccatgatgaaagtattaaactaacatataattcgacaaatatgaagatggagagatggacttcaaccatgtgatgattcaagatatacgatcaacataaaatgaaacactagctcccaacatggtgaaaccctgtctctattaaaaatacaaaaaattaaattgacgtggtggtgcacgcctgtaatcccagctactcgggaggctgaggcaggagaatcacttgaactcgggaggtggaggttgccgtgagccaagattgcgccattgcactccagcctgggcaacaagagcaaaactctgtctaaaaaaaa

SEQ ID NO: 557086 - DNA, 964 bp, Homo sapiens
  misc_feature (186)..(186): n is a, c, g, or t
  misc_feature (467)..(467): n is a, c, g, or t
  misc_feature (832)..(832): n is a, c, g, or t
ttactaataaccgctcccgactccatcagcgactaggtacaatatgtctcatcttatgttcacccggtcttatggggcctatattcgctcgctccctaatctctccccctataagattgtgctcctcccgatctgattttcccacataagtgcggccaaatcacaacctgggttcctctgtttaanagacgccctcccgtttttttaccccccccgttaacacctgtctttccaccccaaaaaaaggtgtcccactctccctcgccagtactttcctggaattcaattataaaaacagctaaggttgttacaccacggtctatatgccccagatcttcaaaaattctggtatcaggttatatatttttacaaactaaaaggggattcaattccaaaacccaaatggtaattatcccttcctctggatcattccaaactccccctcttatgacttattcccgcccttncccccccattgatcattaactcactcattaccccccggataataaaaccaccacagagggtccaccctcgcccttaacaaattttgagcaaaataccacgtttggctattacaaatatccagaaatctcgttgcctccctgataataattgaaattctttcctcaaattattatctctgtccaattggacaccaccccacaacaaagatattgtggtgaacctaattttgtctgaaaaacaatatttactggtctctattcggtacccttctccgcgcttctttaacactcccgcctgaaaccatcactgtgtttctgctgaagcctcccccgtgagcaagctagcaattgagtctatctcccancattcttgagtaacatgatgcaataacaacaccccattcagaacaaattgagataaattcatccccccaccccctatgttcgcaaaaaatggtctactccaaataaaacccaacgggcgacccaacataaca

SEQ ID NO: 557087 - DNA, 383 bp, Homo sapiens
  misc_feature (149)..(149): n is a, c, g, or t
  misc_feature (189)..(189): n is a, c, g, or t
  misc_feature (214)..(214): n is a, c, g, or t
  misc_feature (267)..(267): n is a, c, g, or t
  misc_feature (289)..(289): n is a, c, g, or t
  misc_feature (311)..(311): n is a, c, g, or t
  misc_feature (317)..(317): n is a, c, g, or t
  misc_feature (349)..(349): n is a, c, g, or t
cgaagtatttcgcacatcgttggcaatgctgaaggtggtcagcgagccacgggtcatcagcatctgtttgccaatgtgcaccacctcgttcaacttggtcgggttagagtcgagatcgaccatattgcccgcctctttcgccgcctggntgccggagttcatcgccaccgcgacatctgcctgcgccangccggagcatcgttggtgccgtcgncggtcatcgctaccaaacgaccttccgcctgatactgacggatcaatgccagnttggcctccggtgtcgcttcgncgagaaaatcatcgacacccgnttacgnagcaatcgaggcggcagtcagacggttatcgncggtaatcatcaccgttttaatggccattttgcg

SEQ ID NO: 557088 - DNA, 229 bp, Homo sapiens
ccagtaactcaggatgaacaccctcatgcttcaccacacagctacctggaaattgaacaacctgcacctgacagattcctgggcaaataatgaaattcaggcagatatcaagaagtactatgaaaccaatgagaacaaagagacaatgtaccagaatctctgggacacagagattctgctaaagcagtggtaagagggaaatttatgcccactaaatgctattgaaact

SEQ ID NO: 557089 - DNA, 252 bp, Homo sapiens
gaagacactcatattacagtctgtgttatgtatgtataccatttattcaatgctactgtgtatataatggaaaacttaagtccagtttgaaacatctagtctttctaggtgtttaaaagtgtacaacggcctgtcgcagtggcgcatgctgataatcccagcactttgggaggccgaggcaggcggatcacgaggtcaagagatcaggaccatcttggccaacatggtgaaacccatctctactaaaaatac

SEQ ID NO: 557090 - DNA, 120 bp, Homo sapiens
caaatcgagtcggtaccgctgtgcggacatcctcaagtgctgggattacaagcttgagccactgcgcccagccttttatttatatttggagagaatgggagctctcaactctgattgccc

SEQ ID NO: 557091 - DNA, 620 bp, Homo sapiens
  misc_feature (95)..(95): n is a, c, g, or t
  misc_feature (119)..(119): n is a, c, g, or t
  misc_feature (301)..(301): n is a, c, g, or t
  misc_feature (307)..(307): n is a, c, g, or t
  misc_feature (494)..(494): n is a, c, g, or t
ttagatgatcttaacgtagctaacattattgtgcacatctgaaattaattaaccagtaaatgccagtctgaaacaattgggagcctcaatatacnaagatctataaaaatatcattacnaaaatggtattaacatttctcccacttgagcctccctgaacagctcatttagctcaaacatttagaccagatgtgctaagagcatctgctgctgaaggtgagtgccaccaaggcagcactgtccttctctgactgcctgctctattcaacaccaaaagatgagggggttgggctgtctttcnaaaccnacatatttttagttagtttcagacattggcaaataactgctatgtctgtactcttaggctttccagactagtttacatactattttacatcttttcttatcttgcaaaatagagctcacataagatatgaaaacaatttttcttaaaacaaattagagtgctaagaatatctccaatgtaatcaatntaacttatgcaaagtttaacataatacatcttttaaaaagataagagagagacaataacttcaacaaatgagccctaatttgcatttgggaaacttataacaaacattacccaacacatttcaact

SEQ ID NO: 557092 - DNA, 233 bp, Homo sapiens
  misc_feature (147)..(147): n is a, c, g, or t
  misc_feature (182)..(182): n is a, c, g, or t
  misc_feature (227)..(227): n is a, c, g, or t
catagaggatttcgctgatccgcttaagtcgctgctttcggaggcgtctcccactcctcattggcgtgatcggagtgaagttctggtaggagagctcaggggacctgcggcccacatgtgccactctatgtccgcatgaacacagtntttggcctgcctggccacttgacctgccagcaggntggggctcctacctcgggtccccgacaggcccagtcgactcccgnctcttg

SEQ ID NO: 557093 - DNA, 105 bp, Homo sapiens
tcctccatatgcctcaataacctccatacgccccacagttatcctccgatatgccccagtttcctccataggccccggtttcctccatacacccacagttacctc

SEQ ID NO: 557094 - DNA, 748 bp, Homo sapiens
ggtgcgcgcaccctctcccctcgtccactcgatgcgcgccgttccttcttctgccgctgcctggatgactgcttgtagtgctcgttagagtgcgagacctggtacctctttgtgaagcggcagcgtgaggatactccggcgctcgccatggccgacgaaaagccccaggaaggagtcacgactgagaacaaacgatcatataattagaaccgtggcaggtccgcccaggatggtactagtggtgcgactaaaagattgaagaggccatacaccacttgaagtaaactaatgacaagcctatggtgcaacgacagggatcgtcacatgctggacatcagattcctgactttgatcgggcaaccaatcaatgaaacagagcacaccttgcagagttcgaaatggccggatgaagatacaacttgaggtgcttccaaccagcatcacgggaggtgtctactgaaaagagggaacctgccattctttagcgtccagaaaatcatgcttccttataagggacctacgtattacgttgctcaatttagaacactgcaattgtggttccacacacatccgtgactactaccggataggtctcactctattcattgcatagtcccgccttcccattcctttatctgtagatagagtaacggctatatgtgcccgaagccctatgcctttgtttttggtttcctcaaaagcgtcacgtctcatgtcgatgcaagctccagtcggaaggcgcactggc

SEQ ID NO: 557095 - DNA, 345 bp, Homo sapiens
  misc_feature (15)..(15): n is a, c, g, or t
  misc_feature (28)..(28): n is a, c, g, or t
  misc_feature (42)..(42): n is a, c, g, or t
  misc_feature (254)..(254): n is a, c, g, or t
  misc_feature (271)..(271): n is a, c, g, or t
  misc_feature (310)..(310): n is a, c, g, or t
  misc_feature (318)..(318): n is a, c, g, or t
ctttcttacctttcnttcctttctttcnttctttctttcttnctttctttctttctttcttgacaagggtcttactctgtctggagtgcagtggcatgatcacggctcactgcagccttgacctcacttgaagtcaggagttcaagaacaccctggccaacatggtgaaagcctgtctctactaaaaatacaaaaattagctgggcatggtggtgggcgcctgtagtccaagctacttgggaggctgaggcggnagaattgcttaaacccnggaggcagaagttgcagagagccaaaattgggccactgnactccagntggggcaatagagagagactccatctc

SEQ ID NO: 557096 - DNA, 156 bp, Homo sapiens
tctgttctgcaggatatgggggctgttttcagtctatagactttcatgaggcacgattctctacgcactcagtgactgctctgggacctttaccctgatgcacagggcgtcctgtagctacaacatagtgaaaggtgccacgctgcataaatgcca

SEQ ID NO: 557097 - DNA, 355 bp, Homo sapiens
  misc_feature (5)..(5): n is a, c, g, or t
ttcancagcgacacccattcctccccctttggcggtgggggtggcattgccctcaacgacccttttgtcaagctcatttcctggtttgccaacgaatttggctccaccaacagggtggtggccctcttggcccccttggcctccaaggagttagacccctggccccccccccccagcaagagcccaaaaggaaaaaagagtccctccttgttggggggtccctgcccccctcagtccccccccccattgattttcccctcctcccggttgccatgtagccccctttaaaagggggggggcttagggacccccccctttttttggcccctcaataaagtcccctgtgttcccccca

SEQ ID NO: 557098 - DNA, 263 bp, Homo sapiens
ccccggtaggcgagggccgggcggcaggaggcagcgaggctaccgggtggggctgtcgaagacacgaaccgtgtgcgccatccatgccaggcgcgtgaccatcatgcccaaggacatccagtgggtcagccgcatccgcggggagagggcctaaggtatatttttaggtggtcgatcaaaggatcttttcagagccacggccgttttcatcaagagcagctgtacccgctctccatctgatgtgcgtctgccttgcgcagcag

SEQ ID NO: 557099 - DNA, 923 bp, Homo sapiens
gcgcacttgtttggcgggtctcccagttatatggagaatttttctcccgggcgcccagacacgagtgttgctaactgtgtgtcgctccaactcttgccggaggatgttaccacacttatcggggacaaaataccggtgcttccaggcgattgcgagaccctggcctgctgggtcaagagacgcagaatttgtgttccgatcccccccttgtcacgaggccgtcatatcccacttgttgtcgtgcaccagtcccccccagcaagtgctgttggtcgacacattagtgtcacacatccctcacctctgcggaataattgtgcgtcgtgacaactggtatactccccccctccctctggtgcggcttgtatccccgtcatattctctaatggtagtacccccgcggagtctaaccttgcccccctggtgtgaacaccgctaagtcccccccctttcttttttctaacaaaaataagataataaaataagacaacagctccttttctctctacaaaaaggaatgaaatgacaccaccatcctcatcgctcgtccaagatacacataaggtgtcaatctctatcaacagcactttgtctactacaacccgccgccccagcgttttttgtgcacaagggcgcctaaaactgggctcggagtcccgcatgtcccgagtggtctcacaagctgtgttttcccaagctgctccccggttattcctacgcaccgtgtttatatcaggagcgccccgaaacacatcgggggctcccggtgctccttggcgtaatatcccccggcgggattctcccccgccctctggggcaccacacgggcgttccgcgctggcaccctgtgtgtcccggagggcttgaagacgccaccccgcccccctgggaacccccattccccgaaaaaaacccaaaaaaca

SEQ ID NO: 557100 - DNA, 488 bp, Homo sapiens
ggtctgtttcccatgagccagtacctgtggggtctcgtgcggccaggtttctgccctatccgtccaagacacaggatgaagctcatgcctcactcggggtctccttctctctccctgcagtgcacccactctggacgggcccggtctccgtgccagggggcacccggcagtctcctatcaacatccagtggagggacagcgtctatgacccctggctgaagccactcagggtctcctatgacgtggcatcctgcctgtacatctggaacactggctacctcttccaggtggaatttgacgatgccaccaaggcatcaggtgagtgccagctggggctcgaggactttctcctctccgctccctgttctgggagcagggtcaggggcttcgcggagaaggcggaggagagctagaaggtgctgctttccttgtgctgctggcgcgccactgcacttcagcctgggagacagagcgagactccgtctcaa

SEQ ID NO: 557101 - DNA, 291 bp, Homo sapiens
  misc_feature (236)..(236): n is a, c, g, or t
cttatggcaccaggcaggacaactggcgaggctataagtacctcgtgagggcggaaatattgccgcgtcctgagtcctctgggcagatgcagagccgcgtaagctcatagaagcaaagccaggggaacagtgggagctctggcctcgcggtgcggacgttagtattggattcctggggaacagcgacctctgcaggagcctctcatccacacagagtcaggacactaagggacggnttcttgagacaaagcacccctttcctcaccttactcccattccacccgttgggaa

SEQ ID NO: 557102 - DNA, 1181 bp, Homo sapiens
ggtccgccgcatcttcttttgcgtcgccaggccgagccacatcagctcagacaccatggggacggtgaaggtcggagtcgacggatttggtctgtattagagtgcgccttggtcgaccagggcgtgcttttaatctctgcgtaaagatggatattgtcgccatcaaatgaccccttcattgatcctcaactatcatgcgctttacatgttaccaatatgattccacaccatggacacaattccaataggcacctgtacaatggctgaagaacggagaagcttgtcatcaatggaaatcccatcaccatcttccaggaagcgagatccctccaaacatcaagtggggcagatgctggcgctgacgtacgtcgaaggcagtaccactggcgtcttcaccacacatggagaacggcttgggagctcatttagcatacgggggagccaaaagggtcatcatctctgccaccctctgactgatgacacccatgtacgatcatgaggtgtgaaacatgcagaaggtatgagaaacagacatcaaggattcatccagcaatgccgtcgtgagacaaacatagatgacgtatagagaccctggacacggtcatccatgactagcttttgggcatcgtagcaaaggactcatgacacagtacatgacatcatgcctaccagaagactgtggatggcccatccagagaaaactgtgcgagtgatagagacagagaggagatatccaagcaacaattatttcctgacctctacatgggcgctgcacacagctagaaacacaagggtcaatccctaaagcatgaacgagggacagttcactgagcataggcattccagtgatcccccactagcacaaagatgcccacgagaggaacactgaacctgcatagcactacaaaaaaacccgttaccacaattattaaatgtcatcttcaccacttcatatgataaagtacaacagcaatacaaaagagacacactaaaagagacacacatgacacaacatcctacctcactgaagtatctacatagaacactaaacgaaaaaaccgaaccagccaaccaatattaaacaacataaccgtacatcaccatacaccactaatgtcataactctcatacctcatacaaaaatagattacatacaaccgttcaatcacataaacaacaaa

SEQ ID NO: 557103 - DNA, 117 bp, Homo sapiens
cggagagacgtgttgcaatgtgtgccgtgaggctcggtcgggggatcacgtcgcacgggctgtcctgcgaggtgtgctaagatttaacggcccacaagcgctgttgctgtgcgtgca

SEQ ID NO: 557104 - DNA, 380 bp, Homo sapiens
  misc_feature (1)..(1): n is a, c, g, or t
  misc_feature (339)..(339): n is a, c, g, or t
  misc_feature (342)..(342): n is a, c, g, or t
  misc_feature (349)..(349): n is a, c, g, or t
nctaacaccttataatccccagcactttggaagcccaaggcagggtagatcacttgaaccccaagagatcgggattgcccctgggcaacatagtgtgcccctgtctcttaacaacaacaaaaaagacactggggactacaaaagggaggagggaagaagtgaggacaagggttgaaaaactatctattgggcagtatgttcactatttgggtgacaggttcaactgaagtccaaatctcagcatcatggaatgtatccatgtaacaaacctgcatatgtgccccttgagttgaaaattaaaaataaatagtttttttctttttttaagagatgaggtcntgntatgctnccaggctggactgagtgctattcacaagcac

SEQ ID NO: 557105 - DNA, 543 bp, Homo sapiens
ggcaggcggcccctcaaaaaaggagatgtcaaaggccccgtgaaaaaaagcttcgggggacagggctcctaatgggtttgtccagtaaataatgggtaataatccggccaattggtgggtcaacgaaaaaagtccaactctaagatgaagagatttattttgacccaaatgtgagtgcccgtggccccttacaaagcccccaggaggtccttaaaacatgtgcccaaggtggtccaggcccacttggttttaacccttttaaaggggcctgagccctcaatcaaatccctttaagaaaacccttggtttggtccaaaaacggggggcccctcaaaggcaaaaggggagggggcttccaggctatagggaaatttaaccatttttgggttaaaaatgggttaagtttgtttaaaaacctggggtccccaaaaagggaatgttcaagttaaaataaaaaattgtgttccccgacccccccgggtccgactgcttgttttccccgttcagtaacgaaatccagccagattgggaaaattgcctttt

SEQ ID NO: 557106 - DNA, 296 bp, Homo sapiens
aaatgggtatgctaaattaaagaaatgattagtaataaatgagatttgctattaagaaattccctttgggtttgagccaccctttttcatccaatgtagaaacctttatggtcagaccagaaccccgtttgaccctaaattaccagtagtgttaaagaattcagggcgggatattatcccaaaaggcctagcccgctgctccccttaatgttccctcccaagtggtttttgtgttgctattgttttttttagcctttcaatgactgtgtcttattcccttaaatcaattggctcta

SEQ ID NO: 557107 - DNA, 319 bp, Homo sapiens
ctccctgcatcctgggctgtcaatgacatcttctccatgtccaccgaccataccctggcatatgacactgacagcttcctggaagcctctgcaggacccctgcgttgttgcaggtgtctaaccgcctgcctgcgaaacccagcgctcttcaagatatgatgtgatggaacacacacacacgcatacactcacacactcacagatgcagacacacaacatcttgagtacagccggggagagaatccaagcctaacattaaataaatctttcaccctgcttcttacccaggggtctgtgttgcagataacctcaaatgtat

SEQ ID NO: 557108 - DNA, 648 bp, Homo sapiens
  misc_feature (48)..(48): n is a, c, g, or t
  misc_feature (62)..(62): n is a, c, g, or t
  misc_feature (101)..(101): n is a, c, g, or t
  misc_feature (107)..(107): n is a, c, g, or t
  misc_feature (134)..(134): n is a, c, g, or t
cggcgattcctatgtctgggagtaattcgatacaaaatgatcttttgnatcctgaatccatnaattacacttttttttttcaaattcacaaaattcacagnggtgcngacggtgtaataaccactatggggaancatcccgtaaacctgcctgttgccatgccaatggagtgactgaactggtgacatctgtttgagcatgcttggtgtggctggtagcaacccaccgttgtgcataacttggtacatgcaggggtgcaagcagagggttttctcagcattatggggggcagggtaaacatggggcattttttggttgttcctttgtttgcatggggtgtggggcatcatagtactcagcttatgccctaaaataacatgtataaaaaacccctgaagtattgtgtgggtgtgtacgtgtgagtgtgtgttggtatacgtctggcaattaaagcttggtcttcgggaacttagtgaattcttttctctttttcctccagaagtatttgttacacgatttgtaactaagagctctacttagtttgtttaccatgaacatgtagcagcaaaccttatgcatctaattcctaccaggttaaagaccggcttttagacttgccaggttaagcaacagccaagttctcagtaa

SEQ ID NO: 557109 - DNA, 109 bp, Homo sapiens
cactacgtaatcgtgagtggagcccagcgaaggaggagcgcgtgggacatggcggacaactgagcaggtgctgaccacacgagcatgagaagaagcagaagctggagac

SEQ ID NO: 557110 - DNA, 598 bp, Homo sapiens
  misc_feature (277)..(277): n is a, c, g, or t
aggcgggcaaagtggcccaggccaatggtgggggggctggtgtttttctggttgggggggaaaagaaaaacctttattcgctgccgggtttgtggggtgtggcatggggcaaataaaaaatggtgcccctttccgttttggggggttggccaagtacacccggttctttagattttaagagggggtgggcagcaaggttaattttccgggcaggaattttaaaaaccccttggccaagtaagttgtgggggggcaagccctttggtcccttgttggntaaaaaaacccctccctttgggttggttagggggggttggggcccccgaccaacatttgggggggtccttgttagttggggccccccccccggggggttgggcccgtttctttaaaatttttaaaaaagccagggtcccgggggccctgttgggggttttagttttgcattggggtaattggcccaagtcattgtttttttcccccccctttcccccaggggtttaaggttttgggggcctggggttttttcggggggggccccggggtaattccccgggggttttgggtttaaaaaaaaaagccccggggccccctggga

SEQ ID NO: 557111 - DNA, 387 bp, Homo sapiens
cgctgtgcgggatgtgtcccgcgccccaaaactattgccccaaatgatgcttggggtccacacacacgtgatatgtggtcgccccgggctctttgtgtacgaccacaatattttagaagaggggaaacctatatgtggcccacacttcttctacaatcgtgtggtctggtttctaaaatccaaaaagaggctaacacacacaattggttacacacacctctgattattcacgcacgtataccacactttaatttagaagactgcattaatgagaatattataatattgagggtttaacacaccaccgtaggctcctcatcttctgttgcaaaattaagaatttgctccttaccctttcccactccccccccctaacactcccccaca

SEQ ID NO: 557112 - DNA, 211 bp, Homo sapiens
  misc_feature (5)..(5): n is a, c, g, or t
  misc_feature (17)..(17): n is a, c, g, or t
  misc_feature (103)..(103): n is a, c, g, or t
tggtnaacatatatcgngttttcttctccgattgattgccaatagtactgctcctcgactcttaggataacccttcggagtgccgctccgcatgaagtccagngtttgttttggatgattatgaactcctgtttttcggtttatcgctttagcatatttttttgcagattcagatggagagtacttctgaattttactatcagaaaatcca

SEQ ID NO: 557113 - DNA, 1468 bp, Homo sapiens
  misc_feature (201)..(201): n is a, c, g, or t
gactgataaatagaagatcaagagtagatccgactttagaagcctactttgtgaccaaggtagctccaatttattgcttttgcacagctttacgtacatcttacccagcagccattgtagcatattcttcttttctaccactcgtcattgcttctaacacatcagcactgcattcatcacacgggtgccagcagcacaccntctcctattctcgtcttgcacaagcacatgttatcaccatcattgggtcatccacgcaatcacactttgcacgttgcaccacttttccattactccagtcgtcaatcactcatcagacagcatgcttcctcatcacagctgggtgcagacacacaggtccatcatggcctctgtccacatcagacattacacgtgtgctcacactctccatcacagccactccatatcatctgtccacattttccaccatcacttccaattctctcctcgtccgtactggcttccacaacatctacacttctccactgcgctcggctctgtcatcggctcctttctactcacattccatctaacaccttcctttaaagttggacggcgcccaccaactccactttgtctcccgcttttctactcaatggcgccgaaccacaaccatgtattcccaaaattctatgtatcatgtcccaatggtacatgctacctacagatgactcgtaagccgaaaggtaaaacgacgcctttgcatacttgactgcgcacgtttacagctatcctgttgctaggcgaactaaacgtagagcagtaccacttatgttatgactatcaccgtttggacgttctacgtgcggggacaccattttgttgccaccacttcaccgctcgtatcaacacagtttatattgtcggcgccattgtttctcagtggaagttaatacatgatagggcccgaccacccaaaggtcgactcaagtctgcaagataaagccacgtcttgactggtgggatcaacgcaacggtcgtttcaacacaacccgaacgggtttctactcaatttgaaaggtcacctcattaaaggtatgtgagaggggagtcacccctttgtggtgccaccacgtttggtaaacattgtttcgggtaccacagtttggtagacagtcgcgaaacgttggtactcgcattttcaccagccgattttacgaaaccaccacacacaagcagtatctataaactaccaccccgtgtttggattcttaccagtttgtgccacgtaggttccccccacactttttccacaacaacacaagtatgaaactgtgttttatgctgaaatagattactcagcccacccagtctggggactaacagcccaccttttgtgggacacaaccaccgtatctgctatatccatgtggctacagctttgtacgtggtcacagatagccgcacatttaaccccacgcgttgcggtcttgatggaacaagccat

SEQ ID NO: 557114 - DNA, 290 bp, Homo sapiens
  misc_feature (2)..(2): n is a, c, g, or t
  misc_feature (80)..(80): n is a, c, g, or t
  misc_feature (99)..(99): n is a, c, g, or t
  misc_feature (113)..(113): n is a, c, g, or t
  misc_feature (149)..(149): n is a, c, g, or t
  misc_feature (176)..(176): n is a, c, g, or t
  misc_feature (183)..(183): n is a, c, g, or t
  misc_feature (185)..(185): n is a, c, g, or t
  misc_feature (188)..(189): n is a, c, g, or t
  misc_feature (192)..(192): n is a, c, g, or t
  misc_feature (214)..(214): n is a, c, g, or t
  misc_feature (221)..(221): n is a, c, g, or t
  misc_feature (224)..(224): n is a, c, g, or t
  misc_feature (227)..(228): n is a, c, g, or t
  misc_feature (235)..(235): n is a, c, g, or t
  misc_feature (261)..(261): n is a, c, g, or t
  misc_feature (279)..(279): n is a, c, g, or t
  misc_feature (286)..(286): n is a, c, g, or t
gngtgccccctgataagcccagccagttcattccagtcaaaagggtatcagtgtgaagcagcaagaaatctgcaggtggnggggagagaagcctggccncagctacccaacgngccctcctccctgactcccacaaggatgcagtaggncaggaagccctaagggatggggagtgngtgagtnanacnngcnatggtggggggactagggagtntcctggntgntcnntgtatcnaagcacagagctgaggaggtaggggnccctgccctgggggtggnggaggtnagag

SEQ ID NO: 557115 - DNA, 1159 bp, Homo sapiens
gtgtcgggccccgacgggcggcggcggctgaggtggaggcggagggagtgcggcggcggcggcggcgggaagatggcggctcccgtcctgctaagagtgtcggtgccgctggctgggagcgggtggcccggtatgcagtgtgcgctgccggaatcctgctctccatctacgcactaccacgtgcgagcggagagaatggagctgtggaccccggaagcacctggaggcaccatcatggacgaaaccattgagtggccccatggtggatggaaagtgctccagcacagcccttagccctcgcagaattgagaggatccgaggcattatgggtcctattataggggattccaattaatatacatggcaacaggggcatggatggttcatttcaacacgcaaggcaccaaaaacccacaggatagggattcacttactctccggggaacccacttagtcccacttaacattacactccaacatcaataccataacaagatatacattaacatatgggcatttgaccacgcacagcgactgatggacagagactatctggactccattcatagacaggttaactcccaatcatgaacgagaacgatgagaggattccccctgataaacacatggaccttaacatttcactggtaaccttataggtggcttgaaagggagatatcgtggcgacattcactccttggcacatcggatcaacacgataaccagttgcatgcaaacctatcccgttttacgttacacttccacatttaatccaaaaagctcacaaagacggacccttagggcttataaaccttatggaaaaccggaacgggagaccccatagaggggaaaaacaagagaggtcaccacccacacaccggacacgagagaaacgagcacaagaagtgaacagtgaataaaaaatcactagggcacccacacagatagcccgacgtggggaccaccacacccaagaaacaaacagcaaaccacaacaccccacacacgaccgacaaaaacaccactaggaggagcagccaccacaaaacagaggggggcgagatacaaaaaacccagattgtcggcaacacagggaccccacacggtgaaagcacacggaacacgattccacaaaaagcccccattaaaaaacccaagg

SEQ ID NO: 557116 - DNA, 385 bp, Homo sapiens
gcgtatcgctactgagcagctgtatgtggttttcttgctctagtggaacacgtatgtaaggaacagggatgcagagacaccctcactcactatagcctgtggatcacaagcattctgaattatcggtaaaagcacattagccagaaatcgtaacaggtcttttaaaactattgatgaggccaggcatggtggctcacgcctgtaatcttagcaccagcactttggagtgccgaggcgggtggatcacgaggtcaggcgttcgagactagcctggaaaacatagtgaacactcgtctctactaaaaatacaaaaaattagacgggcatggtggcagccacctgtaatcccagctactcgggaggctgagtcaggagaatcacctga

SEQ ID NO: 557117 - DNA, 222 bp, Homo sapiens
ggtcgaccgacagcgtcaaagccaagggcagcctagtaggtgcccgccgatatccaggccttctcgttgaacgccctggatgtcgaagcgacgaaggcgttgatccgcgaaaccgaatcgcagatcgtcatcaacgtcggttcgtccttcctgaacatgtcggtgctgcgtgcctgcatcgataccggcgtggcctatctggacaccgccattcagtcgacg

SEQ ID NO: 557118 - DNA, 1173 bp, Homo sapiens
agcggggggcgcaggcggcgggagtgcgagctgggcccgtgtttcggccgccgccataggccgcgagagacctagagaaagcagcatgagcagacgagcagcgatacaaggatccatacatgcagatcagaccaagcagggcggcgacagcggcaaaagcaagaacgcagcgaggaccagatgcagtagacgcagcaaaggggcaatttatgtgggaaccaaaagacatatgcacagacagctgagaagcgataaagggaaggcgcttgaaaatgaaggggggagtaggggcgagcgagatcaattttcgctaatctaggaacgaagttcaacgagccaacggagcagagccaaggcgaaatggcgagctagcgaatgcaacgaagacgaccgatcagctggatcgatgagctcgggaaaactgcagtcgagaaggacaaaaagctcgcgtggttctttgcatttgcccagagctgtctcagaattgcgctgggcaacagagtaaagcgatcctagacgcaatatttttacaacgtactttaagaaggaatcattgcgacatgatgaaaaagccaaagcaggactgatggcgcagccttggcaaaggtaggatgcgatgtgcgaactgatgttaaaaattcgtggggggaaggcatgtgaaggagtagaagtaagacacgagaaaagcctaagctagctccattgagcccgtaactacagtcccgctcaagaagcttgactttcttaatcgaatgggttagatcggactcaggagcggattttagcgagacgttgcgggagcaagtcaaccgaagctaaattatctcttgagctttcttatgctgaggattgagctgcccttctactccttccttccaagtccttttattttaaaagacaagtccgagaattccagaagtatccaaggcttctaaacccccgagttgtctctttcccagaggggaaatggctaggctttgacggagattaacggtttattggggattcaatgcctgctgaaaccggtgtgaacgcctaattatcatccgaattttaaaaacaagcttcctttaattccaagaagggagagccccgtggggtattttcatgagttcgatactccctgaaattttcagccattggctttatgtatgtctttcggatgtgtattat

SEQ ID NO: 557119 - DNA, 165 bp, Homo sapiens
cactggcagtgaagcgaaaacgggactccaggacgccacgctcggactgtgtcataaactcaggcgtctgggcagagcgatccacggccttcttgttggctaccaactatactgtccgtatacttgagctgacacttgaggtcatggtgaccctctcccctggat

SEQ ID NO: 557120 - DNA, 422 bp, Homo sapiens
ggaggctgaggcaggagaattgcttgaacccaggaagtggagggtgcagtgagctgagatcatgccattgcactccagcctgggtgacaagaatgaaactccgtcccccccccacccccacccccactaccccccaaaaaaaccagaaagctagagtaactttccactagttggaattgaacttcataaaatataaacattttataaaccctacaattcaggtaatttgatttaattatgactaatctataggaatatacaatacaaatttgtcagtcatccacaattaagaacaactatttatgaagaaaaattttactatgtttagaatgagattttattcatattcttgaaaggtagctttgttcccaataaatatttctcctactatttctgtatattttaggggatgttttcaattc

SEQ ID NO: 557121 - DNA, 515 bp, Homo sapiens
acattttcaactcaactattatctgaaaacatacgtgtgaggctatggaaacaaagcactccatatagagaaagtactgttagccaaagtatcattctaaatcttgctagactatgcttttactaagagattttgttttaagtaagtttttgttcctgttaaatctgcaaattcttgcaaaactctgtcaaggaagcaacacatcaaataccctaactatatacaaatgcaagactaccagccttttggtggggaagggcatggaggaacaagatgtattctaaaacccaactgtgcatccctcactttctcaagaaaccttgccacccacagcctatctcatgtactattgaaatgcagaaaaaccactacttgggagactaccatggtgcacagcaagtgcacagtaactgttccgtcaatttttaactcataaaaagctatagttcaaaatattgatctcatgtacacaaactcaactactattaaacagagacatagcacataaaaaaaaa

SEQ ID NO: 557122 - DNA, 188 bp, Homo sapiens
tgtatgtgtaagagaagatggttaagtctacggaggctccaggatgaagagtagtaccctgctaagggagggtagactgtacaagcatgtacctgcaccggtctccactcatagccagcatgcgcagcaggcagtaggcagcagcagggaggtaagcagtcagcacagcttatgttgtttatagcggg

SEQ ID NO: 557123 - DNA, 716 bp, Homo sapiens
agcggaagatggcggtggaagatggcagaccagtttgactctgatatttcctctgctcaactacttatgccctcttgctaccagaagatagttaacagaactgaacctaatccaaagctttcctgagaggaattcctcaagaaatcttagcgggactttgaagggagaatccaaatatattcagagaagttatctggatcatctggatgaacatgtcctagataatctagcactgcaaagagatagtcctgcactgttgcccaggctggagtgcaatggcaagatctcagctcactgaaacctccacctcccgggttcacgcgattctcctgcctcagcctcccgagtagctgggattacaggcacacaccaccacaactgggtaatttttcagtgtactttagtagagacggggtttcagtatgttggccagactggtctggaactcctgacttcgtgatccacctgcttcgttctcccaaagtactgggcttacaggcgtgagccaccacgcccggccaagcttcttaacctgagacctaggttacctcttctgcaaaatggttatcacactaataccatccctctaggctgtaacttggttactcattcatatcatgaattgcacttaactctttctgataactagcaacaaaggacctactgcaacgagcatacacatttaaaaataccaagcctcaacaaattccgacaca

SEQ ID NO: 557124 - DNA, 265 bp, Homo sapiens
gggggggccctgggggcccccctgaagcatttttcccccactttttttcttttgcttcctcccctgttgggggtagggagggggttggggggcccctaaaagggggggcctttttttccccccccccttcctttttggaaaaattttccctggctggggggggggccttgggggtttgggctgggcatccttggtcactccctcagccccgccggcggtgcctttgactttaaaaaaaaagccccccccgggctgtgtgtggcca

SEQ ID NO: 557125 - DNA, 409 bp, Homo sapiens
cagagaacttttgtcgaggtacctgaggttagaggcttactatgcaaagatcatgatgaagcgatgccacagacttggtacccaggataattggcctaagatgccatgccccgagagctgagcgtgtaggcctatgctggactgagttgaagctgacacgtggctggccgtgaggtatattacagatgctgattgtaccatgtccatactgagtgctcctagtaaggagcggacttcatcttgaacagcgggatgcagtgactcacataggcctgatctcacgacagtgccttgacttggcaggacggattcaaggaaggctcatgaccagtatgcagacgatctggaacttaatcatgacgatccattctggcacgagtccgctttgtgcacatgctgtcagcagcgg

SEQ ID NO: 557126 - DNA, 172 bp, Homo sapiens
ttatcactacacatgctaacttgcgtgggaaaacgtctcccctgcaaagattaaattaaagaatcagtcctttggaatactgtgctttaaagtagaattactggtggaaactgtgacgtaaaaaggacagacactgcatttaaatggtagttaaaatggaaactacagagag

SEQ ID NO: 557127 - DNA, 177 bp, Homo sapiens
ctggacactagcggatcccctgtattggtggtgctgccagctttataatggtggcccacctagccatttatgtttctaggcccgcaagaagtacaaaggggagtatcctatcatgtacagcaccgaccctgaaaacgggcacatcttcaactgcattcagcgagcaccaccaataca

SEQ ID NO: 557128 - DNA, 1324 bp, Homo sapiens
  misc_feature (486)..(486): n is a, c, g, or t
  misc_feature (1193)..(1193): n is a, c, g, or t
tgggtgaaaaagccagctgactttattggctctgggggcagggggctcaggagctctgtgggggggcgggtccgtttccttctttcaccatctcacaggccttctgtggcttgcgcaggatggtggcgcttggccctgtgcggatgtggcttgccatgtgcgcaggttcggggcggatacttgtgtcctgtgcggactcagtggtgttctagatgctgccttggagcttggcgcagagcatttctgtgtagatggttgtctccggcaccattaggagaggtgtgggcagggctctccggctttggccggagatcctccggctttaattagaccaccacgagacaaccttttgccgtgtcgggcttcgcccgggcttccacgcgcccaacaggtctttgcgggtgagaatccagctcctgtcttgtacgcggagaaaagagaatttggcgggcgccttctcaaagcgttttattgggcgccctccangtcgcttgataggcgctcgtgctatatattctcctctctttgtggatctcaggagaaacacctggggaggaaggcaaggtctccccgacaaaccagacccattcccattgtgtggcagagaatttgcccgcaaagaacatgttggcggagcggggctctccccttctctgacagggcgggcagaaccccgcagggaatctcaccgggggttgaaacacaggggaaaaaagccccccatgtgcgggagaaaccctttcttcgacatttctcgaaaaaaactttctgtgtttctctcaacccatcttcgtgggtgtttgtggggagaacgacgttttggggacgaaccaagacctgtgaacgcggcagaaaagtcaactgccccaaaagggggtgttgtgttgtgggcggacacgcccagtctccttccaaccagtgggggggccaaaagcaagccccccccgtttgtggtttgtctttttctctccacaaagaggtcttaaaggaaattccccccgcgtgtggtctccaagaggaatcccctttttgttggggccaattcctcgggcggaagacaacactgtgcacacaccaagttatcttggtctgtgtccccccaactgttgtcgcaccgatgttcttccgggaagggtgtgcccccaagatggcggcctcgacacagacaaccttttcttttgggcaacaacagnggggtccctcaaacagggtttcgcggggaaatctttatcggaaaggtttttacccgccacacacaacccaacacaccttctctctccacagaattcactgtgggggaacacactttttggggcgttaacgg

SEQ ID NO: 557129 - DNA, 214 bp, Homo sapiens
ttagaatcgagctcggtacctgaacattcgtgtccccaacattagagctaaaacagattgcaattcccggacgtctaaaccaaaccactttcaccgcttacacgagccgggggtatactacgagtcaatgctctgtaaatctgtgtgagcaaaccacacgtttcatgcccaatcgtcctatgaattaattcccctgggacacgagatgttcagt

SEQ ID NO: 557130 - DNA, 795 bp, Homo sapiens
gtcgtgaaaactacccctataaatctaaatgcgaaaggaaaagactcatatcaacattgtcgtctttggtcacgtagattcgggcaagtccatcactactggtcatctgatctataaatgcggtggcatcgacaacagaaccattgacaacgtttgacaaggaggctgctgagatgggaaagggctccttcaagtgatgcctgggtcttggtataagagcctgaaatgctagagcgttgaagcgtggtatcactcatctgatactctcctatgatggagaattgtgagaccagacaagtactatgtgactatcattgatgccccaggacacagcagacttcatcagaaacattgaattacatgggacctctcaggctgactgctgctggtcctgaattgtatgctgcctgggtgtaggatgacatttgaacgctggtatctcctaagaatgggtcagacccgaccagcaatgccctatctgggcttacagcactgggatgctgaatacacatctaaattgtcggatgttatataactagtgggattcctcttgagcacatcgcgtaccaagactcatgaatagagaactatgcaaggacaattttggtttagtggaatgtcaggtactttatgaattaacgatacatttggtcgtacataaccccgtgcgactagtatcaattaggtgccaattgctggttgggaagtggttgacaaactatgcttggaagccaaagatgctaataattgacctggtgttcgaggggcactggacagggcgcccttctgatggca

SEQ ID NO: 557131 - DNA, 534 bp, Homo sapiens
agcggggggggctgtccgggcccacggagaggacggcggcgggcgggggttgctgcagtggcccgcaccttgtcttccgcgccggcagggctgtgccccgtcgagacctgctcgggctgtggctccgtcctccggcctccagggtggctgggcggggggtgcgcggacgccccggcgtgactgccctcccttcaccagcgtgccaggaggcggtgtccctgtgacgccgcgcggccgcgctgtagtggccgtctgaggcccgcgtctgttcgaaggctgtccgacttcacggttccccgcgggctcggcccgggggcgtgagtgtcgccagcgggccgacgggggggccgcgcggtaggccctgtagcaaggccagggcactggtggggccggcaggaagagcgaacccgaggcatcgtggtgccatggcggggccgcccccacgggcatgggcctgcacaagctgtgggacgtaggacgctgacggtgggccgcgcacgtgctcacaggcccacggggcgtcgacggaggact

SEQ ID NO: 557132 - DNA, 872 bp, Homo sapiens
ttacaacgagggcggtaacaagcgcacatttcagaaaggtgggtgtaagaaccgccgttattggaggtgacggtggtgcgccccctcgatttttgagaggccctctctgcgtgcagagatgaggaggctctgcccggtgtgtagctttccttcgtgttagcccccaggtgttggaggggccttccctcaaccgggacccattgctgtccccccgcgcaaaggccctcgacagggacgtttaagtgttgtcacacccgaggaggagatttgtgactaaaagaagggcacttagttgagcgccactgtggacgcgtcgccgataagcttggagtgcaccaccttggtaagaacatgatgacgcgccgtgttaatgcagcccctccggcgggcgtattataaaacaacaaggggggtgcaacacagaggacactttatggttgaaacgtcatcgcacgctgatacacaatgtacagtccgcggtttctttgtgcaactattacgcgaacatctactggctgccaagacaacagacaatgttcttgataagaggccctcattcgagtgtcacccacgcggggtatggttaaacaacggttccgtttcaaatggactcggcgcctttctgtctcatcctcccgaacaagttttgttgtaaaaagtcctggtgtggttccaccctcccaaaggatttaaagacgtgtctgtaaaccaagcagcttctactatcgcggcatgtttcaaaaatccatgggagggctatgaatcagatgtattcatgaacagctgagatggagcatggtctttctgaaaaaacatttgtgaagatagctgtttgaatgtttcaggaaaaaaataatttcaaccacatgtca

SEQ ID NO: 557133 - DNA, 731 bp, Homo sapiens
aatacgaggctatgaggctcctgaaggtcaagagcgggtcaggatcacagaatgaggccagagacaatgtctcctaccaccagtgttctatcttgagttatgtcacactttaaccatgcctctaactgcaaatccttctgtctataacatgggtgtgtcactcacacttcctcagacgtattgtctggacgaattgactaaatatctaacagcatgcaaatatctcttagataaaatgacatcatgacgcatatctaatactatctttactggacacagaagtcatgtccctcctgtcgaatgtgccaaggtccactattataacaccgatagtacgccctacatgtaccaccttgaaattcgtcctctctcatgctggactacgtttcctacacaatcatacaagactgtatagacttacttactttcacttagacaacatcatcgaactgagcatttactatgctagttgacttctaaattttaaaacctacaaggtgcaaattgtgttgtaaaaatcatggacttactgtcttgcaagtaatttctaaaatacaaagttggatttgttttcaaagttaaataactgatattttccctctgctagatttgcgattatctgtagttaggtgatttttgaacgagttcaaagaacttcccatccaaccattgaactttaccaggctaccacgcacatttagaagattctcacacagagaccacacttcgga

SEQ ID NO: 557134 - DNA, 491 bp, Homo sapiens
tttagcagacctgttgatgtttttccccctaatcaattaaatcacaaatttatatagaccaactacttttatatatttcagaggcaataactttaaattaaaaaggctgaaaactcacaattcttggtaagtgcagaatagggattcttgacaaattaggtaactttttatgaaacagcagccaattccataagggagaaaatcatcccaaacacatttcaatcccttaaatcattggctagtgaatttatacagtgctcaaattttctaggaaaaaaaaacttgaaagttcatagtcattcttcaaatttgacaattcaagaaaaaaagtttgatacctactttcaaactctatatattccactgttttattattattgaatgagtaagtatgcctgtcatcaaagtgaaaacatcaatattgaaagtaaattccaatgaaattgttatgtttctccaacatctacctacatacatgtattgagaatgat

SEQ ID NO: 557135 - DNA, 111 bp, Homo sapiens
tttcgtaaactatcagcaaataaccttaatattatgtcttttagattatagctatcttaatggagatgaagctgtatctctttgtggttttgatttccatttccttgatga

SEQ ID NO: 557136 - DNA, 925 bp, Homo sapiens
gaggcatgaggcagccagggcaggggctactgctgaggggtgcaggcggaggctggtaggaaaccgcgaaatgatgtttttatctcgttttgaaagatagagattaatagaactactgtaaacaaattatcacgtccaattaggtcacataaagcattatgctttagcagtaaagtttgaaaacagtacatctataagagcgttgagattctctacagagaaaatcatgaagactttagaagagtcacgctatgaggaaggtaaattggataatgggtttctagataacatgagaggaggttgaggatgaagctttcttcagtggagtggatcaaaatgtatttgataagagagacatgaggagaatggactatccgagctccgaattgaaatacccacatcagaagggcaacagctattttagtattacccatgaatgggtgtcttagccctggctgtaacaggttcagttctacaagggttagtagggctgatatagaccatgacttggatatggcgatcttgttaaacatagagataaatatcgaggggtgattagcagacccttgaaatgccatgacgcagggtagaatggggtcatttttaaagcctagatgagcgcgtttgactaaacgccgacgatgatggacagattaatggagagtggtaacgatgagacgcccttgtgagacagattccacggttgacagtgcatcaccgactggagaagcggggcaggggaacgaagaatagagcaagatagggacagtgctgctgaacctgcttagaaacacaaggattcatttggacctgcgagtgggacgcgaggcactccaacggcggggcaaacagcggggcatggtccctgtagacctgggacgaacattcagaacaggcgatgtcaatgaccctgacggggaaaaaa

SEQ ID NO: 557137 - DNA, 88 bp, Homo sapiens
cggcacgaggctgaacgcaaatcagccactttaattaagctaagcccttactagaccaatgggacttaaacccacaaacacttagtta

SEQ ID NO: 557138 - DNA, 194 bp, Homo sapiens
  misc_feature (4)..(4): n is a, c, g, or t
ctantgtgctgtgggtctcctgtgatcccaagtatactctgcagatctttctgggaccagccaaggagtccctcagagcaggtacttgtgggactgtggcctatggggtgcaagccctagaggagacccaggtctacggagagagggactggaccagcaagtataggccaggagcaggggtgggtggagagcgg

SEQ ID NO: 557139 - DNA, 122 bp, Homo sapiens
  misc_feature (26)..(26): n is a, c, g, or t
taggtagaggcgcttccgtagctctntgcggtcatacttgacggtgaccttcccttggcgcctcactgggccctcatctgttccgccgtccgggccctctccgtgcgccgcgggggggctct

SEQ ID NO: 557140 - DNA, 119 bp, Homo sapiens
ccacttcagcctatcaagccataaaaagacatcgaggagctaagaacggtggtgtgggcctctagacccagctacttgggaggctaaggtgggaggattacctgagtctgctgagattg

SEQ ID NO: 557141 - DNA, 572 bp, Homo sapiens
catggctcaggattatcagtagcgagagatgtacatggacggatgggtataactggtatcaggatctccctcgtccagggaaggatacccgggtgtaaaaacttcccccttgccaggtactcaaagcaattgatttatacgtgggcaactcaaatccctgtgtgaagaaatctcagagctggaagattattgtgtgtcggtcggggtggctctgtcttgagtcatctcgtgagaaccttgtgcttgtggaaggtagaaattcgtcagcccccatttgaatgagagggctggaggatcaaatcaatggagagagggatttctattttgtaccaatactatggagaacaaaactgtttctttgaaatggaccttcatttattgggaggggaaagcagttagttcaataatggctgcctggtgccttccagcatttgaaaagacagaagaaagattgggagcaaggcaaggttccagtgttatctaaacaactcactaagcccagctacgggttggctgcggagcacttcctgctaccgggcctgcatcccccaatgtcccctacatgcatcagt

SEQ ID NO: 557142 - DNA, 392 bp, Homo sapiens
  misc_feature (89)..(89): n is a, c, g, or t
  misc_feature (211)..(211): n is a, c, g, or t
tgtgtctgtgcactaggctataggttgtgtggggttattagaccagcgactacagggaagagggaggggacagtgggggatctgttganaggccaggaaaaacaaggggagctggggctaaggaaccaaaggaggtgggaagagtggggctagaaccaaaagtggggtcctttcttgaaggcagggtggtcccttggctccccttcatcancctcctcttgcgcttgagtttcttcctcttggtcttcgtccccaggaccccgatgaacaggctgcttggaaatggggcaggtcttccgggtctgagtgagccaggggtccacgcagcggttgtggtaggcatgagcacaggggagtacccgcagcttgtgcccatcctcatattcatccag

SEQ ID NO: 557143 - DNA, 570 bp, Homo sapiens
  misc_feature (479)..(479): n is a, c, g, or t
  misc_feature (527)..(527): n is a, c, g, or t
  misc_feature (532)..(532): n is a, c, g, or t
  misc_feature (547)..(547): n is a, c, g, or t
  misc_feature (557)..(557): n is a, c, g, or t
cttccccgggggggtggttttcaaacaacccccctcttttaaaccccggggggggggggtgggggggtccccctttttgggggggcgccccccccaaaaatggttttttttttgtggggggggcccccaccctatggggttaaaaaaaagaggcccccccccgggttgttggggttttcttcccccggaaaaggggggccccctccgggggggttttttaaaaaacttccggggggccccccgttgggggggggaaaatttgggaaggggggggccccaaaaaaccccttggggccccttttctcacaaaaaaaccccaaatttttgggggggggtgggggggccccacttcttttttgtatataaaacctccccacggggggggaaaaaattttttgggagagggccccctccccccccccttggatattgggaagggggggggaaaatttttaaccccctcggcgcaaaaaaggccnctcctccccttttaggcccccctttagattaggcccaacacctttagnaaccnaggtttttgtacctnaacggccgcngcagtaggagcga

SEQ ID NO: 557144 - DNA, 607 bp, Homo sapiens
  misc_feature (499)..(499): n is a, c, g, or t
gtttccaccatgcactgctattttttaggagttgataatcttaagacttacattcctagttacatttgcgcttttctcaggttatgtctcgtgaagatttggggggagggctcttttaaaacttctgcctcagttgtgtaacagactctttaatatatcaatctgcactaacatctctgtgatatatgcacatattgtactggtaaccatgtctcctaaactactcgcgcgcatttgattgggcttcttgtttagggtcccttttttaatgcattagattgcataatgtgttctatatttctgctggactggacagaatgatctgtgtccccaagtgcgacaggctctggataaccttcgttctctgcactttttattgatgatttgtgactcaactggatacaggtgctcaataatcaagcttgcatgtgtgtcaggacgcattacaagctggtagccgatactgactgtgcatttgcaccatccttgactaaccttnctctatttgcctaaggggcctatggcgtggcactagcattcactgtcatattttgcagcgctcaagatgagggacgtccactattgatgtgctcgttcgcttctctgc

SEQ ID NO: 557145 - DNA, 369 bp, Homo sapiens
  misc_feature (217)..(217): n is a, c, g, or t
cagatcggtcagtttccttgccacccatgttgtaagctccatatcggtcatgtcaaccgtttcaatctggttaggctccagtcctagcaagtaagtgccgccctgttgaggtcatggcacactcttgtgtcctgacacgttggggttccaagcctgccttcctaatttttaacttttcccttaagggtatgactccggtgcatgttgtaaataagcnacttggctttgtttctgggggctttcaaagggccaatattcgggacacgttccgcagtggcaaataaattcatcaggtgcccatcccagaatgaaacaagacagcaaacaaaaaaaaacgaatcagtcaaaataaactcgagactagttctc

SEQ ID NO: 557146 - DNA, 1673 bp, Homo sapiens
aggcatggttctcaaggcacacagcctttgccaatcttgcgcagcattggtagcacccagccactcaccaacagcatcgccatcagcatccaacatcaggcacacacacaacaatgtcgcatttttcattccagctctgcatgagttcatgtatcgtatccatatgctgcatcagtccattcaacacacagctggtcacaatgtgctccacatgtcacatcatatttcggctgacgcatggtcttcagcacagtctgtcgtgcattctattgagcaccatccgtctgcatcacaacacattgccacacagtccaacacatcacacaccaggttgtcacttgggtatcggcatggctccaatcagccacattgcatcgccacaggcagcagcacacaacacaggtcagtatcacgtagtgttatccacctcagaccacaaagggtcacatgcagtagcacaggcacacagcacatccagtccagccagcacacagccgaccaaggcacatggctcggcagctcacaaagcatcgtcagtgcgccacatcctcaaaggttcaaccccacaccacacagtcacgcaacaagcacaacacacaagggcacctgcatagccatatactcaagggggctatcgcacacgctttcccgaaacacacgtgggcacccagggcaaattcgtacgcattcgacattcctatggtagcggggctctcccaatacttacccacctttttagctccccactatccgaccaattggcgaaacccaatttggcaatttgcaaggcaaggccacaagccatggccgcgacgttgttgaacccccgcagaaagaccatatctcgacgcgacgcacaattccccacttcaagctgggtgagcacacgcaatctgtcattacattggcaattaacacacacaccttatcgtcccacagggacacctctaggggacaccacattcacaacccacattcacgcggtgccactttcactacacagcacagtagggtccgctatcaggcgccgacacagcacaccccactcacaagagtcgggacagacaagagaaaccaggccacaggacccgaacgggggaccatggtcggatctaccacacggacaactactacggaagacacacctacgcgaccagcgtacacacagtgtacaacagcacaacaattaccaaggcagcgttacgacaacagataacgcacaacacacagacataaactaaacacgagaaaccacaggagaccgcatgagaacagaagcgaacatcacatcagccaaccaacacatgaacacaacacagaagcacatgacaacccaggtacagacaagagagacgcgaggagccaagcgatgcacaaacagagagagctaaataccaccacaagagacaacgcgagcaagcaagaaaagcaaacagacgtacacgcgcagagaaacacaagatcacacaccggtagagacaggcaacagagacaaccgcggacacagcaacacgacaaagatcaatagatgcacaaaacaagcagaagagtatccacagagaaaccacaccaccagcagcacccacaaccagcacacaaaccagcaaacgcacgagaagagacaaaaccagccggagagcacgaccacggacagaaatcgtacaatacacaaa

SEQ ID NO: 557147 - DNA, 326 bp, Homo sapiens
cctgggaaaaaatatttgattatgggtttggatggggccccctatgcccttgagggacccccccagtacctgttggacttgaaaagttggattgaggaaatgccctttgaacccctgtgccggagccccccccagggggcagcctgtgcccagttcaacgacttcctccaggagtatggcactcaggggggccaggtgttagggctcccctcccccctcccctgggaggaacctgaacctgggaaccattaagctggaagccctgctgtgtccccttttattaacccagcctggggcccgggcatattaaaggcttttggccccca

SEQ ID NO: 557148 - DNA, 314 bp, Homo sapiens
  misc_feature (49)..(49): n is a, c, g, or t
ctaattggttcttcgatgacgcttcacttggcttctcgcctggctcctnctccaaacctgagcatgtgcccagggctctgccttcccgaaggcaggtgacctcgtccagcccacggccttcctcgccgtgcacctgtgatggctggcacacctccaggctgctggacacacacccctacctgcctgctcatggacacacaatgggcatttccaaccctgtgttgtccctttcctcaaccttctcctccagtgaacagtgccactgtggactgcacccaaacagcgggagcatccgtcatcgaagaaccaattag

SEQ ID NO: 557149 - DNA, 324 bp, Homo sapiens
tgtcagagcctgccagagggtggtggtgggtggtgggggccgtcatccaccccacccagtggcattccagactttaaatatgacggggagtggcctgttcagcaacctccagcagtacgaccttccgtaccccgaggccatttttgaactcccattcttatttcacaacccctagcccttttttattttagccaaagagcttgtccctgtaaactacaagcccaacgttactcactactttctccggctgcttcatgacatggggctgctttctgggctctacacgcataacatcgatgggctttgaaagagtgttaggcattc

SEQ ID NO: 557150 - DNA, 905 bp, Homo sapiens
cctgttcaggaacgctgctttcgaaagaacctaaccctcctattgatgaagtgatcagcacaccaggagtagtggtcaggttggtggagtacctcaaacgaaaagagaatggtacagctgcatgttagaatcagcttgggtactgacgaaatattgcttctaggacattctcgttcagacccgaatgtgattcgaggcaggagctgtgcccatcttcatagagttgctcagttcagagtttgaagatgtccaggaacaggcagtctgggctcttggcaacatcgctggcagatcagtaccttgtgctgggactatgtcttagactgcaagtatccttcctccctctttttgcaggttattttcaaagcaaataccccggctgaccagtgatcccggagagtgcagtatgggctctgtctaactctctgtagagggaaaagtgcacctccagaattgaaagggtttctccatgtctgaatgtgctgtcctggttgctgtttgtcagttgagactgatgtactggctgatgctgattgggccctcctcatattctatcagatggacccagatgattagattcctaggcggccctccactgcgggggtctgtaggggacttgtggacaccgctgatgccttaatgattatgagtggctcagtcctgcttgcgagctgtgggaacctgtcccagggaggatcattagcacggtgaatctgaatgccaagtcgcgatattgcattgctgagacccaaggactttcgcagagcggtgagatctactatcaccggactgcgaaaccaagtgtatcacattcgccatgattaatggtcgcaaaaaggggccacacgtggggacacaaaggacagtccggaaaaatggataaacaacagttggaaaccactccc

SEQ ID NO: 557151 - DNA, 1390 bp, Homo sapiens
cgacaggtgtcgtagaaaacatacccctgaagaagaccaaaatgggaaaggaaaagactcatatcaaacattgtctgtcattggacacgtagaattcgggggcaaagctccaaccgagccttactgggtcactagttcgtcgcatctcataatatgacggctaggaaatccgaacaaacatagaagccattgaagaagatttggagaaggaggtctggtgagatgggaaagggctcctgcaagtatgcctgggtctcgggatgaacgtgaaagctgagcgtggaacgttggtgagtcacgcattagatcatgctaccgttgtggcaaatttcgagaccagcaagtgactaatggtggactgatcgattcgatgcccccatggaccaccatgaggactttatcaagagaacatgattacggggaatgtcttcagggctgagctagtgactgtgctgattggtgtgcatgactaggtagtctggtgaatttgaagctaggtgatctaccaaggaatgaggcgatacccgagaagcatgccacttcttggggttagacacatgggtgtgaaagacacctaatctgtcgggtggttaccaactaatggtattccacgtgagtcgcgaccctagcagcccagacatgagatatggagcgagaagtagctaagggaatgtcagcacgttgacttcttaacgaaactgttcgggctgacagatggcctgacgacaaggtgagcactttggtagaccacatcctctaggtccggacactgggtggaaccaaacatggtgggagcgcaatgtagctaaagatggcctctggttcccaacgggatgggaaccgttcaccggtgacagatgggcaccgaccaaagggggcaaagcaacaagcaaagccacgcaggggcacccgcggcaactgggatcaccaacccgaccaaaagtgggccgcaacgtggaacaccgcacttgggacacttggatgcgtgccacaagactggcccgaccacaactcgggggggataagggaaccgggcacaagagtgggccaatgatgacaacgaggggttgttccatacaacgcgcgatcggcggatccacacgatgatcacagccaagcatatacaacggacactaacacgtgggcatagcacaacagaacgcatgagcgtaaaactatcgcgggacacgttggcatcctgatcgaacaacgtagtcaccgaccagatctgatcacactggctgacacaccaagccgccagcgatggtatgatgggaaacatacagaacgcaagaggaacccaatcgtaatcagggcagaagcacgctctctctcgtcttcctctccacttgctctcttctcgtcctctcaagtacaggagagagggaac

SEQ ID NO: 557152 - DNA, 207 bp, Homo sapiens
  misc_feature (64)..(64): n is a, c, g, or t
tagttggtatgaaatcaaatagagtaatatgatgtaatacttatttttaatttgttttatttcntattgcctgtagcttcttcttggttttgttaattgttaaagtaagcatgtctttttacatttatgtaaatgtaaaatactttatgatcaatattaggagtttctgttttaattctgaaataaaattttcttccaaattattgt

SEQ ID NO: 557153 - DNA, 150 bp, Homo sapiens
  misc_feature (41)..(41): n is a, c, g, or t
  misc_feature (89)..(89): n is a, c, g, or t
ggaggatcctgcgtcttcaactgcggttcttacacaacctntctcttccagcttttgtgatctttcatatgggaggtggagggtttggntggcctcaatgctccgatgggttattggttttggggaaaaaggagagaaacccactgtctg

SEQ ID NO: 557154 - DNA, 280 bp, Homo sapiens
atcgtgttacctggtgtacatgctcctggtctatgagatactagctggtccataaagtcagtggtgtaaagtggactctgaaaaattctggcagtcggagctgtgagtcgacttaagggaaaatattaccgaaatagtggaacagtggcatgtgctccggtaagcaccatgctcactagaatggctaatgttcgggaagcagtgctgggcaggatagggttctgcaggaggcagtgagaaagcctggggctttttcctcttctccaatgtctaataagga

SEQ ID NO: 557155 - DNA, 594 bp, Homo sapiens
gagaaaagtgccccattggtgggcgtgtgcaaaagagggcgggggtattagataagtggggcagccaaaaggcccgtatgtggaaagccgggtaggcccaacatggggtaagagtctctcctttagttaaggccccctatacctctgttggtagccacaaaacccttggtgaccccacttaaaccggtaaagaccttgtagcaaaattgtaattcaggggtaagcacatctttcccgtctagggcccaccttggggggtgttcgctctatatgcccgcctggggttatatggttaataacttatcaagttgcagtcatagactgtgtgaagttatttggtaatctacggaaccctgtgtggttgtgaacagcaacagcaaagatttttcttgtactttaatgttcgggcgctgtaatgccttgtgcaattatcatgggtgttgtacgatcacgcataagtggacccccataataatgaggctcctcacaagtcacggggcgtttcattcattgaggacccaccctttttttactcagtcccctattgatctgggtttttccagcttgaggccccaaaagcccaacccaacatca

SEQ ID NO: 557156 - DNA, 147 bp, Homo sapiens
gaaacgtacctttgccggcgaccggatagcacctggcattctgctgaagtgatccagtctcgagtgaacgaccaggagggccgagaggaattctatgtacactacgtgggctttaaccggcggctggacgagtggtaaaaaagaacc

SEQ ID NO: 557157 - DNA, 194 bp, Homo sapiens
aaactattcgtgtgctgatagcgacactggagtggcggagaaattttcaaagaaaaatgagcgaatgggaggggtgcaaaagagtagagtatgacaacagcatggagaaaacccggtacgctcaaaaagaaaatggaaaaaataaatcccatcacccacagcaaatgacagctgctaaagagaacaccaatccc

SEQ ID NO: 557158 - DNA, 150 bp, Homo sapiens
gtcaaatggtgaatatgctcaacaatggctattcactcaactgtgtggtggggtccaaggcatgccaagagaatcgtaaatcaaaaattgctttccttgacttcagcctgcaaaaacaaaaatgaggcttggtgtcaggtggtcatacag

SEQ ID NO: 557159 - DNA, 1824 bp, Homo sapiens
tggcgccgggagcgcggatggctcacgcctctgtaatcccagctctcaggcacgcgctaagcaggcgggaggatagcttgagcccaggagttcgagacctgcctgggcaatatagcgagaccccgttctccagaacaacggaaccaaccctctcccaaccacccaccgagcgaacacagaccaccccaaccaccacacggtgtggcggaccgccaacgccctctccgaacacacgcctgtagaagaccacgccactggcagcccgagcgccccacggggccgcgttacacctgcgctctccccccgggcccatagaacactcctcgcgccccaaccaacacagcgacagcagagcagcatccccccccatatgaaaaaaaacgcgccagaggggaagaacagacccgcgcttccgtcccacaccagccacgaagcaggaggcagtcatacggcgacgcatccacacggtgggccctcgcccaccccccggcggagcccccagccgcgagcgcgaaggcgaaaaatgcgccccccactgctattgtgttatttactctcccttcttactttctctttatattacacaatcacacaaaacaacaaacaaccatagactacatctttatctacatcatccttcctccttcaccataccccaccatacataacaacacaataccaagaacaaaatatatttctttccttctcctctctacctcttcctctcctcctccctcactcacgctagcacaacagcgaaagtcgattgtatttatcttcactctctcccctttcccttcccacctctcctccccccccgctcagccccataactacgagaaagcgcacaaaccgaccaacaccctcttcctcctttccccctctccttcttttcgcccctgccaacgcaccacgaacggcagcaaattcggaccctcatcgtgtcttctccccgctccgctcctcacagccttccacttccacgcaaccacgaccactcagatatgaaacctcctgctctaattactctctcaattactatttactctcctctctatcctccgtcccgccccttcctgtacacaatacaagcagaacaaacagactagtatctcccttcactcacttccccttttctcgtctattccttctcctactgcctgcgcgcctcgtcactgcgctatacacgagtagaggaatctgatgataacgccagcttccatcagctgctttctctcttctcctagcgccccacccgctcgaatgacgcgcgtcccctgagcaatacagctgcccctgcccccttctctgtcccctccagctctccatcacatccgctctgccatccaagcgcccatacatacacatcaaacatcacccatctcatacgcctccacttaccctctcactaactcactagtaacacacactgacacaagatctcctcgtgcgtcaccactccgccgcctctcctactccccacgacaagccagcaacaaacactctgtcttcctcttactatctcactcctcactccaatgtcccctgagccacttgccatgctactcacattgagtcagacacacagtcaagaaattaaatactatactattctttcttgctcttcctcgcccttctcgatcttccattaccctgcatacacatcgacgaaccatcatcattatggcactctctcagttgctacacgccatcatccctgactccctactatccaccacctacgccaaccaccctactcgtactgtctttcgcacctcattcttctctcctcgcatctcctcatatgcctctatatctaaacac

SEQ ID NO: 557160 - DNA, 243 bp, Homo sapiens
gggtttttcccccccccggggggggggggctttgtttttaatttggtttcccctttttgggggggggcccttcccccctagggtgttttgcgcccccttttgggggggtttttttttttttttgccccccttttggggggttcccccccccctttttccccccccccccccaaagaataaaaaggggaaaaaaaaaaaattaatatcaataaaataattaaaaataataaatgttgaataaaa

SEQ ID NO: 557161 - DNA, 120 bp, Homo sapiens
tgtacaaaacatcactctacatcaccagtattagagacgcctgcccagtgacacatgtttaacggccgcggtaccctaaccgtgcaaaggtagcataattacttgttccttaattaggga

SEQ ID NO: 557162 - DNA, 380 bp, Homo sapiens
tcgagacagaatttcgctcttgttgcccaggctggagtgcaatggcatgatctcggctcaccacaacctccgcctctcgggttcaagtgattctcctgcctaagcctcccaagtagctgggactacaggcatgtgccaccatgcctggctaattctgtatttttagtagacatggggtttctccatgttcgttaggctggtcttgaactcccaacctcaggtgatctgcctgcctcagcctcccaaagtgctgggattacaggcgtgagccaccgtgcccaacaggtatatcgaatttaagatttcaatttgtgtagcacaatttatttaaaagtcgaccagttcgttaaattagtagtagtaggaaaaccgggaatttc

SEQ ID NO: 557163 - DNA, 1481 bp, Homo sapiens
cccgttgtggtgagacgtggttgtgtttctcccctctttgggttagtgatattttcaatagggaggtggcccactgtgtgggtgatgttatgtgcaataccccccgcgtagagtcttttctctacggagatcacctctcgcccgctttattcttggtgtggccccagcccattttgtgtgcttgttaagggtttcctcatacgcctgctggtgttgtggtaaataattccattgtgccccaccggggagtggttctctcctggtgtcggtgtcgtggggtgcatccagtgtcatacgaccagccgtctttgggggggggttgcccaccagggccttggggcccactatttctcccccctgtgggcccccccggggtggtgtgtgagcccaccgcgtggctctccttttgtcgcccctcgtgtgtgattgttgtccgcggggggtaacaccgcgagcacacgttgtgggagagttggcttgttgccccagcaggcccacgtcgtcctgttaatattgctccacgggggggtttctatcgtgcccgggggaagatttatattttttgtctcgggggggcttctcaacaccctccccttctttggtaaaacttgttcgtggggccccccaaatgcccacacggggggccaccgctgttttataggcgccaccgccccccctccagtcgttgtgttgaccacaggggcccccctttggtggtgggcccacccctggggtggcactataccctctcggttcactaaggtcacaatagggtccctcggagtaccgcaacggcgttgtgttgtctctcggttcacaacgctcgctcccccccggagtttttcgcccacccggagacccacagggagacactattgtcccactacagtgggtcccttctcacaggggccacactttggccaacccccgggcgccccccttttggcccccatcgtttgttctctggggtacacgtgttttgtgtgaaaagagtgttgtgtggaaaaaggaagaacctccttcgagagtgagaagagacacacccacagcgtgttaatattgtgataaatatataggctctctcgttgaagagagccacccacatcgtccctcttggccctctgtccttcttgtggaacttgagacccgcgagaaccggctcacatagttggcgctgaagaaatgggagacccacattctctcctctgtgccgccacactgggcttttccgcgcgctgccacccgtgtgctcggtgcgcgtttccccttcaccgccacgaccacgcgaaaaggtggtttggcgccacacttctgagtccacactggaaacctctctggattcacaccgcgcgctgaatttccctcttttcccttacatcccattaaaactacacataccagactggacacaccctgtatcaaaccggctgaatatccccttttcccgttacctcccattaaagcgtaccatccagacctgg

SEQ ID NO: 557164 - DNA, 80 bp, Homo sapiens
aagaagtatggctttttatgcatccttcatcgagggcattgaagttgcatggactgataaaagttgatgcaaaaaaaaaa

SEQ ID NO: 557165 - DNA, 340 bp, Homo sapiens
atcccctgtcgagatgtgacatctctacggctgctgtgtctgcgctggcgcttacctagctgccttctctccacccaccacgccttggattggtctggcagaagctctgtggacgctgatgcgagcctgggctgggtccccctaagggaccatccattgctgataacacagggaacatctcttaaagaatgctgggaactgtctaagccccgcagtcattgctcggcctcctgaaagatgcttccaagtcaggcggatgttaacttcgtgaacgctaagctgctggtgaaagaggctggcctcactgtcagcacctcccacagccctgctgcaccagggg

SEQ ID NO: 557166 - DNA, 286 bp, Homo sapiens
  misc_feature (262)..(262): n is a, c, g, or t
gaattccccccccccccccccccccccctatccagttggtgggggccatgaggtggaaagtagtttttcacggaggggaggggaaaagggggaaccccccaaagccatcgtgtgacctgtggaatgtgtgaatcccccgaaattgttcccagctgtggtttaatccgggggggattggaagggagaaccagtccctgggttgggagtgagggtgatttttaaaccccataggccaaattcgataaaagttagtaatgatttntttttcctggagaccggtttataa

SEQ ID NO: 557167 - DNA, 803 bp, Homo sapiens
  misc_feature (11)..(11): n is a, c, g, or t
  misc_feature (18)..(19): n is a, c, g, or t
  misc_feature (70)..(70): n is a, c, g, or t
  misc_feature (72)..(72): n is a, c, g, or t
  misc_feature (431)..(431): n is a, c, g, or t
  misc_feature (433)..(433): n is a, c, g, or t
  misc_feature (522)..(522): n is a, c, g, or t
  misc_feature (555)..(555): n is a, c, g, or t
  misc_feature (558)..(558): n is a, c, g, or t
taaataaattnttaattnngtaataaaaaagaaagaaattaagatattaaattttataatagatgtgaantnaggagaaagggtaaatatttataggaaagtgagctttggcaaagtaacaaaaaacataaagtggggaacggacaccgtattgaaccaatgatgctgggataattggcaagccacatgtaggagaatgaaactagatcctcatctctcaccttatacaaaagtcaactcaagatagatgaaagacttaaatctaagacctgaaaccataaaaattctagaagagaatatcagaaaaacccttgtagacattgacttaggcaaagacttcatgaccaaaaacccaaaagcaaatgcaacaaaaacaaagattaaatagtgggacttaattaaactaaaaagcttcttgaaacaaaaataantngaagaataaattggccaacccacagaattgtgaaataattttcacaatctttacttccaccaaagaactattattctccaatttacaanggactcatacaaatctggggaaaaaaaaaaaanatnaaaaaaaaaaattttggcccccctggccccaacaatttttttatttttaaagttttttttttccccccccatttaaacttattttttcaactttcccctatagagaggggattaaaattacattggcgcgggtttaaaaaaaggagttgggaaaccacacccgtgcccccctatatagcttgggcacaaacccttttttcagggggggaaaagaaaagaaccgcccccccccctttctcaattta

SEQ ID NO: 557168 - DNA, 213 bp, Homo sapiens
  misc_feature (4)..(4): n is a, c, g, or t
cgancttctgctctgaggggcagtggctttgacgagactgggctggctccactccatgaggtatttccacacctccgtgttcctggcccgtgccgggtggagccctgtttcatctcagtgggctacgtggacggcacccagttcgtgaggttcgacagcgacgccggggagtccgaggacggagccccgggcgccgtggatagagcagaaggt

SEQ ID NO: 557169 - DNA, 812 bp, Homo sapiens
  misc_feature (14)..(14): n is a, c, g, or t
  misc_feature (19)..(19): n is a, c, g, or t
  misc_feature (24)..(24): n is a, c, g, or t
  misc_feature (26)..(26): n is a, c, g, or t
ggaaataaatttgngcctnattgngnatcagccgctgcattggccgaggatggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557170 - DNA, 181 bp, Homo sapiens
gcatactgtacaaaggctaataaactagttgagaagcagaacccagctgacggactgcacactttgggggctcaacatgcaatgtggtcttggctgtggcaaccagttgccaaaaacagatggaggaagtgaaaccaataaacagcgaagcaaacggcacacagaggacgggtgcgaacgc

SEQ ID NO: 557171 - DNA, 872 bp, Homo sapiens
ggcacaaataatgaagctctagctcagtatgttcatgtatcaatattgtagtatttaaaatgtcctcatgtctccgattctcttgctttgtcctctcacttctttagcagatgtctcaagaaaatattgaggaagcagagtatatctgtaggctcttctgacccctagttttcttctggatcattttgctctgtgtgcatgtgtatgtgtgtatgtgtgtaataactacacatagaagaactgccttggaaggtttctgaagagaactcttagtgtttcatttggctttgtaattctaatgagttcttatctaaccaactcccttcttttctttttcagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557172 - DNA, 3804 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557173 - DNA, 3644 bp, Homo sapiens
gttggagttggtggtggcttaagttttgaagggaggtagcatccgtggatatccacaccatccttctcgctgcagggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557174 - DNA, 3144 bp, Homo sapiens
  misc_feature (14)..(14): n is a, c, g, or t
  misc_feature (22)..(22): n is a, c, g, or t
ctacgtcgaggccnggtgttantcggccgaggaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557175 - DNA, 3833 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaaggtggctggtgaaggtgctgatcaccacagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557176 - DNA, 3076 bp, Homo sapiens
ggcacaaataatgaagctctagctcagtatgttcatgtatcaatattgtagtatttaaaatgtcctcatgtctccgattctcttgctttgtcctctcacttctttagcagatgtctcaagaaaatattgaggaagcagagtatatctgtaggctcttctgacccctagttttcttctggatcattttgctctgtgtgcatgtgtatgtgtgtatgtgtgtaataactacacatagaagaactgccttggaaggtttctgaagagaactcttagtgtttcatttggctttgtaattctaatgagttcttatctaaccaactcccttcttttctttttcagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557177 - DNA, 2285 bp, Homo sapiens
cagctctgtggactgttttcattttacacacgtgtgagcaggcttagagagatagaataggtgagctagataatattgctcgtagcccatgcttttcacatatgctaagccatagtggctctctcaagccctctttttcttaagataggctgttatatttctagaatatcttaggatactctgcagactgaaatttggggatagggcttttggtcagcttataccatatttgtattctttcccaaaccatattgagctgggttttttttttcccctcaggtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557178 - DNA, 2058 bp, Homo sapiens
tggggtgagatggaagcgagatcggtaagaatagctcaaccatgagcggcttgactatggccgatactgcctcctggtcctggcattcggactcgcgaagagcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtga

SEQ ID NO: 557179 - DNA, 3977 bp, Homo sapiens
  misc_feature (106)..(106): n is a, c, g, or t
  misc_feature (113)..(113): n is a, c, g, or t
  misc_feature (115)..(116): n is a, c, g, or t
gcgtcgcatcgttcctggccagttcttagctgtgtgatcccaaagggcgagccgttatgattagtgccattgagaaacagaaattggtgtatatttagaacagagntgctgcngnncgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaacttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgaaacacacacctcaccactaccacttcccccgccaccaacacacaaaaaagggggggggggcaaaaaatatcctcggggggcccattttcggcaccccttttttgaaagggggcccaaagggggggataaaagaggcgggggcgcgaaaacgcgccgggggaaacgcgcttggc

SEQ ID NO: 557180 - DNA, 723 bp, Homo sapiens
aaaaattttttttttttgaagaggggggggggtttaaatttaaagtctccccaaaaacccatccaaaaaaaacccggccccaaggggggggtgaaccaaaggggggtttggggccaacaaaccaaaccgggttccaagggccagggtccccctccaaagccaaaaacttcccctccctcccctaaaaaagccttttcctcaaaagggtaccaggttttttgccaggctcaaaattctccattttggggggttggcccaaacaatgaaaaagggggccccctgggaaaacggaaggtcaaaaaaactggttaaaaggcccaacaaacccacaggaaaagacccccccccctttttaaaaaaagggaccttcctatttttcaaaaagggtggcggggttttgggcattcccccacccggatttttttaaagggagagttgcccactcccccccaaaaaaggcccaaccgggggccggggaataaaaggggcccttgaaatttaaaatgggtttttttttccgaaaaaccccccgaaaaatattggggagaaaaaggggtttctaagggggaaaaaggggcaaaaaaccccaaaaatgtggggaaattttttcaccggaaaaaagggcacccccctccttttggtgggggtgtcccccccaaaccggtgtgttaagggggttccccaacctaaaaaaacccccccctgggtttttaaggcaaaaat

SEQ ID NO: 557181 - DNA, 447 bp, Homo sapiens
ctcgagctgtgtaccaagagtggtgtacttttgtccacattggtggcagtaaagccccagctattgctcatcctcagcagcttgtgcccaagtgtgtggtttggcttctcagccaccgtcagtgctgtacgatagagttgcttccagccaaggatgtggtgcctgactccagcgtggcagggggctagtggctcgattagccagaatgaggatccacaagagcttgcaggggttggcgccattcctgccggcacaggaccctgtgcttgccctcccacacccatgcaccagcactgttctggacggggcctttggccagcaggagccagcgtgaggggctgggtgcgctgcacggtggtggtggcagcccatggtgcggccccacggcctcagggacccatctccacctgcaccacggcatatcgttacccagatcatcccgttctc

SEQ ID NO: 557182 - DNA, 148 bp, Homo sapiens
  misc_feature (1)..(1): n is a, c, g, or t
ntcatggcgctcctggatggtagcctcacaggatggaccgactctgtgtccttgaatcattgcatggaagataattggaagttgccaggaacaccagccttggacagttatgcgaacaagaaataaacttctggcctcgttggcctca

SEQ ID NO: 557183 - DNA, 729 bp, Homo sapiens
tggtcttggtacaaaatttaataaagggtctttaaagagcacctatccaaatctccaaaatacatgtcggccaaggaaacccggtatatgctggggggacgtggctgtggggcatgtggcagggcggctctctgtgcttccccacccttctcgtgatctcgtgaaatgtgggggtgtgggtgggcagatatctcctcattcttgtggggttctccacaatgtgcctcaccgtgtgtgctcgaggcagggtgctctctatggcgggccaaactcttaccacaggtgtggggtctcccaggggggacacagacgtagtgatctcttcacaccctgttgattgtgcccacagagacaaacacccctgtgtgtctgtgagcacacaacacgtgtgtgtgcggacaaacagagacaagtgtgttcaccagagataagaaaagtttacaaggagggggagtacacacggcgagaggtgtgggggaatctacaatctcagaggggcaacattttccacaccaaaaactttctaccgaggggggaatttattaaaagggccccctctgctgtggctgctccactcgggagaaagggtgttcccccccagaaataacacccaaaaaaaatctctctcgtgacaaagccccttttgtgtgtggcgccccacaaaatcttctctaccaaagttgagttaggacaccgcgggaagagcacaaaaacacaaatatgcgtggg

SEQ ID NO: 557184 - DNA, 407 bp, Homo sapiens
aaatcccactttctagactggcctgtgaaatgctgttttattgttgatgtggcagcagaagctaaccaaatgctgttacataccagatctttcttttttttttgctttcgagacggagtctcgctctgtcaccaggtggagtgcaggggcgcgaggcgtgatcccggctcactgcaacctccacctcccgggttcgggcggttctcctgtgcctcagcctcccgggtgtggcgtgggactacgggcacgcgccgacctacgccttagctagattagggtgtgttggggggcagacggtgtgctcaaccacgtgtcggccggggattgcccccgaacccttggcctcgtgattagacagtgtttcggaccccaatgttgtgggattacaccgtgttggaagtgcttcc

SEQ ID NO: 557185 - DNA, 441 bp, Homo sapiens
caggtggatcacgaggtcaggagatcaagacaagcctagccaacatagtgaaaccccgtctctactaaaaatgcaaaaaattagcctggcatggtggcaggcacctataatcccagctactcgggaggccaggaggcggaggttgcagtgagccgagatcgcaacattgcactccagcccgggcaacagtgcgagactctgtctcaaaaaatatagatatagatatagatagatagatagattcttaccatgcaatctagcagttttgctcctgaatatttatccaactgaattgaaaacttatgtccacataaaaacctgcatgcaggccaggcatggtggctcacgcttataatcccagcagtttgggaggctgaggcaggacgatcgcttgacgccaggagttcagaacagctgggcaaatatgagacccatcttaca

SEQ ID NO: 557186 - DNA, 115 bp, Homo sapiens
taatctgtaactgctgaaaatgaaacatgacggctgaaatttatccctccgtagaagtactgggataaagagtaacctgtcatagagtctctcaaatgttgcaacttgaacggtg

SEQ ID NO: 557187 - DNA, 460 bp, Homo sapiens
  misc_feature (393)..(393): n is a, c, g, or t
  misc_feature (419)..(419): n is a, c, g, or t
  misc_feature (446)..(446): n is a, c, g, or t
ttctaccctgttctacatcaaatgcctgattcctaaaaggcacctccttaggtatgactttgaattttttttcttttaaagacaaggtctcactatgttgcccagactggtctctaactcctgggctcaagggatcctcccgcctcagcctctcaagtagctggggatcagaggcacatcactgcacctgccttgcgttttttaacgtttccaacagtttctatttctcccaccgagtaagctctgctctgcaagaagttttagactttgttattgcaaagccaaatacagtgcctgggcacagttaggtgctcaatgtctaatcaacttagtgacttcctatcccttaacaagaagaatttaacttggccaaatttcttctaaggtttttcntaaaattgctgggaattcttaaggtnacttacatatttaccattaaatttaantcccaaagttcaac

SEQ ID NO: 557188 - DNA, 352 bp, Homo sapiens
acaaatacatttgaactcgattacaatttaacctgcatattggggctcttttctcaaaggtcatatgttgtgtattaaagaaaacttctatcagggaaccttgtgctacaggcaggccagaatttgtgatgttctcagtgggccttcaagttcattttgttacccttcagatacttgagtatcttcccctgttataaacagtatactagccaaaacaaaatggcatttggcaaagaaaacccaaattcaccgtgcatgggaatccagtgaagaaatgtttaatctagttagtggggtgggcttcggttgtcatggaaactcagctctgtgatcctgtgttgttactaggccg

SEQ ID NO: 557189 - DNA, 207 bp, Homo sapiens
cgagtcgagaccagctctggacacatagatgaccctgtctctacaaaaaaaatgaaacaattagctctgtatggtggcacatgcctgtgattccagctactttggaggctgaggtgggaggattgcttgaacccaggaagtcaaggctgtagtgagccatggtcataccactgcactccagtctgggtaacactcgagacctgagca

SEQ ID NO: 557190 - DNA, 363 bp, Homo sapiens
agcggcgggtgcggcggatcccagggcagccttcggacggaggcgctgcctggtgcgtcgcggcgtggtcctacggcggctgtccgtggcggtaggagttggctgcgggatgtgctcagccggtgagctgctgcggggcggcgacggcggagaacgcgacgaggacggtgacgcgctggcggagcgtgaggcggcagggaccgagtgggatcccggagcgagcccgcggcggagcggacagcggtcgaaggagagcgagcaggatgttgaagactcacagaaccacactggtgagccgagtggagatgactacttgacaaggatgtatttttggagaacgaatagtggccaggtatagttttt

SEQ ID NO: 557191 - DNA, 102 bp, Homo sapiens
tctttaacctccttaaattccccgggccggcccccccaacaaaggattttcccgcccaaaattttaattgttttaaggttaaaaaacccttgttttggccca

SEQ ID NO: 557192 - DNA, 166 bp, Homo sapiens
cccaccttatgccgtgggattctcttcagtgcactgaaaacccacatggagtgaaggctgtcaccagtgggcagctgctgtgccatacgccctagtggttcaccctgtgaccctcgaacacagcgacgcgggacagggtgcagtgcagatgacactggtgaacgat

SEQ ID NO: 557193 - DNA, 334 bp, Homo sapiens
  misc_feature (233)..(233): n is a, c, g, or t
aagccccccaattcccctagagggcagggggggagaggaaccccacatccaagggggttcaccccccatggggacagaaccctgaacagcagcccattgagtccccagatctttcccactgaaacaatcctaccccaaatgagaagaaatcagaaaagtaactctggtaatacgacaaaacaagattctttaatagcatccccaggagatcacactagctctccagcaatggntccaaaccaagaataaatctctgaattgccagaaaaagaattcaaaaggttgattatttaagctactcaaggagataccagaggaaggtgaaaaccgactt

SEQ ID NO: 557194 - DNA, 363 bp, Homo sapiens
tccagtcaggtcgttgtataatcacggccagtgaattgtgatctgactcactagaggctgaactgggtactgggccctccctcaagctgtttcatctgttacattggtggtgtgctctgcactttacatgagtgaccagcattatctatgtagcaaaagtacgcacaggtgccgaggtaggctcagccagtgtcgtcatcaggggtgggcattcgggctaaggcttaacttgccgtcagtctcatcagattcgtcagcttctgggcccccaagctgggtccgcgaatcgtaggtgtctggcatggtgctctcgttggtctgcgtggcgcgcttgggcacgggggcctcctcggtcagtgtgcc

SEQ ID NO: 557195 - DNA, 487 bp, Homo sapiens
agtggggaagcctcgacagccctgagttcagcagcccaggtagcttcgcgagtctctctctcatgcaatggcttcagccgagcaacagctcacaggtgctgcaagagaaacagcagcagctttgtgaagcttcagcaaccagaaagcaaagctggcaagccaaagttcacatcagacaacagctgcagcagctgccagcacgcatcagcagtaggtccctgttccacaagctctgtgccattccaacccagattggcttgcgcccctggattcttgcattcaatccatctgagtgttcatatgccacaccactcccaataaacaaactaccctcatctgtttatggagcttccagtcaggttcacgtcgcagctcccaattgaaagcaggttatcccggtctgtgacttcaagtgcccgaacctgtgcacaagcttttctcacccaaggggctcaagttccactttggattccctcacccaagggca

SEQ ID NO: 557196 - DNA, 114 bp, Homo sapiens
tggcagcacaggttggacagcacagaggaggtggacagcaagaggaggagcagaagctagaagcgcacagtgactgggttcgagatgtggcctgggccccctcctctgtgctgt

SEQ ID NO: 557197 - DNA, 1498 bp, Homo sapiens
gagtttgttttttgttttttttaaaaccctttaaaaactttatggtaagtttcaacatctaaattggcatcaattggatacatcgtggctcatttggcagaacattaacagttgtgcacattgtgcaagagtcaacttgtgcattcgggtctttacatgcctcagtgggggttccacccctgtgccttcccttcttcccgtgaccgtgcattccgtgtccctccaacagtcgtgcgcctgtgcctctcctgtgtgtccgccacagggtgtgtgaagagacccaaagccctgtgagagaagaacctgtgcgtgtgccacgggtggctgtggctgtggctgtgcagacgcctaggaggggccatggcacgttacgccctgtgcgcaacgagggcgagggggcagaggactagagagagacactcgattatctctcctctcttatctctgtgggctgtgtgatgccccgtgtgccgagagcgcgagaccccaccagaaagtgtgcaccttaagtttcaaagccccaagttgtggctctccgaaggagaacgccctgtggcagtgtgtgtgtttctatacactcacatgtcaccacatttttccaacacccggagagagccccaatatgtgtgggatattaaacctttcccggagacatacctctgtgaggccaaaaaaatttaaaccgcgcagaggttttcccacgtgggagagaaaagtcttcccgaggaaaacccttttgaaacacccaagtgtggccatgttggggtatatttacaacccatgtttactttgtggggtatataccacttaacgaatttgtctagcgcgccagccaaaggggttactgttggcacgcaggctcccctcctgtgggccactttgggcacaaccaagttctttgtggtggagaacgtcgaatatcgaggatctccccgcggttggtactttccttaccctcatacaagtcttcccccccagacgaacggcattttccggaaacaatccaacaaggttttttcgccaggcatggacactacaactccaggttaactctttaaaacaaaagagtttcctcattgacaacgcaacggggatctcattggaaccaatgtggtcccttcttggggcgcacacgcgatacacaattattaaccctgtactttccgcccctatatcaaacgagacgtccatgtggacgcacttgtaacccgtggtatacccacgcataacagacacggtggctttaacaagcaaaattttcccccaaatatgcgcaaaggttcgccaaatctaaacatgtgcctggcgctgaaaaaacttcttctgcactttttaagtgtgcacactttttaaacgacacgttttcaaaacagcaagattgttgaacctccccaacctatatgggggacaaagggccccaatataaaacatttgtgattgtcacacactgtcgtacaggtaatgttgtcagacataaatactcaccaccaacataaag

SEQ ID NO: 557198 - DNA, 345 bp, Homo sapiens
  misc_feature (47)..(47): n is a, c, g, or t
  misc_feature (71)..(71): n is a, c, g, or t
  misc_feature (99)..(99): n is a, c, g, or t
  misc_feature (140)..(140): n is a, c, g, or t
  misc_feature (217)..(217): n is a, c, g, or t
  misc_feature (244)..(244): n is a, c, g, or t
  misc_feature (267)..(267): n is a, c, g, or t
  misc_feature (270)..(270): n is a, c, g, or t
  misc_feature (341)..(341): n is a, c, g, or t
gaaagccccctcccatcctttttctggcctttatcctataaagtganagccacttcccttacattctaccnaaggaagagtaaatgccagactggccgnagtggctcatgcctataatcccagcactttgggaggccganacaggtggatcgcctgaggtcaaaagttcgacaccagcctggccaacatggtgaaaccctgtctctactaaaaatanaaaaattagctgggcgtgctggcgggnacctgtaatcccagctactcagnagnctgaggcaggagaattgcttgaacctgggaggcagaggttgctgtgagccatgatcacgccactgcactcnaacc

SEQ ID NO: 557199 - DNA, 654 bp, Homo sapiens
ttaaaactgcctggattagaggggggagccttcggcattggaatattggttggagagggaattaagttgcagttggcctgtgagattgggagaatgggctggttgcaggggttaaggcctataatcccagcactttggaaagccaggggggttggatggctggagtccaggggttcaaaaccagcctaaccaccatgccaaaaccctgactgtccaaaaattagctggccatgggggacatgtagccttagaggttcaggaggttgaggctgtaagtgagccaggatggggtcactgcactcaatcctgggcaccagagcaggaccctgtctaacaaaaaaaaaaaaaaaaaaaaaaaaaaaccttgtcggccgcttgggccaagccgattttagactcgagcaggctaatgcatgcggccgaatttcgggctaattggcccaattggccttatagggagccggattacaattaatggcccgcggtttaacaccgtcgggacgtgaaaaaccttgcggtaaccaaactaattggcttggaagaaaatccccttttggcagagtgcggaattacggagaaggccggaccggatcgcctttccaccggtggccaacctggatggccaatggtttgtaggccgtatttggttccggg

SEQ ID NO: 557200 - DNA, 814 bp, Homo sapiens
agagtgcctagtgtgggagaccaaatagggatcaccaggctaatggggggcgtcagcaggtttctctccctcctatctggccggtgctttttggtttgtgagacggagtctcactctgtgcccagggtggagtgcagggttgatcttgggctcactgcatgttccagctctgggcatcaagggattctccatgcgtcagcctcttgagtagctgggattacaggctgcccgaccacgcacagcctgcttaattttggtattttagtagagatggggtcccagcagtgttggccaggcgtgttctcaaactccgtgagctcgaagtgatccgcccaccttggctcccaaagcgtgggattataggctgtgagccatgtgccgggtccaccttggccgtgttgggtttttcttgccttgggctcagcaattcaagattctagatgttatcgggtggaagcagtagcccaagcccagtttaggggaaggtagcacgagggcagagccactgggcactttgtttcctgtggcccctccgaaggctcactgtggcaaaaatgaccccgagagcttggctctgggcagatcttgttggtgtgcagcgtgtatggcgaacctcagattggactcgggcagtgggtctgtggaggctcttcgtggtcaaggtacaagtgctggcacgtgggggccagagtgccccttttacgcccggggtctgcctagagaggcgggaggcaggttcttggcccgtgtccggttggggcccgacttggtggctggcccagggggtgggtgggacccccgcagtgggagtccc

SEQ ID NO: 557201 - DNA, 180 bp, Homo sapiens
  misc_feature (172)..(172): n is a, c, g, or t
tatacacggatgtatgtccatcgactgagataaggagaaaactgccttacgggtggaggtgagacatgctggtgcaatactgcctttaatgcaccgagatgtttatgtatgtgcactctcaaagcactagcacccttttctaacccttgtgtactggcacacatgacattangttcacat

SEQ ID NO: 557202 - DNA, 170 bp, Homo sapiens
tatactgcaattatagacacgattcagaaaaaagctgctcatcgaacaccccatcccatgcgagacacatacaccctgatttctctgcttcccttcatgaatagaatcgctggaataattcgtcggtgtctcttgacgataactcttctcctcccattctctctcaaatt

SEQ ID NO: 557203 - DNA, 254 bp, Homo sapiens
cgctcacaacaggcacaggaaagatatcatttctatgctttaaaaaaccctctatggagcattttcaaatattaattttattggggggggaaaaggcccacaacaataatggcaagatctttctcaatagcttcagttggcggtgggatgcctaccttaactatggttttacaatatagatatctatatatatatttaaaatagtttgcgaggtattttcttctaccttttttaaaaataaatttccagaagtg

SEQ ID NO: 557204 - DNA, 328 bp, Homo sapiens
cccgggctcaagcaatcctcttctcccaagcaactgggactataagcgcataccaccatgcctggctaatttttggggggtatttttggtagaaacgggtttcaccatgttgcctaggctgaccttgaactcgtgagctcaagtgatctgcccgtattggcctctcaaagtgctggggttacaggtgtgagccactgcacccatcctgaaaatgtcttcatattacctttatttttacaaaatacaggtttaattttgaaataaatttagatttacagaaaagttgcaaagataacagaattctcataagtccttcatcattttctct

SEQ ID NO: 557205 - DNA, 109 bp, Homo sapiens
gcgagggcgagtggaacagaggtcggacatgtgctaagctgctggccttttcacgtttcggaccctgagaatatgtccaccgcattacaaatgggattctctggcatct

SEQ ID NO: 557206 - DNA, 376 bp, Homo sapiens
ggtctgaagggctccctgagaactaggacaagagactacaaggagtatgtcctgaggaggggtgggatggtgtgttttctctcaccgtcccttttagtgaggggtccttcattggtccatcgttcaaggccatcacagtgggggcttgcagcaggcaggtgcaggaacttgaaaagacgcgacgccaaggaaggagggacaggactcgagctgtaggggctgtgatccgtcgattagtgggaagttatggggagacgagttccaccgttgcggatgcggtaggggggtacggcggttcccgatgccgcttggtgccgttggggccaagccaaagggaccgaatcgaaggaggattggtcccgagtgggcgaacgca

SEQ ID NO: 557207 - DNA, 117 bp, Homo sapiens
ctgtagggctaaaaccaggatagtttaggcggcgcaagtggtcaaagggagtgtctccctccgatgccctgctaaactactgatagctatcttccagattactacccttacaccaaa

SEQ ID NO: 557208 - DNA, 556 bp, Homo sapiens
gccgccatggtggctcatgcctgtaatcccagcacttgggaagctgaggcggggaggatcacttgagcccaggagtttgagaccagactggcaacaacagtgaggaactctacctctacaaaaaagaagtacaagaaaaaaagttgttaataaaaaaagagaactcaaaaaaacaaaaaaatgggtgtggggcgggaccgggacccacaaaaaaaggattttttaaaaacaatggcttgggggaagaggggacacccccagggaatgaatgaacagaaccaggtggcacacagacggtgtcacaaaagaagaaaccgggcacacaaaacagaagcggtgagctctcaacacaaataaaaaaagccggcgcggcgcaccacgtacgtagtgtggtagaaaacacacacgaagagagggaagtccacggaagaacagcacagggcgtcatcaaacacaaagggggagcaccaaggagactgcatccaacataaaaatactgagccccgacatcgagggtgaaacgatgcgacgagcacgagcgacgtactcagcagaa

SEQ ID NO: 557209 - DNA, 327 bp, Homo sapiens
cttcagactgggtctcactctgtctcccaggctggagtacagtggtaccatctcagctcactgcaacctgcctcccaggttcaagtgattctcctgcctcagcctccctggtagctgagattacaagcacgtgccaccatgcctggctattttttgtatttttagtagagacgaggtttcaccctgttggccaggctgatcttgaactcttggcctcaagggatctgtccacctcggcctcccaaagtactgagattataggcatgagccaccgcactcggcctatccttgattcttattgcttttgtccccttctgtcgtcttctc

SEQ ID NO: 557210 - DNA, 1712 bp, Homo sapiens
ttctctatgtgtctagtaacgaataagtgatgacataaagcaagctagcgctaacgtacgtcgtacggattgcgactagttactttgaagtgtcgagcgatctagttctatacttgtagtgtgaggtctactgtttcgctgtcttgttggctcgagctcgtgagtgtgtactgatgctggtgtgcgcgctgcgttggttcgcgactcttgttatctggtgttgtgcgtgtcccgctgggtttcttccactcgttgtgtggtggctgttggttctccagctcagttttggtactcccctggtgtttgtgtctgacgctctcctgttttttactgtagtggttattgttcgggcgtgggtgtgggctgggctgtcttggcgtgtggctatatatttgggggccatcggttgggtgactactgtgtttgtcttttcctctctccgtttgtggctattttcgtgtgtgggtgttgttgtcacactggtgatctggtggtgggggttcatccatcaggcagcgcttggttgtatccctatgttgtggtgctcgcacatcattgtggtctgtgtgtggtctcaggggtgcttttatgtcgtgagggtgttgttagttgttcgctgtttctctccccctttattgtgggggtggcggagggtaggttccaagctgtgaccataatggaggtgtcatgttagttgtgggtggtcacaaatagaattgttagtatattgatagcgaggcgaatttatatgcgggagtgagcaccataaaggaggtggtgactattattgtgagcaggtgcgataaatgattgtcctcccgtggcttctctcgtcatgcacaattgtgggtgggaggtacctggtttgtttgatagaagtgggcaccttcgctttcttcaccagggggtgtggtgggtcttgtggcgggctcgctgtagagcggctgtcgcgtctgtgcctctgcagggtgcgtctttttcctcgctgctcgcctcgagttagaagtggtctcttttcttttgatgaggtctcttctgttgggaacccttgctgtcgctgtctgtgtgtgtctcccacgccgtgcggtttttgcgcgggtttttgctggggtggtatatattttttggtttttttttgtttccacaccgctctctccaactttgtttctcacacacactcccacctctctcccgccccccttgtttttttgtttttgttttgttataaaactgggtgatatttatatatgcctttgaattttctgacactcttcacagcacactccacaccccctgggtgttctacatgtgttgtgtctgtggatgcgcaacacttctttgttgttggcgctgtctgtgcaccctgtgtttctgcatgtcttttgaagcttccccctcgcccaactctggggggcaccttggtgtttggaagaaagccacacacgggcctttgagattttcatctgcgtcttcctttcctggagcaccacgaggagggcacgacagaaagaggggtggtgttcttcccactcccccagacacactgtaggaagaaaacggggcttcttttcattttcaccccttccctctttttcccctgccccccgagactgggccacattttgggtgggccaatgggtcccccaaatggctcaccctgagaatgtaagaactaccacacccaaatttttagtaaattaaattttgtgtcc

SEQ ID NO: 557211 - DNA, 1053 bp, Homo sapiens
  misc_feature (37)..(37): n is a, c, g, or t
cgaggtggctccactgtcagaccctagctttgaaggncaatctcatcttcgtcgtcttcctctctgggtccttcattccggtgaaccagtatacatcaaatgtcgacgcaaatacccctcccaggactccactctgttgttttctaacagggggggacgtaagtgtggccctctggttctggaaaggcttggcaaaattgccttgcagaagctccttgagctccaactctgaactccctttcagcagccggcacaggcataacaggcccagcccacaggtaccactggcactgaggcagtgacccctacatgtagggctacccccagtcacaggggctgtgctggactgcaacaaggctccctgcagccagaccaagtatgaaaaatgccttgtatgtttttgttgcttgagtgcccccaaaacacaccaaagcagctgtgccctcttggcatggtaggttcttgcaatgcaccactgtgaggagcctgcgtgaacatcaacctgataggggcaccagtggaaaagcctcttcaaccagttacagccactagggaacacctgtgttgaccccttttattggcccttcaaagctgttttacatgctgactccaatcctttacctagtacttccaattgacgccattctcgctttcagaccctttttgaactctgtgtggtgacccctgtcctcccagccaagggcgcgcttcctaccttgtccccgtgccaagatgacaggtattacccactggccacgggggccccgcttcaaacgtctcccggagtcaaccccgtgtatatgcatcggcaacatacctgtttattttctctgtcattactaatccctccaacactccaaacaaacacccagccccacacccggcagcaccaccaccgggaggacaccaccacccaccacccccacacgcaaacgcgccacccccacaacccacaccacgccgaacgaaacaaacgccgccccagcgccccagaaccaacaaacgcgcccagagcggagaagcacacgaccaccccgccgtgaccaccccgcc

SEQ ID NO: 557212 - DNA, 234 bp, Homo sapiens
  misc_feature (24)..(24): n is a, c, g, or t
  misc_feature (70)..(70): n is a, c, g, or t
  misc_feature (76)..(77): n is a, c, g, or t
  misc_feature (81)..(81): n is a, c, g, or t
  misc_feature (90)..(90): n is a, c, g, or t
  misc_feature (96)..(96): n is a, c, g, or t
  misc_feature (104)..(104): n is a, c, g, or t
  misc_feature (108)..(109): n is a, c, g, or t
  misc_feature (111)..(111): n is a, c, g, or t
  misc_feature (115)..(117): n is a, c, g, or t
  misc_feature (121)..(121): n is a, c, g, or t
  misc_feature (148)..(148): n is a, c, g, or t
  misc_feature (158)..(158): n is a, c, g, or t
  misc_feature (163)..(163): n is a, c, g, or t
  misc_feature (168)..(168): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (186)..(187): n is a, c, g, or t
  misc_feature (193)..(193): n is a, c, g, or t
  misc_feature (204)..(204): n is a, c, g, or t
  misc_feature (226)..(226): n is a, c, g, or t
atcagaccacaactattaaatgtntaaaaaaaaaaaaaaataaatgtaaaaaaagcacctttaaaaaganttaaanntaanattcccctnattcanaatcaacntctnnanaaannnggtngacgcgaacctcctcataatcattctnaagggcagcnatgtnctcangggcctctganaantnannttcgtncatcccctccncagcgtaccagtgaacgggggngcgtttgg

SEQ ID NO: 557213 - DNA, 113 bp, Homo sapiens
tccacccaccctgtatttactcattctctaacttgactcagctgcaggtaaagtcggaaacctctcctgcaaactgaccttcggcttctccagtcggggtgggtggagagcgg

SEQ ID NO: 557214 - DNA, 247 bp, Homo sapiens
  misc_feature (145)..(145): n is a, c, g, or t
ctgtgcgcgtcgctctacgacggactcccggacacttgaccacgacgggacgcgtgacttaccggacgctctggctgtacacgtacggcgacgggggcccacggaccgtgggaccccactggggttggacctggtctgcttcccnttcccacaccctctctaccctcctgtctgcacggactaacactgtgccactgactgacacggacctcacacccggggactgacgtgacgggggtgtgctgtt

SEQ ID NO: 557215 - DNA, 646 bp, Homo sapiens
ctgggctcttgccctgtgaaatctattctattgcttaccccatcttttcctcgcattttttcaccagctttccctcaatctccaggagccaatgcgagactttggctccgatgaagcgacggcgccgaggactctgcgggtgcagcggaggaggatcgacagcagtggtgatggagagcaccccgttcaaggggactgaacctgagtacacactacgatagtgcaggaatctgcacggaattcttaggggggcctgtagccctgggagtagttggaccgattgtatgggcaccctgccacagtgtctcggctctgtcttcatgggacgctccctatccgttggcttattcgacacttggcgtgagtgcggagtcgctcgttgtctggagctcagcacttgtgccagcaggcttgctgatcaactactagtgtggtcaacaggaaggaattccagccatacgtgctcaaggcagtgaaaagtacatgggctcgctggagcgggccgtccgggtatccttggcgactaccactagcttgctccccagggcagggctcgccagggccctctgtccgtcgaaccccaatttttgccggcccagtaaccctccggcgatttggcccttgctgggggtgggggggggggaaa

SEQ ID NO: 557216 - DNA, 391 bp, Homo sapiens
  misc_feature (130)..(130): n is a, c, g, or t
  misc_feature (255)..(255): n is a, c, g, or t
  misc_feature (272)..(272): n is a, c, g, or t
  misc_feature (330)..(330): n is a, c, g, or t
  misc_feature (357)..(357): n is a, c, g, or t
tcagaacctctcatttcctttccatcgtggaaatctatcctcaaggaaataacttctcagtgttccatctgctattctactactcctcagggattattcaggccccctcccttccctacacatcaggctnggaggatttgccccacccaggactggcaaattacctttactcaacatgtcccgagtcaggaaactaaaatacctcttagtctaaatagacactttcactgaataaagtaaaggcctttcctacangggtctgagaagggccnccacaagtcatttcttcccttctgtcagacacaattcctcaagttttagccttccccnagctctatacaggtctggataacaggnccaagccctttaattaagttcaaaattcaggcca

SEQ ID NO: 557217 - DNA, 573 bp, Homo sapiens
  misc_feature (22)..(22): n is a, c, g, or t
atccccaccttctatcagtccnattcctctcttctgctgctcactgtaccatttgtattgacaaaggcttatccctccgtggaagctggttaaaggtgcatatttttagaagtttcagagacagggactcatatccagcactctcagaaagcaacagggcaaaagtcttcaggctgacctttcagttgttcccataatacacgtgtttctccccctacataaggtcctccgttaagtcaaagaaccaagcagatttaaaaggaaataaataagtcatagaggcaaagagttgagcagatagaagaggaataggagaactggggaaaagacttagcctgccacatacgctgatgtgcagaccctgtcaccaatattaaaccagaggcactaagagaaatcaaatatttacagtccagcctaatgccttaactctttactccccataaaacccttatgtggtcaggtgctgcactcacgcctgtaatcccagctctttgggaggcctaggcaggagaatcacttgagaccaggagttgaggagcagcctggacaacatagcaagaccccatctct

SEQ ID NO: 557218 - DNA, 247 bp, Homo sapiens
tgtaaaagaaatattacatactattataccaaacgcaacgaaacaaagacaaaacacgttgataggctacttactgccgaccttactgaggtgcaccggcgcgatcttggctcactgcaacctccacttccccagctcgagtgattctcctgcctcagccgctggagtagctgggactactaggcgcgggcaaccacactcggagaatttttcgatgttttgtagagatgaaatttcgtcgtgttgt

SEQ ID NO: 557219 - DNA, 182 bp, Homo sapiens
aggaccttacagaggagggacagggcaggcgggccatgaagaaagccctcgttgaccagcactgtctgcgtctgctcttctgtgcccaggtggctgccagcccactgcctcctctgtgctgtccggacagcacagggagggactgagatgcaggatttcttcacgcctccccctcctctgtg

SEQ ID NO: 557220 - DNA, 860 bp, Homo sapiens
  misc_feature (53)..(53): n is a, c, g, or t
  misc_feature (78)..(78): n is a, c, g, or t
  misc_feature (109)..(109): n is a, c, g, or t
  misc_feature (144)..(144): n is a, c, g, or t
  misc_feature (151)..(151): n is a, c, g, or t
  misc_feature (159)..(159): n is a, c, g, or t
  misc_feature (161)..(161): n is a, c, g, or t
  misc_feature (171)..(173): n is a, c, g, or t
  misc_feature (183)..(183): n is a, c, g, or t
  misc_feature (190)..(190): n is a, c, g, or t
  misc_feature (199)..(200): n is a, c, g, or t
  misc_feature (202)..(203): n is a, c, g, or t
  misc_feature (215)..(215): n is a, c, g, or t
  misc_feature (242)..(244): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (266)..(266): n is a, c, g, or t
  misc_feature (268)..(268): n is a, c, g, or t
  misc_feature (279)..(280): n is a, c, g, or t
  misc_feature (285)..(285): n is a, c, g, or t
  misc_feature (298)..(298): n is a, c, g, or t
  misc_feature (301)..(302): n is a, c, g, or t
  misc_feature (308)..(308): n is a, c, g, or t
  misc_feature (318)..(318): n is a, c, g, or t
  misc_feature (343)..(343): n is a, c, g, or t
  misc_feature (351)..(354): n is a, c, g, or t
  misc_feature (356)..(356): n is a, c, g, or t
  misc_feature (370)..(370): n is a, c, g, or t
  misc_feature (375)..(375): n is a, c, g, or t
  misc_feature (386)..(389): n is a, c, g, or t
  misc_feature (391)..(392): n is a, c, g, or t
  misc_feature (423)..(423): n is a, c, g, or t
  misc_feature (440)..(440): n is a, c, g, or t
  misc_feature (442)..(442): n is a, c, g, or t
  misc_feature (452)..(452): n is a, c, g, or t
  misc_feature (460)..(461): n is a, c, g, or t
  misc_feature (466)..(466): n is a, c, g, or t
  misc_feature (476)..(476): n is a, c, g, or t
  misc_feature (501)..(501): n is a, c, g, or t
  misc_feature (513)..(513): n is a, c, g, or t
  misc_feature (516)..(518): n is a, c, g, or t
  misc_feature (529)..(530): n is a, c, g, or t
  misc_feature (555)..(555): n is a, c, g, or t
  misc_feature (557)..(557): n is a, c, g, or t
  misc_feature (566)..(566): n is a, c, g, or t
  misc_feature (572)..(572): n is a, c, g, or t
  misc_feature (584)..(584): n is a, c, g, or t
  misc_feature (621)..(621): n is a, c, g, or t
  misc_feature (631)..(632): n is a, c, g, or t
  misc_feature (635)..(635): n is a, c, g, or t
  misc_feature (638)..(639): n is a, c, g, or t
  misc_feature (650)..(650): n is a, c, g, or t
  misc_feature (660)..(660): n is a, c, g, or t
  misc_feature (685)..(685): n is a, c, g, or t
  misc_feature (734)..(734): n is a, c, g, or t
  misc_feature (737)..(737): n is a, c, g, or t
  misc_feature (773)..(773): n is a, c, g, or t
  misc_feature (778)..(778): n is a, c, g, or t
  misc_feature (833)..(833): n is a, c, g, or t
aataaagaaccaaaaaattatctgtgaaatgtaaaaaaaaaagcaggccctgnggctcctgactcctctctcagaaanggaggcgggaacagacttactgatccaagcnccacctgcctcccatgcaaaggccaaccccaagancccaggnagcgacanancaacccctcnnnaaccctcaanaaaatgntcataaaannanngagaaaaaaagnttgcaccctaaaatgttgaatgaaaannnttttttttttcttngntntttngnggttttcaagnnttganatttttttttggnagnnatattnttccttaganatattttttatttttttaggttttnggggagtnnnntnggggaaaatgaggnacagngaggtggagtnnnntnngtcaggccactctgcgaggaagtgcaggggntggcccgatcttgaaantnattgggggtnggtttttnnttttngttttgtaangagggtttattccaaagagggccanacttgaagagcntgnnnaggtaggaggnnccccaaagtgggttttgaaaattcnangtgtagctngggggnctagtggaaganccttggaaaaaagagcccagttttagttttggaggtntttcaaaaannagntgnnagctaggttgntggtaagttntctgggaggcaatcttcggcaccgngagcctctgtccattagtgtcagccccgagggggccacggacggaggcngcncaatgtccactgtgatattggtgaagagtggttgcngaganacctccaagacctggtaccgcactgacccaatggcgttccgcttcatggtcaggntcgtgttttgaatcttggtaaacctct

SEQ ID NO: 557221 - DNA, 1039 bp, Homo sapiens
cgggtaggatggcgctggcgctccagtcccccgcggttggctgctgcagtcggttgctgttactactgcggctcctgcttccgcctcggcgcctcctcggcctcacggcagcatgcatcctcgaccgggccgtggtccccgccccgcgccggcccggccccgctcatggatgtcctgtgatcatctcgtcgcctggtggtgctcatctttggcaccctggtacccagtgctattcttcctacaaggccgtgaagacaaaaaacgtgaaggaatatgtgaaatggatgatgtactggatcgtcttatgccttcttcaccactgacgagacgctcacggatatagtgctctcctggttccccttctagctttgaactgaagcatcgccttcgtgatatggctgctgtccccattacaccaaggggctccaggcgtgctctaccgcaagttcgtagcatccaacgactgtccaacaaggcagaatggagatcggacagagtacatcacgcagtgcccgagacaagagctatgcagacccatgatgagggtgggcaagatggggcctgaaccttgccgccaatgcaaacagacacaagctagacgccaagggccagggagggtgctgtcagaagaatgctccgcaaactttcagcgatgcaaggaacctgagccctaatcacggggacgaggaacgacagtggacactgacagcagggccataccgtgtacgcgatccggaacgagatccaagacagcatatctagagacacccaatcaggaaaggtaactttaggaggaaatgcaccgctgcacacagagagaaacacaaagggacacaggaggcaataaaccacggggaagaacaacacacacaggggaaaagaagggactacatagaaggggatagaacaatagggaagaaacaaaacaatcgcaaaataaaggggacacacaacacagcagaaaaaggcacgacaaaaggcaaaagaaacatggaaaccaaaagaacaaaaaaagacaaggaacaagacgaacagaaca

SEQ ID NO: 557222 - DNA, 457 bp, Homo sapiens
cataatgatattctgttaatatatttacatattaatatgtatataatacattatatgcatatatacctaaaatataatacacacgtataatgtgtgtgtatatatatgatataatatacatgagaggagaaaaagctagagttgaatccatatctgcatatttgtagagatgcacatgataaggtgttaaatttaaaaaagtagtaatgtgtaagtatgattctattttgtcaaagcagacacatacaaacaaacttctatagttgtggtctccataaatgcttgtaatattgaattagctatgaaaaaaggtgtgaaggaataaatgccagggtgttaatgtgtgttaactcaaaggggattgaggtgaggatgaaatgatgattaactttttctttgcacatcattgtaccattttacttcttcaataagcctgtattgctttgtaatttgagaa

SEQ ID NO: 557223 - DNA, 582 bp, Homo sapiens
ctttcccccaaaaaaaaaaaatttattggggcgggggggtctttttcaaaaaaaaaaaaaaatttatgtttaaacccccttttttaaaaaccataaaaagggaaacctttttcaaaacactgattagaaaaaaaaatatggttgcctttaaaaaaaatggaatttttgaacctaagatggaaccagatcccccccttttgggggaaacaaaaaggtttcttttttctcttttaaaaaaccccccaaaggggttttaaaaatgggggaaggcctttttttttttatagggcggggaaatttttaaacatttgggggccgccccctaaaaaccccccaaaaatattgtggtatttccgggccccaaaacaaaggggccctctctcaaaaaaaaaaaaaaaacccccccaaaaattgggggtggggaaaataataggaaaggcttttcttccgggagaaaattgggccgcccaaccaaaaaggaagagaatctcttatttttttggcgcgccttttttatacaaaaaaccgcccttataatttccaacagagaaaccccgtatatacttctcccgggggtattcc

SEQ ID NO: 557224 - DNA, 1063 bp, Homo sapiens
  misc_feature (6)..(6): n is a, c, g, or t
  misc_feature (115)..(115): n is a, c, g, or t
  misc_feature (123)..(123): n is a, c, g, or t
  misc_feature (142)..(142): n is a, c, g, or t
  misc_feature (144)..(144): n is a, c, g, or t
  misc_feature (149)..(150): n is a, c, g, or t
  misc_feature (177)..(178): n is a, c, g, or t
  misc_feature (182)..(182): n is a, c, g, or t
  misc_feature (195)..(195): n is a, c, g, or t
  misc_feature (199)..(199): n is a, c, g, or t
  misc_feature (214)..(214): n is a, c, g, or t
  misc_feature (225)..(225): n is a, c, g, or t
  misc_feature (228)..(228): n is a, c, g, or t
  misc_feature (240)..(240): n is a, c, g, or t
  misc_feature (294)..(295): n is a, c, g, or t
  misc_feature (313)..(313): n is a, c, g, or t
  misc_feature (326)..(326): n is a, c, g, or t
  misc_feature (328)..(328): n is a, c, g, or t
  misc_feature (338)..(338): n is a, c, g, or t
  misc_feature (352)..(352): n is a, c, g, or t
  misc_feature (377)..(377): n is a, c, g, or t
  misc_feature (383)..(383): n is a, c, g, or t
  misc_feature (392)..(392): n is a, c, g, or t
  misc_feature (400)..(400): n is a, c, g, or t
  misc_feature (418)..(418): n is a, c, g, or t
  misc_feature (424)..(424): n is a, c, g, or t
  misc_feature (442)..(442): n is a, c, g, or t
  misc_feature (455)..(455): n is a, c, g, or t
  misc_feature (461)..(462): n is a, c, g, or t
  misc_feature (476)..(476): n is a, c, g, or t
  misc_feature (482)..(482): n is a, c, g, or t
  misc_feature (490)..(490): n is a, c, g, or t
  misc_feature (494)..(494): n is a, c, g, or t
  misc_feature (521)..(521): n is a, c, g, or t
  misc_feature (543)..(543): n is a, c, g, or t
  misc_feature (598)..(598): n is a, c, g, or t
  misc_feature (602)..(602): n is a, c, g, or t
  misc_feature (664)..(664): n is a, c, g, or t
  misc_feature (877)..(878): n is a, c, g, or t
  misc_feature (893)..(893): n is a, c, g, or t
  misc_feature (896)..(896): n is a, c, g, or t
  misc_feature (911)..(911): n is a, c, g, or t
  misc_feature (913)..(913): n is a, c, g, or t
  misc_feature (919)..(919): n is a, c, g, or t
  misc_feature (930)..(930): n is a, c, g, or t
  misc_feature (936)..(936): n is a, c, g, or t
  misc_feature (938)..(938): n is a, c, g, or t
  misc_feature (948)..(948): n is a, c, g, or t
  misc_feature (964)..(964): n is a, c, g, or t
  misc_feature (966)..(967): n is a, c, g, or t
  misc_feature (977)..(977): n is a, c, g, or t
  misc_feature (984)..(984): n is a, c, g, or t
  misc_feature (990)..(992): n is a, c, g, or t
  misc_feature (1000)..(1000): n is a, c, g, or t
  misc_feature (1002)..(1002): n is a, c, g, or t
  misc_feature (1005)..(1005): n is a, c, g, or t
  misc_feature (1009)..(1009): n is a, c, g, or t
gctgangccatagagaccaagacccctcccttggctgcgcctccaactcaactgcactcctatcaagggcttggggctccctgctgcatccctgcctcctccctgaaaactccangaatgctnctgaatgcaagaacccagntntcccnncacgccgggagggcaaccagcctcccnncgantcctgcgggcccntctngaggctttggggccntcagctgcaanccnggtctgtcaaantcagcccctaggaaagaacaggccttggtctcccctagtcctggccagaaggtnntctcgcttttcctctacnggcctataagaancnggtacttcanttctaaaatctganttgtgttcttttcgtcttcaaaaantctaantaaggccantgtgccantgtgcacccttgaatacnattganccaaagctttcccacagncctccctggcccncctagnngctttcttggtcantgcctntcaaagcnccantcctgctgaaccaaaggctttgtcatncctttctcttcctgtaatctgngcaaacccactccaactttctggtgtcacaggcgggaatgttagttagtaggtanactnagatcccatttctgtcctgctcccaggaagattcttaggtcctcttcaatccagcagccccncccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggannagggtgatttcaagncanggaagcaactgggancntgaaanctgtccctccncagccngntccccctcgntgtgccctggtccccntnntgccatgtgnatgctgntgtgannnctgtttgnanatnatcnaaatgtttttatattaaaaatgtttggtctgataattaaaagcacttcgtttag

SEQ ID NO: 557225 - DNA, 566 bp, Homo sapiens
  misc_feature (222)..(222): n is a, c, g, or t
  misc_feature (376)..(376): n is a, c, g, or t
agttcaaataaggtccggttcacagattctgggggttaggacatggacagctctttggggatcaccattcaagtctttgcaattgtgtctggttccctccagaggctctaggggagggtccttcctgcctctcccagttcctgggggcttcagacatttctgggcttctggccgcatcactgcaatctctgcctccatctctacgtggccttctcttctgtntctgtgtctcctcttctgtctctcagaaggacacctgtcattgcatttagggtccaccctaactccatatgacctcatctctacatacttaagtaatcatatctacaaagacactatttccaaataatgtcccactgcagcttgtggacaatanatgtgaacagatctttcaactacatgcagctcctccggaggctctggggagggtccttcctgcttctcccagctctgcgggctccaagtgtccctgggcttgtggccgcatgactccagtctctgcctccgtctccacatggccttctcctctgtgtccgtgtctcctcttctgtctcaaaaaaaaaaaa

SEQ ID NO: 557226 - DNA, 494 bp, Homo sapiens
  misc_feature (167)..(167): n is a, c, g, or t
  misc_feature (178)..(178): n is a, c, g, or t
  misc_feature (194)..(194): n is a, c, g, or t
  misc_feature (219)..(219): n is a, c, g, or t
  misc_feature (222)..(222): n is a, c, g, or t
  misc_feature (230)..(230): n is a, c, g, or t
  misc_feature (250)..(250): n is a, c, g, or t
  misc_feature (258)..(258): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (294)..(294): n is a, c, g, or t
  misc_feature (301)..(301): n is a, c, g, or t
tgtttctttatgagtcagttttggtagatttgtccattttatcttggttatccaatttgttgttgtacaattgtatatggtattctcttataaatctttttatttctataaagttggtagtaatgaggcctgtttcatttctgttgctagtaatgtgagtcctcccntttaatcctgncccggcctggccaaangttggccaatttggtggacctgggngangaactttnaggtttcatggacttcctgnattttccnatncncnatttcagtttttccccactataatccttnataattncttttggcaagctttgaggtattggtttttttctagtgggcatatggcataaggcatagttaggcctagttcctaatttgatttgagatctttcttcttttttaattgcatgtgtttggcagctataaataatcattctggccgggcacagtgggctcgcgcctgtaatcccagtggctttgggaggccgaga

SEQ ID NO: 557227 - DNA, 103 bp, Homo sapiens
  misc_feature (32)..(32): n is a, c, g, or t
  misc_feature (84)..(84): n is a, c, g, or t
atacgggcgcatgcaggggaggaattcatctncagacgaccagcccccgcaggggcggatacacactcgaatcacacgaagatncgagagcgactagaattca

SEQ ID NO: 557228 - DNA, 133 bp, Homo sapiens
tagctcggtaccccagtgttatttacaatggcaaaaccacttaaatgacaatagccaaaatgggtttgttttttgttttttgagacaaggtcttgctttgtcacccaggctggagtacagtggtgcgttctta

SEQ ID NO: 557229 - DNA, 407 bp, Homo sapiens
attagctgggcgtggtggtgcacatctgtaatctcagctactcggtaggctgaggcaggagaatgccttgcccttggtagccagaggttgcagtgagcccatcttgctccactgcagtccagcctggactagagtggaactccatctccaaagaaaaaagtatctctctcatcgacaggggttttcctatatatctcagggtattctaatagcctaattgccatattcttcttaagaatatgtgattttaacacttaattcagtgttccgtttctttagcctcattatttttatttacttttggtaaggattatgtcttttcattgatttaagtgatcgtttagataggctccttttagttacacaaattcagccagacttatcagaaaatgagtaaggaagagtga

SEQ ID NO: 557230 - DNA, 1203 bp, Homo sapiens
  misc_feature (609)..(609): n is a, c, g, or t
  misc_feature (647)..(647): n is a, c, g, or t
gccacgtcgttcggcggacgcggtgggtcgacccacgccgtccgtgcagcatgtttgatacgaaccagttatctctcgaagtatagaaagtgtacgaggatggtcttcatatgcgcacgtgagtaggcatactcttttcgccagcacgagaggcagtacacgtagatacagtgttgtacgaggttgctggtgtcttcgcaatgggacgtgtgcacagagacattcagtcagagtgtctgagttacgcgtgcaggctcgagtggggttctgtcgtaagagtgatcgtgctcacctccaagcgatctgccaatcttcgaactctggcacgtatgcaggagggatagttaaagagctcacccctactgtgaatgggaggtgtgcagtctacactatcaacacaatgatccacaagattacttacccaaaatgcaatctatacatgacggcaaggccactctgtccagtacatctcatttccacttgcctcgacggttcattttccttaataatttccctacctgagacatgcgcctagaagatgagaacatgacagatgaagcctcgggatgtttgtgagatggcatgagttacaggccaattcgagcgacnagaattgttatcaccgagtttacaaggcagagagtganctggtgtccagtggccgatggcggttggggtgggctcaagggcgctgatcacatctcctagacgatcttctggggcaggccggagggtagggcaaggatcacctgggaggggccacgggagattctggaggaaccagtcccatttgcccgaaaccaataagttgaaaacaccctggtcctgcgtacctagaaaaactaaagcgagaagctgcacagggggggggaccggtggccaaggaagaaatcgccctcgggaaggggggggcccccaaaagcgttttaacggcggtaacgccccaagagtgaaacctcgggcggaccaacattcggtgtgcccccattaagaaagccagagaggaacagcagttcaaacaaaacgtcctaagggagcgaccggggagccggagcgagagtcacaccacaacgaggacccgaaaacaagtggcaaagcatcttgtgcgcgctacggggcgagcactcttcgggcgaccagagagaccctgaaattcactggggggggggcagcaccacacatcgcgcacaaactccagccgga

SEQ ID NO: 557231 - DNA, 109 bp, Homo sapiens
ccagtgctctctcgccacctctgggtgctttactgtctctggcttgttccatcactggacatcacttagcgaattgtcgtgtttttggtccttgataaagcctagaaga

SEQ ID NO: 557232 - DNA, 603 bp, Homo sapiens
  misc_feature (22)..(22): n is a, c, g, or t
  misc_feature (24)..(24): n is a, c, g, or t
tggctgggactacaggcgtagncncccgcgcccggcaaaatcctgatttttagtacaagtcctttcatgttatagaacattacatttgtcctttgcagctggtatctttagtttaaagaccagtgaaattcttaaccatgttcccattttaaaacaaagcgaacataaaaatgactaattcttagaactgaagttctaggttttgctttaatagcttttaagtattgccacttataaccccattattaacaccacagtctgcatcaaaagcttacttaaaacatttagttttcatgagagtttccaaaaataatttcataacaatcatttgttctaagagccatttcttaactcatcatgaactgtaatagattatgaagataagtttcaaaatttacataccagattttttaaaatgaagttaaaagcatggacatattgagggtcttatgcatgggcatactgaagggtttggagagacagaatgtgcatgaggtttgagaaggggagcatcacttccctatgtggaaataggacggagcagcgttcattgtgttgggccttgagccctcatcctttcatctaggctggaaccaagctgat

SEQ ID NO: 557233 - DNA, 1309 bp, Homo sapiens
  misc_feature (292)..(292): n is a, c, g, or t
  misc_feature (586)..(586): n is a, c, g, or t
tgttcattgagctgcagcgggaggaatcggacaagcttagtgaggcagtacaagcgcaggaaggccgcgaaggctgggccactcccctgaaaagcgctttgacgaaccgaggttggttgtgtgtgcttccggtggcctgcgggaggtggtgtgtgtgctttccacgtcgctatgcaacaaccgaggtacccccgtgcgaggcataccgttggcggcattccattaaccgaggtggtgcaggcatgccggtcgtgacggcagtgcatacttacctgagcgtagtgtttcaacncgcatgcgcgtacggtgtgttgtgctactagcctagagaccgctggtgggtaacaacaagccgtggatacacgaacaatctccaactagacagtaggtcagcgtacaaatcgcggtggctcccctagcgaatcgagccgaccaaccatcagtcagccatcacgccagcatgagtcctaccgagcccagtcgagccaccgaccattcaccgcagctaagcaggccctgcttctggaactccctcccatggggtccgaggtgttatcaataaagatactagaaactatccctaggnctcaatgcgccaaataccatggaacccccaccgtcatggagcttacagcccatccacagccggagttacaatgcccgagcctagcctacagccgagggtaggttacagccagggctatcacagtctccatggtctcgaacttccaagcaaccatcgtgccttacttgcttaaatggtgaggcgtagcgcgcgggtttacggagccctggggcctgacgtcataaccttgatgccgacgctcaagacacgctgcaagaagggaccattccccggttaaccacgctcttcactgcctctcgagtgcaaattcccactaaccatgacagtgggaggccatatccggtatgtacacacaaatgtttgccacaaggtatgatgagggccccacctgaagctaatgggacagctacgggagggaatagatttcggggcactcaagccccgagtgaggagttaaacagcaaaggccaactgtagtggccccaccgcgacgaagacacggtaggaagaagacgagtgctggcgctaataggcgcaggggaagaaagagacgcaagcagggccgagagacgcagcaggaacagaacgagggggcagaggcgaacgacccccgaaagacggacagcccaagcaaagccatagcgcataagggcggccataacgagggaagcagagagacggcaggccatagcagaggaaagaggaagcgacgcgacaccaaca

SEQ ID NO: 557234 - DNA, 647 bp, Homo sapiens
  misc_feature (1)..(1): n is a, c, g, or t
  misc_feature (72)..(73): n is a, c, g, or t
  misc_feature (77)..(77): n is a, c, g, or t
  misc_feature (87)..(87): n is a, c, g, or t
  misc_feature (91)..(91): n is a, c, g, or t
  misc_feature (95)..(95): n is a, c, g, or t
  misc_feature (101)..(101): n is a, c, g, or t
  misc_feature (126)..(128): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (147)..(147): n is a, c, g, or t
  misc_feature (156)..(157): n is a, c, g, or t
  misc_feature (163)..(163): n is a, c, g, or t
  misc_feature (179)..(179): n is a, c, g, or t
  misc_feature (184)..(184): n is a, c, g, or t
  misc_feature (195)..(195): n is a, c, g, or t
  misc_feature (210)..(210): n is a, c, g, or t
  misc_feature (273)..(273): n is a, c, g, or t
  misc_feature (275)..(275): n is a, c, g, or t
  misc_feature (358)..(358): n is a, c, g, or t
  misc_feature (449)..(449): n is a, c, g, or t
  misc_feature (501)..(501): n is a, c, g, or t
ngcccagcttaatgctgtattattcccaatgaaaagaactagactgctgattgtactgtaggataaggtggnngggngtgaagctgnggtntatncttgangcgtgtgagagtggtatggtaaggnnnaggngngtnttttctttcntagccatanncactanacaacttaattttccnttccngaaaatcagcngtcatcaagacagcncttggtaaaacatttaagatttgtgataataagcaagtgctgcagtggcacgccgtgtggttntncactttgaaaccccccattactgttaccctgttatatgatttagctacacagcaagtggactctgaggtgacgttcttttggnccaacatcgtcttcttggaccttagtggggtggggtatgctctagagaagcagcagcccatgcactgaagtttggggcaccgcggctgggngaggaatgggttttcctgtggcgtgcatgctgggccatcctgcacatcaggngcggaatggagaacatgcagaaacaccgacaatgtgaccagagagatagctgcatattttctgtagttatccatggcgctcctttctctgggctttttgcaggatgtgttcagggcggttgactgtcgatccgaagagggatttta

SEQ ID NO: 557235 - DNA, 146 bp, Homo sapiens
cagagaaaagttcattcagtttgattccccatgccctcgacaacgcagctttctcgattatgagcgtggaaggacacatggctgtggtgcatgtgtgcgacccctgtatgtcccatgccacttggctgaggctatggactgggtac

SEQ ID NO: 557236 - DNA, 256 bp, Homo sapiens
  misc_feature (129)..(129): n is a, c, g, or t
atagatatgagttagggaaggttgaggaggataggagaagggtttagatattcctttcagtgagtgtcttgtagtctttatttcttctatagaaagtatctttagagtactttctttggcttcttactntgccccctttcggggagtgcacaacacaatagttgcagatcaacaatcatcacttgccttttgtagaaaagaaaaacaaaaaaagtaaataaaaattttaaacagtaaaataaaagtttaactgcta

SEQ ID NO: 557237 - DNA, 177 bp, Homo sapiens
aagatcccactactccactccaacctgggtgacagagtgagatcccatttcaaaaaaaaaataaatggccatatagacccagttactcagcaaggatggcttgagcctcgggaagatcaagggctggcagtaaggctactgatttgagccatttgcactccgggccggggtaccgga

SEQ ID NO: 557238 - DNA, 291 bp, Homo sapiens
cttaaatggccgaatgttgcgagaaagacccggtccccatgctctttgtccaccagttgcccatggttgtctcggtgtccccttcaccttacctttctagtgcgctcagatctttttgtacgtttgagaattagacctattctagagctatcaggcttaaaagctgcactgatcctcagctgttacttttagaacacaacccctgggtcaggtgatgtctctgcttgctctatcagccttttgccagcctcagaataggcgaggtaccctttaattcctgtgcccttttcg

SEQ ID NO: 557239 - DNA, 298 bp, Homo sapiens
tttcccatttgccccctttttttttttgaaattcccggaaaggaggttattttagagaacttttaggtcgggttcctttggaaccccttgaattcgggggggtaatattttcagaggtttccccaataagggggttgaggcaaacatctttcggcggctaaaaggtttaaaaacaaaggtttccccttgatttttttaaaaaattgggggctttttttttttatggggtttttaggttttgatgaaaaaataaatgttgccttaatcggcatagtaaactgatgtttaaatttcccta

SEQ ID NO: 557240 - DNA, 609 bp, Homo sapiens
gagacccaacaactgtaagtaatatggtatgggatcctggaatagaaaaaggaaactaggtaaaaactaggaaaaatgaaaaacgtatggactttagttgacatactttatcaacattggtttgttcattgtaaccaatgtactattctattttaaggtgctaataataggggaaactggatgcagagaatacaggaactccttgaactatctttgcaactgctctgtaaatctaaaactgttataagataggaagtctatctttaaaaactaaagggagctgaggccaggcgcaatggttcacgcctgtaatcccagcaatttggggggctgaggcaggtggatcacctgaggtcaggagttcgagaccagcctggccaacctggtgaaaccccatttctactaaaaatacaaaaattagctgggcgtggtggcaggtgcctgtaattccagctacttgggaggctgaggcatgagcatcacttgaacccaggaggcggaggttgcagtgagctgagattgtgccattgcactccagcctggatgacagagcgagagaccagcctgggcaacaaagcaagactttcccatcttaattaatcagtaagt

SEQ ID NO: 557241 - DNA, 551 bp, Homo sapiens
  misc_feature (1)..(1): n is a, c, g, or t
  misc_feature (6)..(6): n is a, c, g, or t
  misc_feature (13)..(13): n is a, c, g, or t
  misc_feature (23)..(24): n is a, c, g, or t
  misc_feature (32)..(32): n is a, c, g, or t
  misc_feature (39)..(39): n is a, c, g, or t
  misc_feature (61)..(61): n is a, c, g, or t
  misc_feature (64)..(64): n is a, c, g, or t
  misc_feature (72)..(72): n is a, c, g, or t
  misc_feature (85)..(85): n is a, c, g, or t
  misc_feature (107)..(108): n is a, c, g, or t
  misc_feature (116)..(116): n is a, c, g, or t
  misc_feature (118)..(118): n is a, c, g, or t
  misc_feature (144)..(144): n is a, c, g, or t
  misc_feature (152)..(152): n is a, c, g, or t
  misc_feature (154)..(154): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (170)..(170): n is a, c, g, or t
  misc_feature (174)..(174): n is a, c, g, or t
  misc_feature (182)..(183): n is a, c, g, or t
  misc_feature (185)..(186): n is a, c, g, or t
  misc_feature (196)..(196): n is a, c, g, or t
  misc_feature (199)..(199): n is a, c, g, or t
  misc_feature (202)..(203): n is a, c, g, or t
  misc_feature (206)..(206): n is a, c, g, or t
  misc_feature (224)..(224): n is a, c, g, or t
  misc_feature (250)..(250): n is a, c, g, or t
  misc_feature (256)..(256): n is a, c, g, or t
  misc_feature (262)..(262): n is a, c, g, or t
  misc_feature (264)..(264): n is a, c, g, or t
  misc_feature (266)..(266): n is a, c, g, or t
  misc_feature (283)..(283): n is a, c, g, or t
  misc_feature (302)..(302): n is a, c, g, or t
  misc_feature (320)..(320): n is a, c, g, or t
  misc_feature (330)..(330): n is a, c, g, or t
  misc_feature (337)..(337): n is a, c, g, or t
  misc_feature (341)..(343): n is a, c, g, or t
  misc_feature (353)..(353): n is a, c, g, or t
  misc_feature (369)..(369): n is a, c, g, or t
  misc_feature (371)..(372): n is a, c, g, or t
  misc_feature (387)..(387): n is a, c, g, or t
  misc_feature (426)..(426): n is a, c, g, or t
  misc_feature (433)..(433): n is a, c, g, or t
  misc_feature (440)..(440): n is a, c, g, or t
  misc_feature (442)..(442): n is a, c, g, or t
  misc_feature (449)..(449): n is a, c, g, or t
  misc_feature (458)..(458): n is a, c, g, or t
  misc_feature (474)..(474): n is a, c, g, or t
  misc_feature (482)..(482): n is a, c, g, or t
  misc_feature (522)..(522): n is a, c, g, or t
naacanagggtantttatttatnntacatganaaggtgnggctccctaggcccctcccctnttnaaggggtntaaatggcaactntgaggaggggaaattcattttnntgggggantnattttggcagggactccccagcagtnagggtttntntnttcctntttttntntttntggggttnntnntccaggggtnttnttnnttngaggccatttgggccatnaggtccaccaccctttttttttaacnaaattntttttnananaaggaaatgagctttanaaagtggtcgttaagaganaattccaaccccaacttnaaaagttgangatttgntttnnntttttaattnaaaggaaaccaccttntnntcattttaacccaanattccctttagggggccctccgatgctttttttaccacnttttttnttttatnanatttggnaagtttttntaaacggcaggtcagntccaccanttaaacttttgaattggggacacggaaggccatgccagtnagcttcccgttcagctcagggatgacctt

SEQ ID NO: 557242 - DNA, 288 bp, Homo sapiens
gaagccccagcagatgccaccgccggaagagcccttatgacccctgggccgcgctgtgccttagtgttaaattgcagcttttccggagtcacgtgcagccccttttggttgaggagactcctttggagaagggtgagaaggtggaggttatgctttggggggacaggccagaatgaagtcttgggtcaggagcccagctggttgggcccagctgcctatgtaaggccttttagtttgttttgggaccccccccccacgaaccaaatccaaataaagtgaccttcccca

SEQ ID NO: 557243 - DNA, 310 bp, Homo sapiens
tgttgagctcctactatgtgctttgcactttagaaataaaaagatcagctgggattgcaggcatgagccaccacaccaggctagactccatctcttgagggggagtggcatgattctgaaaaagcacctgggagcagaaaggttgctgtggctgtttttggaaaacacagtctgctacacgggtctccagttagccatgtgtagcagactggagacccgtggaagactagataggctctgagataggtgtactgcttcatggttaggctacaaagcctgtgtcttcatccactcaagctgcttttgttgg

SEQ ID NO: 557244 - DNA, 201 bp, Homo sapiens
aaactcgactgctgcgctcttgtcagactgcgggacttcgaactgctgcggcgaaatcgcgtagtaatctccgtaatccgcatacccgtcgctggcgggtatggacacgaaatatctctctgaatcaagttcagtgccgatcgcgtaccgaccttcgtctgagaagagcaggtctctgaatctcacgtcggtctccggtta

SEQ ID NO: 557245 - DNA, 192 bp, Homo sapiens
aagtgctggggttacagtgagccactgcacacagcctaatgactttaaaatcacaggcaaggagaagggcacagatgacttgagttttatttcatgatgtcacagcatgtttggagcaaagtggaacactctgcattgggttcacatcggtccacagtcaataatggcctaacaagatagcaaacgcggccg

SEQ ID NO: 557246 - DNA, 122 bp, Homo sapiens
gggggatgctggggccatcggctctcagatggcaactcccagggcccagtctcgatgcctctgtaaatatttttcgtaggcagcgtggctccaccggccaagcagtggtaacaacgcagagt

SEQ ID NO: 557247 - DNA, 155 bp, Homo sapiens
tgcaaggattgtctgcacacctcagcctgcccaggagcctgtgttaggacggggtcggggagaaatcatggctctcgaagctcataaaattcaacgtgagtgaagcatgtacaaggactgcccgaagcacacgtggacggtcataaacggagcgg

SEQ ID NO: 557248 - DNA, 357 bp, Homo sapiens
ggaccttggttgcggcgacattgcccaactttccaaaaaaatcggggtcttcggtaaatacgggaccccctttggggccctccccccgaaaatgggggagaaaatttaaatccccccccccccccaataccctttttttttttttggcaaaacccaaatgaagagacgggctttggggattttgccccttggttcccccctaaaaacagggggtggggggcccggacgtaaaaaacccccccccctttcccggtaaagcccccccccacaagactggaggggttgaaaaacccgttgaccccccccttctttttgggaaacccccggcccttaaaaaaagggtttattttttttaca

SEQ ID NO: 557249 - DNA, 561 bp, Homo sapiens
  misc_feature (16)..(16): n is a, c, g, or t
  misc_feature (27)..(27): n is a, c, g, or t
  misc_feature (34)..(34): n is a, c, g, or t
  misc_feature (44)..(44): n is a, c, g, or t
  misc_feature (48)..(48): n is a, c, g, or t
  misc_feature (51)..(51): n is a, c, g, or t
  misc_feature (80)..(81): n is a, c, g, or t
  misc_feature (84)..(84): n is a, c, g, or t
  misc_feature (92)..(92): n is a, c, g, or t
  misc_feature (103)..(103): n is a, c, g, or t
  misc_feature (154)..(154): n is a, c, g, or t
  misc_feature (168)..(168): n is a, c, g, or t
  misc_feature (175)..(175): n is a, c, g, or t
  misc_feature (200)..(200): n is a, c, g, or t
  misc_feature (231)..(231): n is a, c, g, or t
  misc_feature (265)..(265): n is a, c, g, or t
atagttatctatctancactcatatcnatcaatnatgaatcaancatntanctatggatctacatctatacatatcaatnngcnagcaatcngttatctattnattacatctatcatctgtgaatcagttatctaacaatcacatatacgtgtncatcaatctatcanttatttntctatgcatcaattatttatccgtncaatagtttgcaaatgtgaatgattcaggtntcataattgggaagatgcgtctggcatctggtgngtagatcccagggacactgctcaacaccctacagtacacaggatggccccaccacagaggatcatctgggctgaaatgtcagcagtgctaaggctgagaaacctgccctcaagcaactgtgtgacaagagcagccttcaacaaacacacagagctcaggagtactttccaaagaatgtctgcaagaggctttcggggagagaaaagaccccaggcagatgttcctagcaagaagctggtgtcgtggaaaggggcagtggtctcatcatggttagtgaccagctgtggatgaagagc

SEQ ID NO: 557250 - DNA, 945 bp, Homo sapiens
ggtcttaagtattggtgataggtattgcccgcgtacatgggctgaggaagtgttcaacgcagaagaaatggtagagtgttcttcaggcttaaagggtatgtccttgtaactctggaacctgataatgttggtgttgtcgctgttctggaaatgagtaacactatattaatggaaggagatagtagtgagagaggacaggagccactccggtggacgttccagctaggtgaggagctagtggcgtctgtccgtcagtttgcaatgcgcacttgggtcaactgcattagtatgagagggatagatgggttaccgaatgtggattcgcaagaacgtcgtggggcgagttgggtctgaattgcacctcgcggtgtcaattccgtcgaagtttgcaagtgcgtggaactcaaatgcagactgggcacttaagggcctgatgggaataagccttctggatggcaaatttggggtacgggtggatcaaggggctaggagagctgaattcatttcgtgatgcacgcagaagaggagctgggaggagatagtcgtcaaacttggcttattggagcacgagaagtcaaattaactctaggaagaatggttgtcggaatgcaattgaggaatcctgtattggagcgaaggaaggcaacgattggtagatgatagtggggagtgctaagggattaattggggttgcacaatgtgaagtagtacacaatagattagggacaagcccttggagtggcaaagggaggactgttaccacaactgatgggtaatgggccgaataggaaaggtttacccatggcacaagggttgcgttggtaccgcacagttgaccgtgcggcgtcgcagatgatggctggggatgcccaacttgtcagagtaacccgggggggttccctttaactttgcgggacttggagagcacggttgggcaggaacgta

SEQ ID NO: 557251 - DNA, 108 bp, Homo sapiens
  misc_feature (8)..(8): n is a, c, g, or t
gttacgtnggaggctacttctgtctcctgccgtccaggtatgagcttcaggaagacaggcattcctgccaggtgagtgagcaggaagcggtacacggaggcatcaggc

SEQ ID NO: 557252 - DNA, 453 bp, Homo sapiens
  misc_feature (47)..(47): n is a, c, g, or t
  misc_feature (67)..(67): n is a, c, g, or t
  misc_feature (86)..(86): n is a, c, g, or t
  misc_feature (185)..(185): n is a, c, g, or t
  misc_feature (194)..(194): n is a, c, g, or t
  misc_feature (257)..(257): n is a, c, g, or t
  misc_feature (353)..(353): n is a, c, g, or t
aaaggaaacccgtaacctcctacccagaaaaaattacccccaggtgntgtggccttatgtctaatgnccctagcccactctgcctnactgcaaacctccggcctccccaggtttgattgaatcccctgcttcagccctcccagagtagctgggattacaggcaccagtcaccacgcccggctaantttttgtanttttagtagagacggtttcaccatgttggtcaggttgctctcgaactcctgatctcaggtganccacgcgcctcggcctcccaaagtgctgggattaacagcgtgagccaccacgcctggccgaattttcataaatgatttgaaagaaaatgagctcantctttctttttttttcagacggagtcttgctctgtcgccatcctggaatgcagccgagatcgcacctttgctctccagcctgggcaacacagtgagattc

SEQ ID NO: 557253 - DNA, 398 bp, Homo sapiens
  misc_feature (52)..(52): n is a, c, g, or t
  misc_feature (243)..(243): n is a, c, g, or t
  misc_feature (262)..(262): n is a, c, g, or t
  misc_feature (285)..(285): n is a, c, g, or t
  misc_feature (296)..(296): n is a, c, g, or t
acctggcttagtcctactccatctctctccaggttatgcaaaagcttctgantgagtaccattcttcccatctttcctcccttcaatgctaactccacctggcagccagtcagcagctcacacagatcagatatggttctgctgaaacccttcagtggttcttcattacctccagaataaagtcctaccttctcagtgcgggccatcccagaacctctacaactggacacaggccatctcttnagtcatgcttcacacctgnctcccctgaatctctaggtcacnattttcttttnatactacttttcatttctcccaaacacgtcaatgggttcacactgctccttggtctgagaatcccctaccaattttccaggagtgaacatgcccagacggca

SEQ ID NO: 557254 - DNA, 576 bp, Homo sapiens
ggtgttatcgatgccaccactttgtgttttaaagacagtaggaataactatgcatctccgggatagtccgttatgctgcatgatatcgaaccccacaggttcaggatacacaaataatgtcctccggtatgtgtaagaatctgtcctaagtaagtggcagaaaagactattctattaacatgattttaaaaaataaaaatgaaacttgggttggctatgtgattgaaatgtcttggcgatagtaaactagttggttgggttgggtatgctattcttttatgaaacgagcatttggggcataaataacctttcagagtcaggtaaatgattgcgggggtatatgacatgctaatatgtagccttggatttcctgagtccttgtggtgttatgaagtgttgtcattcattcttggaacactacttagaatagcgcacggtccgctcaagggtcatcacagcacttaataatttcggaaagagataagcaggacagaagaccttatcggtatatcaaatgtgagttcatgtgtgatctactacaccagccaaagtgctggccctatcaatcctatctcc

SEQ ID NO: 557255 - DNA, 876 bp, Homo sapiens
gtgcgctgcgttggggtataggtggctcttgagagcgcattgcggctcttatgtctcctcttctacctcttgagttttcatatgagggttcccgttagtgttctctagtgagtccgaagaacccagcagcgtccattcgtgccgaacaagtcccagccatgggcacatcttgggacctggttgggctgttgtgtcggtttcgcggtgttctatgcgttgctctttagagaattgattgtactggcctttggggctctataagctgtgttggtggattgtataattgggatcgccctggctcgaattcgttgtcgtgcttcgtaagatctcttggctcaaagtgtccctggggtccttacagagagagataagaggagcccgctgccgtccactgtctgcatggtgttaattttgccttcccgtctacgttctgaggggtcagagggagccggtcacaagagtggtggcacacgagtcggcagcagcccttgagggcgctagacgggtgcatgagggacggaagacatctcagctccgtcgcctcatgagaaagtcccaacgcctgagagtgggagaacctgcccgctttccaaatccgctgaggaaaccatcacagttctgaggagatggaggcacaaagctcaccagtgtctgtggggtgccatgtgcagcgcctcaaaccacttcacccttaggtgcacctcagccatcatctctggtggacacaaagctctcacatcgataggatcccatgaggatggtcacccttcacctgggagaaaagtgacccagttaaggagctggaggggggtctttgtcccccactaacccgctgtcctgagatactgagtgccttgtgggagcgtgggaggggga

SEQ ID NO: 557256 - DNA, 259 bp, Homo sapiens
cctttctctacaaaaataaaaataaaaaattagctggatctggtgatgtgtgcctataatcccagctacttgggaggctgagatgggaagacagcttaagcccagaaggtcgaggctgcagtgagttatgatcatgccacttcactctaggctaggcaacagagccagaccctgtcttaaaaaattaaaatcaagcaatctgctgttcttcagtaggcttctctcacttaaaaacaaatcaccccagccaggctgcagg

SEQ ID NO: 557257 - DNA, 534 bp, Homo sapiens
atgaagtgattgaaaatgttgtgaaaatgttgcgatcgcgaagatggatcccttgtgtacatcggtagtggggacgggctgcattgtcatagcggctgcgagaaatgggtcacagcagttggttatgaattaaacccatggctagtttggtattccagataccgtgcttggggagaaggtgtgcatggatctgccaaattttatatttcagatttgtggaaggttactttttcgcagtactcgaacgttgttatttgcggtgtgcctcagatgatgctgcagtttggagaagaaacttgaacgtgaacttgaggatgatgcacgagttaattgcttgccggttccctttcccacattggactccagaccatgtcacgggggaggggatagacacagtgtgggcatatgatgcaagcacttttagaggccgtgaaaagaggccctgtacatcgatgcatttccagctgcccattcaagcataaactttactggggagcgttatctgaatattgagtcttcctgatctgtagagac

SEQ ID NO: 557258 - DNA, 752 bp, Homo sapiens
  misc_feature (369)..(369): n is a, c, g, or t
  misc_feature (383)..(383): n is a, c, g, or t
  misc_feature (456)..(456): n is a, c, g, or t
ccgatggaactggttaagttctcctgagccccagatcgccctttggttgacagtccttcgtttagtgtgagctggtttttctcctaggaagttgttgtttaaggattctaattctagttcagagacacattctaaagggttttctttattgctttttctcccaaaattaatcttgattcggcttgtctgcgcatttgtgtgaggaattgaactgttgttttcataggtaaatgagagactgagttttctcaactccaaagagaaaggcatttgctcctcccagccaaaacgtgctcctgggtgactgggggccttgtgggagtgtctgggggggggttgacatcctgtgacatgcagcagccctatggngaaatccccaacanacattaattttaaaaatggcttgtccaggaatgcatataaggactgatcacccatcattttgagccctctcanaggtaatagacctctggagagagaaactgagacatgtaacagggtggaaacaactcagtggtgacacatggtggggtcctgccacaagcaggacacattgatccaccacacaaaaaccctaggccacaggtcagttcctacttctaagaaaaaaaagggggaaacaatgatctatgatgacgagaaacaaggcaatgacctcttttgggactctgtgggtttatggtgcgctacttgccgaacctatgtaaatgggaatataatgatcttgggcacattacctttaggatctggcg

SEQ ID NO: 557259 - DNA, 122 bp, Homo sapiens
tttaatttcttcaccattttccggagggaggcccatcagaagacgaaggagttgaaagaccagtagacgctcctctactcttggagacatcacgggcctataataaatgggttaatttatgt

SEQ ID NO: 557260 - DNA, 224 bp, Homo sapiens
tcccccccccttccccggcccgggtccccccccccgggggttttttttggggggggacacccggttcccctctcgggggggggggtgtctgccccccctgccctttttctgttgtggcgggcgcccccccccctcttcttccctcggggccaagtggccccggggcccccccccccgggttttttagaggaaaaaattccccccccttggggggcggggcccca

SEQ ID NO: 557261 - DNA, 1084 bp, Homo sapiens
ccgcccaagcgcctgcatgcgcgctgccctgcgcctcgccggtgctccagctgctgctcctgctggggccgtggcgtggatggctgcgggctgttgcggagtcgccgctgcccgtcgtggtccttgccatctctggccctgcaatgccgaacactcgctgcccctactacctgtggcagctctggagctggctggattacccccggtgccagggatggcccctctggtgtgccacgtgacctactaatgtggaacaacaacgactagaagtatgcttgcaggagctggctggccggtctgctgggcgatcgatctaatggctgcgtgttggtctaggcatgagctctgaggagctgaagcccaagggttctacgccgagattgaagcacgaggtacccaatgccatcgtggacgcaaaggaaaggtcaccacggtttctagagtggagctcgaagctaggcacaggcgcctcagctttttgccagagaagctgggcgttggccgagacctatatcactgttcgtgcaagaccacgcagacgaaacgattcgtggacccaacggaatcaagcactcgtgcgcggcttctccagtggtggccagtggtcgcttccatgtgtggatggtccccaaattgcatggtgactccacagaacctagctatctccaagcaatcgtgtgtgcggatcacccacactcctatgggcctacatagccgatctgcacccaagtgcagaagagtacgtattcaactcatgccaaatgaaagccgtcactatgtgcccgttggagcctgctgtttcctgatggtcaccccaagtggatcacaacatctctaaacacgattgattaccatttggccgatttagccccatttgacggagtgttaccttggacgaacggcgtgagacgcaagaaaaccccaaggccgttgagaggaagtagccggatagagcacgtggacgccaaacaatatcaccccaaaaagcgtaaaccgaacgatgcgggaccaccatatattgctgaacgcggcaagcaaattccaatcacggacgacttccgggcacgtcaattggcgctatgtc

SEQ ID NO: 557262 - DNA, 340 bp, Homo sapiens
gatcaaggtgaaaaggagaaccccatgcggggaacttcgcaattcgcaaaactctgtctcaacatctttttctttgttagagttggaggaaaggacttacggcgaggcaggccaagggtctttggagccagccttaaaaggggccagaacccccttgtgtttttccaaagggctaggatacacctttacaggactcccttttgggcatcccgcgggaaatataaaaggatttcgctctctcactcccacaagattttgaggggccccaaagacagagagaaatctttagagaaggggtctataagggtgcggggagtatgagtttaggaaaacacaactt

SEQ ID NO: 557263 - DNA, 167 bp, Homo sapiens
  misc_feature (13)..(13): n is a, c, g, or t
  misc_feature (17)..(17): n is a, c, g, or t
  misc_feature (30)..(30): n is a, c, g, or t
  misc_feature (33)..(33): n is a, c, g, or t
  misc_feature (38)..(38): n is a, c, g, or t
  misc_feature (52)..(52): n is a, c, g, or t
  misc_feature (71)..(71): n is a, c, g, or t
  misc_feature (112)..(112): n is a, c, g, or t
  misc_feature (123)..(124): n is a, c, g, or t
  misc_feature (147)..(147): n is a, c, g, or t
tgcggatcctggnagtncaaagcacattcnatnctgcncaactggaacattnttcagggacaagacccggnattacatgcggcgtctgatccatttcataccttagagggantagggctttgnntcacggtttcaagaaacaaccanatttgaacaggctagggatc

SEQ ID NO: 557264 - DNA, 135 bp, Homo sapiens
acgtcgaactgtctggcctgcaccctctcaactgaagttgagccaaattcccttctctcacaccctaaagccgccatcactaggagaatgcgcatctcggcttggtcagagcattactaaccagccaatgtggga

SEQ ID NO: 557265 - DNA, 464 bp, Homo sapiens
tacccaggaggaggagaaaggagccacagtatgtagcaagtgtcctaaagtgcaaaagcttaaggatccatgaaggcgaggagccagaggagtcctggaattcccttggagggaaaaaagactaccagaacacaccactactggaaacccaagatgaagaccatccacctcggctataagggtgctctaacaaaagtggaagatatgttattgaagagattccaggagagtacacccaggatgatttagctgaagatgatgtcattgaactagatagttggaaacagatatttatatggattggcaaagatgctaatgaagttgagaaaaaaagaatctctgaaatctgccaaaatgtaccctatgagacaagaacccttctggaagagacaagaggacaccaattgtcatccaaaaaaagggccatgagccacccacattcacaggctggtcctgggctggga

SEQ ID NO: 557266 - DNA, 406 bp, Homo sapiens
attcgcggccgcgtcgaccttatgatgacctgtaagtgttcaagtgaaaggaagagtaacacgtctctcactttcaatcaaaagctagcaaggattaagcttagtgaggaaggcatgttgaaagccaacacaggctgaaaactcggcttcttgcaccaaacagttagccaagttgtgaatgcaaggaaaaagttcttgagggaaattaaaagtgttactccagtgaacacatgaatgataagaaagcagaacagctttattgctgatagggagaaagaatgagtgttctggatggaagaccaacacagccataacattcccgtaagccaaagcctgatccagagcaaggccccaagtttctttcatggaattgaaggtcgacgcggccgggaattttattgtagta

SEQ ID NO: 557267 - DNA, 925 bp, Homo sapiens
ccacctggggtaccatcacccgatgaggcaaccagccagaacgcctgaacgcaggcacatactttcctatgcgacaccctagataggctcccattccctcactactcatctgcggctgatttacactcactaaaacctcctatgagtgtcactaaatcattcattactatcgtcactcatcagtgcccatgagcctatcgaagtctcctgagccactaacaagttaatatgatttagcttacacaatagcgttttatagtaaagatacctcttaacggactccacttatgactccctaaagcccagtggtcgaagcccccatcgctgggtcaatagtacttgccgcagtactcttaaaactaggcggctagggtataatgacgccgtcacagctcattctcgagcccctgacaaaacaataggctaccccttccttgtacttatcccgtatgaggcataattataacaagctccatctgcctacgacaaacagacctaaaatcgctcattgcatactcttcaatcagcaaatagggcctcgtagtaacagccattctcatccaaaaccccctgaagcttcaccggcgcagtcattctcataatttcgcgcaggacttacatcctcattaactattcctggctagcaaactcaaaggacgaacgcacccagaggtcgcataataatcctctctcaaggggatttaaagtctggtcccagcttataagttttggtgacttcaaagaaagccctgctaaactctggctttaccccaatattacctattgggaaactcttggtgtgcccaggtctgaaaaaaaccctattagggacaattatacaggtgattctttatttaccacacagggctcacactaaataactagaaaaccggttttcctctttcaccgtcgggttacaaaacaa

SEQ ID NO: 557268 - DNA, 317 bp, Homo sapiens
ttgaggttaggagctgaggcagcgtgtctaaatggtgaaactctatctctactaagaatacagaaaattagacaggagtggtggcagtcggctgtaatcccagatacttgggaggctgaggctggagagttgcttgaatccaggaggcggaggttgcggtgagccgagatcgtgccactgcactacagcctgggcaacgagagcaaaaatccatctacaaaataaaaataaataaaacactagagtggcttaactgtgcgagcctgaatgcaaaacgcagatcaacgactctacccggactcgctataggggtaccg

SEQ ID NO: 557269 - DNA, 856 bp, Homo sapiens
taagcatcaaggtagtagtactcggggccgaacaggggtcaacgtttaatctacagttatcaccaacttgtttgtcttttgtcggaatcaaaatggtatcaaacggcttatggtgaagagaattatagcagacctgaagggggcgaaaaaccagatagggtgggggggatggatgccggtgacgtgctagcacttgtgtggacatcccagtctgcattatgctgtttaacataaagtgccgacttttggtaccagcaaatacctgcccattccaaccctgggttgggagcagacctctacggtcctcggtagactgggtgctatggaggacaagggagtttttctttcttaagaggtcttgcagggaaggatacaatacaacaaggcctaaggtattggactgtttagctggtgtctggtgtgtataggaaaagctaaaacaagttattggctttccggggtttgtgacgacacagatgggaaattctgtagcccttgtggttaccctgttgattataaaggctagctcaaaagagttggacggcatgagtcaagtgagttgtgcacatttgaaggctgggtgagcctctgtgggtggtggtccccttgggtctgggtcttggacttgcccggtggtgggcttgaagatgcctctctggtctgattgttcacaccgggcctttcaacagggcccaggaaagttgttccggagcccatggccgtcttgtggggccaggtcggtgggtgccccggaacacgtgtctcactctcaaggaaatacgcggcggacacacgccgcacggacgacagggtggtggtggccccctcagggtgggcaggagtaacagaagggcta

SEQ ID NO: 557270 - DNA, 481 bp, Homo sapiens
catctgtaacgaccctcctgtgagctataccgggcgtcgatcacacgccatcgcacacgctccacacctgtggcacactcctgtgagcttacaggccttcgatcacacgccatcgcacacgcttcacacctgtggcgccctcctgtgagacttaccggacttcgatcacacgtcatcgcacacagaccccacacctgtgacgccctcctgtgagacttaccggccttcgatcacacgccatcgcacacgctccacaactgatggcaaactcctgtgaagacttacaggcctatcgatcacacgccatcgcacacgccccacacctgtggcgccctcctgtgagcttaccggccttcgatcacacgtcatcgaactcgccccacacctgtgaagcccacctgtgagcttaccggccttcgatcacacgtcatcgcacacgcgccacacctgtgacgccctcctgtgagcttaccggcctaca

SEQ ID NO: 557271 - DNA, 197 bp, Homo sapiens
agtgtagcctgccttgtatctggtagatccacattacacacatcggcatctaacagcatgcttcacaatcacgaagtagggagtgggacacgctgtaatggagggctgtgtagccgttgccgtctgccaagttgatgacatagcggaggacatctggggaaatggcctcaaatttagctatgtagtcccccactatg

SEQ ID NO: 557272 - DNA, 255 bp, Homo sapiens
gcgcctgtagtcccggctactcgggaggctgaggcaggagaatggcgtgaacctgggaagcggagtcgcagtgagccgagatcacgccactgcactccagcctgggcaacagtgagactctgcataaagagcatacccatgtgtgtacctatctatctatctatctatctatctatctatctatctatctatctgtatatagatatattaggatgtaatggtggcatacccctgttctgtggtggattagggttt

SEQ ID NO: 557273 - DNA, 166 bp, Homo sapiens
attacatgtataaagcgacaccgacaaatactcccacatccgcttcccactggtccagcatattattacttactgttcagttcagctgcttcaggaagagaaaatacagaacggatgggaaatggtctaagatgactggagcctaacggtttgtctaaatgcaatc

SEQ ID NO: 557274 - DNA, 395 bp, Homo sapiens
  misc_feature (51)..(51): n is a, c, g, or t
  misc_feature (135)..(135): n is a, c, g, or t
atcacttccactctcatcctgtggcgttgagtttagtcaagtggttacacntcactgaaagagaggctgggaaccgtagtctagctaggagctctagaagaagagaacatgatttgatattgttagcagtctctnccacactgttattaaaatatcacgaaagctaacttgtattaaacactactcactagcaacctgttctaaaaactttacatgtcgtcttcaacaactctttgaggtacatactagtttaatctctgttttacaagcgaggaaactgaggcatagagaaatcaaggagttgtccaaggcacagtgctggtaagatgaagcctgggtttgaactcaggcagcctaactccagagcaggtgtttgtaaccactactccatgcta

SEQ ID NO: 557275 - DNA, 329 bp, Homo sapiens
atatgatgaacactgtacagttatgaaaacactaacacaacttaaagccaaatatctatgtaataccaaggaaaattctgatatggaagtggttgaggtagaaagcaaagaataaggcacctgctatgaatttagcacaaccataaaacagaattagttaaccaagacacttgtttcaaaaagggaaacaagtacagagactgattaactgggtgagaaaggcaagtgacaatttagttaaaaacctgctggcccaaggtcagttgattcattccttattccagaatagttaagttcctgaaagtccttaaccactctgctcccttact

SEQ ID NO: 557276 - DNA, 194 bp, Homo sapiens
ggggccaggaggaaagttgttactactacgataggggtgttggagaattactattatggacaagcccagcccaaggaaatcctcagtgaatctgcgtgactcataattgtgctgctcaatctatggtttctactgtgaaaatggaaacccactcacccgtcacagaagccacatgcttgatggagatgacctaa

SEQ ID NO: 557277 - DNA, 292 bp, Homo sapiens
agtgttagttcggccttgaactcctggactccagctatcctcctatcttggcagccaacgtaccgagattataggttgagccactatgcccaggctttatgtttaaaacaatccttccataaagtatttttccttgaaccctctagattagcattctttaattgttaattttatttattattattttttgagactgagtctcgctctttcgcccaggctggagtgcagtggcacgatctcggctcactgcaatctccgcctcccaggttcaagtgattctcctgccttagct

SEQ ID NO: 557278 - DNA, 1368 bp, Homo sapiens
  misc_feature (173)..(173): n is a, c, g, or t
  misc_feature (268)..(268): n is a, c, g, or t
tatcatactatctggagagatgcacaatacactccacgaagagagtctacgcctacgatattggtgctcccatactttgaggttagagcctgccctgataaaaactattgtctagcatcaaaactcacctaggtgtccatcgaacaacatagggtatatagacgcctccgatnacactaacatgcagatgtcatagccaattccatacgatattagtgactcaactggcgagaaggcgaaatgggcagttgcacttacactacgcctntcatgatggtagcgcataatacgcctaccgtgtaccgagacaagatactgctcgtcatgctcccgggcaccaaaaaatcgaaaaacaccaatcatagggcaaaaggttaccattactctcacatttccacacatacttccgaattcagtccaagtcaagttcattgagacatggggtactcacatcatcgatagactgaggagaagactaggctctccctttagcgaacgtttgcgtggaaagtgctctcaacgcagagtatgaccactcgataggagtcaatctctctccgttctttgtacggagtactccggtgctccctagcctttcctttttccgtactaccaagtaggaacgacacagaaagcattaaaacacgcggccagtgctggccagaacgcgatgattcactcgccatacttgagctacgtgccctcatacaagcgttaaacccaacgtgtgatatgttctcctctccataacgacgtaccagctaagcgtgcatggcgagatttgcctttaaagtacttcattcccaataaagccaaaggcactacgcaagtgagggggcgggggcaatgtttaatccaccacagataaggaccccaacaaaggtaagaccgaccaagagagaagtcccttttgagggccaatgggacctccccagtcattaccataaaccctcctcaatttaatacacgcgtagtggcaccattcatagttaagcctacggaaatcgttaaccgggctatactagatccgcgtttagagcccatctcatatcgcgcattttcgtctcacacagcgcgtccacgtcggcggaattctttcaggtgagtggtacatttgcctttgaagagggcgttaaacttcaactccaggcggacattgtccgcttgaccctttaatcgttactcaaacaagtaataacattaggcttcacaaagcctaggccgacaggaaacccctttaccttaaattaaatcgtccagcttacccgtggggagtaggcgacaacggcataaacacagttgcacgttaatcatagcccatatgaaattgcaccaacctcgcgacaccgtctccggttgttgccccta

SEQ ID NO: 557279 - DNA, 962 bp, Homo sapiens
  misc_feature (427)..(427): n is a, c, g, or t
  misc_feature (643)..(643): n is a, c, g, or t
gcttgccaagggcagtggttgtgtgatcgccagtcttagcggaagaagatgttctcgtccgtggcgcacctggcgcgggcgaaccccattcgaacatcgccagatctgcagctggtgcacgagtggctctcgagggacctccgccacgtcatgctccccaggggcccacgggcgcagccccggctgctcctcgggacctggacagcctgccgccgtgtgacgagtacagttgtgatgtttggctccgcgaagtattgtgcgctgtgtggcttgggtggggtcttaagttgtggcctgaacacatcatcggctgtggattcccctggtagtttacgtggaaattgcctgtatgcagtgtggagccccctaagaagtacaaggggcatatagaagcggattctcagtgacgcttgaagaggatggtgtncgggggtctggcgtaaagcgatgggcgtccgacgtgttccgtatgggcgtactccagtgcagggactctgcaacgttgtggctctctagtggcaagtcttttaaagctcttggtaatcagcaagtatgctctggaggaggcagaaatactaatactctgggcgcagatcacctaatattaagggatggcgtactgaccatggtgctgaatgctttntgctgagcttttggccctggctcctatgtgaagctgcgtagaggttcggagtatgcaaagcccagacgaggtcatgccgagaacctttggagggatgctagtcccaaaagggtgtaccggacgcaaggcctaaacagcagttctacaaagggggttgctcctctctgaatgacacacgagaaccatacagccatgatgaagtccggcctggctccggcaacggtactggtgcaacgcctgtacaaacgtctgggggtcctaagccccgcgatgcacctgtaaagtcagaggaactgggtgcaactttgcaacaggtacc

SEQ ID NO: 557280 - DNA, 324 bp, Homo sapiens
cacgagggaagcccttaattcactgcaccctgaagatcatgatggcctaagcttccttgcaacagaaaaccacttaagtgttaacaatcttccattgaatttggaaggtcttgtctataaacagaaaattgcaggaatccagcacatactgctcaaaatgatatgagattaacttccgcagtaatgtcatgtacctgttaccgtagatcaccctacccaggtcagtgttacatcccccaggggtaccgacaagaaggttgtgcggaggttacccaaatgggatgggggcaactcgaataagaggccgctgcctgcctgaaatct

SEQ ID NO: 557281 - DNA, 682 bp, Homo sapiens
  misc_feature (677)..(677): n is a, c, g, or t
tagcgggacagcgaggtcggcagcggcacagtggaggtcggcagcggcgagagaggtccggcagacggcgacatgcgaggtcggcgagcggctagcgaggtctggcgagcggagcgcgctgtgctcttgccggcggactctgaatcatggcagaccacggccacgagtggacgaccgtcgggctcgcgcgcgtaaagcggctgctcagagatggaagactatgattacacatgctggaattcgagaccaggtgaggtagcgtggatgtgagccccacgttcgacaccatgggcctgcgggaggacctgcatgctggggcatctatgctttacgagttgttgaatgaaccatttagcaattccaagcaaagtagcaatcaatgtcagagtcatcaacaggggagatgattgtcactcggcaacagatcgtcagatccgggcacacggaaataatcgggccacccttcagatatcatctagtccgtccagatgttctggataattcagggattcgtagatatacttcaaggcttggatcttgagctcccatcaagagagttaggctggtgcagattccagaaggggctgattagctcatcgagtgactaccgtgaactgttcagatgccaatgaccatgcatttgtatggcaccaatgttgtgccaggacatcacggangctgg

SEQ ID NO: 557282 - DNA, 1331 bp, Homo sapiens
ggtcctgacccgcgagcacagagcctcgcctttgcctgatccgccgccctgtccacacccgcctgccagctcaccatgtgatgatgatatcgcctgcgctctgtcgtcgacaacgtgctcctgtgcatgtgcaaggcctggcttctgctggtgctgacgatgccccccgtggcccgtcttcccctccatacgtgggtgcagcacccagtgcaccatgggccgtgattgtgtgcggcataggtgatcacgcaaggatttcctaatgctggcgctgacagatggccccaagagcacacgagcatggccatcctacgacccctgcaacgtaccccaatcagcacgcactggcaatcgatacacccaaactggggaaccgaccactggcagcaacaatcgtggccaccagcaaccgtatcgtaacacatgcagccgtgccgcatgctgggacatccacgcaggcaggcaacgccacgagtgcattgctagaccccgaaggaccaccacgctggacacccccaaaagggccaaacccagcgcagcacacgcatagcaccccaagaagtacactagtaccccggacggacacctagtcaaactagcacgcgcaaggcacaatagctaaccgctaatgccatcactccacaacgaggacatggttgcctaagttccacattggtaagccgacccattactgggcaccggttaaacccgaaccttgggccactaccgctcgaatggcgcacgttcccggaggttgacaaccaatgggtcgctacgaaccacaaaacgacccttggcatggccccccccaattacattaacgcgcgaacgtgacggacgttacttctggccgcacgtttcccgcgcacaccgaaattgagtcccgcaacgatacacccttggacagacatacataggggagaacacatagggggcacttcggcgcaccatgagaggacaccccccagtcgcaacgcatcgggacaacatgaatacccccatacccaagctggggcaagaccaggcaaactagccccggatcgaaacgcgcccgtgcaatggccggcgtccgtgtgcgtgctgtcaataccacgggaccccttcgatcaacagcccaaagacacgccgacaacgacggatggagaaccccggagcagcagcgacccggcgggcgggatcaacaagcacaaagtccccagtggcatcgagccccgcgcgggatctgtgaccaccccacatagtttgctagagacagctgctggccaagccgaggacaataagcagtcgcactctagagacctggagtccactgcaataccagaagcgaacgg

SEQ ID NO: 557283 - DNA, 1403 bp, Homo sapiens
gaggtgcgcgccccgccacccgcgcgcgtagagcgaacgggtgagaacatcgccagcgacggggacaaccacccgggttatatactgcgccgcaccacacgaggggcgcgcgcgacgagtagtcggcgcaccaagctccagaaaaggggcgcccgatctacaaaaagcccctctgcacacggaggtttcgcccacgcaaaagacacacacgggggggtcccccaattgagttccccgcggggcacacccggggtaattccccggggacaaaagagggcaccggtttccccagaaatgctccccgcagaagagatctatatgagtcgtcgcccccccccccccgggggggaaggacctctccacaaggacgacggttacacagagaataatatagagccgcgcgcgaactcaacacggggcatgcggctacgaaagaaccctcttcctccccggggggagaccctctccaagagaaggaagtaacgcacaagggccaaaaagccctcctaaaaaagcctctgggcgggctcccgaagaggcgccccccgaaactgccccgcggggatgacctcccccagaggggggccgctaaaatggagggcgtctccaccccccccacggcaaataacggcaaaaaagtgtttccctcggagcggagcctgtagagggaacaaaacgagaaaacacggttaccacttcccgcagaaaaaagaggtcccgcccgggaacgtccacagcaaatataaggccgctcccgccaacatgtgtaccaccacgccccacgggggggataacaaaaaagagggccctccgattaacagagagagtctccaaaattgcccccctcttctcgccacacaaaattgataggaccccaaaggacacgctcccacggggagccacactgggagattgtacaaaagtgcccctccccacacggtttggagaaaaataaaaggaggattgagagaaagatccacgaattccctccacatgggagaaaaagggaaaccccccagaagtcccacaagggttccaacgggaaaatgggcccacgggaacactgggagaagagaatgtaaagaaacttggagtccatgaattccaagcccctggggaccagatggaaagacccaaagccggatagagttgagttataataaaacttacattcccatatctgtgttccggatatttaaagtgtttgagaaacttgctcaatagaatctcccttaagttgttttccgctttcacattgtttttggaattgttttaatgtttgtcccttttttttcttaaatgtggagtttcacttgaggttgaattttttgaataaatctgccaatctggagtaaatcttgtactggctaaagattttaataaactcgacatgagaaaaacca

SEQ ID NO: 557284 - DNA, 977 bp, Homo sapiens
gagctctgtctagaccttttggttcggcgcgcggtgcgcagccagctcaagtgaacgtggtctgagcgtagctaatcctagcgacgtactcctggagtgcagttgacttcagtggctctgggattactccaaacaaacttacaaggcagtcgcgcgcggtggggcatcggaggcgatacctagaaactgaattggccgagcatggaggtctcatgacagtgcagttactcgaattctagtcgagccataggaggtcgcgaacgcggacgctcgacaagtcggacattaatcgtcgccagcatggctgcgaccttccaaggcggccataccgattggaggcaacctggaggcttatcgccggtagcaccatgtacgcttggaagtctagcacctatgggccgaaccatggaaggccccgtgtgaggccctatccgcactacgtttgctggagaacaggcacaacgatgccgctcacgaggagacacttaacccatggtcaactgggcccctcatagttgagtcggccacccttgacttaggggacccaacttgagttgagttgctctattaattatacgcatggcagcttttttgccttagtgggggaacgtggcgtagcccttcggcaattgccatggaattaacccatatttcctaggaggcacgcgatggataggcccaaagtgtcaagatagcaaggaacattggctagtataggaattttcggcaacaaggaaggggggccactggaatcttgttttggcacgttttccccaaatattggaaaacctcccaagcgggccttttcattgtgtgagggacaccgtacgcacgaggcacgtagggccagtagcgtctgggagccgaatacaccataagcgctgaggcttaaactcaacctttgggggaccagcgggcaagccaacaggattggtcgggagcgtaccccgaattttggaacagtggggacacaccca

SEQ ID NO: 557285 - DNA, 368 bp, Homo sapiens
cacgcccatgtcacaagctgctcatggtgtgacaccaaggagcaggcgcatcctgaaccatgtgctgcagcatgcggagccctgggactgcacagagcgtgctggaggccattagcacctactgcgagcagaaggagtgggccatgaactgtgggcgacaagacaggcaagatcgtggacgccgtgattcaggagcaccagccctccgtgctgctggacgctgggggcctactgtggctactcagctgtgcgcatggcccgcctgctgtcaccatgggcgatgctcatcaccatcgagatcaaacccgactgtgccgccatcacccagcggatggtggctttcgctggcatgaaggacaaggtcaccc

SEQ ID NO: 557286 - DNA, 279 bp, Homo sapiens
tggggccttttggtatccttttaaaaatagaaaaaaccggctaaggggtgggggttttcccaaatttcacaactttagggattttttttcttgttggaattaaaggggttgggtcagtgtgttctcttttagaaaaaaaaatattcaattagtccgccaccaactatctccctttatgcaataagggtgctttcttctcttattttctattgaggggtatgaaaattctcgtgcaatctaccccttttataccatatgcgaaaaaacaaaacaacaaga

SEQ ID NO: 557287 - DNA, 225 bp, Homo sapiens
atctcgcggctctccgaattcttgttggtcattgctcctgtgccgtgttgcaggaggacctgtctttccagctgtccctgaagtgccagcggagagcaccaggcagcccagaaacccaggcgtggagattgatcctgcgagagaaagggggttcatcactggcggatgacctacaagcgattcttgtacaacaaagttaccaagatgttgaacgggctcccatga

SEQ ID NO: 557288 - DNA, 255 bp, Homo sapiens
gaccccacatgtaccctatacaagtgcaaaacacacccgatcctgccatataaagaacatccacacacatttaggttgactaaatcatcatagaagaatctaggaaaaaacaaggaaggaaaaagaaatcatatctcaactcaccattcagaaacagcatatagggccaggcatgggggctcgcacctgtggtctcaaagtgctgggattacaggtgtgagctaccacacctggccaatttactaccatttttaa

SEQ ID NO: 557289 - DNA, 845 bp, Homo sapiens
ctgaagcatggaaggggtgttgaacaagtgggaccaagtatctcacaggctggcagcctcgacgattggttggagataatgcggaatctttatcctactatgattcacaggactgatgtggcaaagggagcagcaggaacgcgtacgatcgatggcagtttgtgaaattaagggttcactaacagcagacaaatacttaagaattggacttaatcatgcctggagagcacgcactttctacatgaaggcagtgaatgcacctgaaacgacagaggtggctggtcgctctggggagctccaaagcatgtttagactgatacacaggactataaaagcaacacacgaaataagtgaaaccagtgaatcgctgaaaaccaaaatgtctgaacttcggcctctactgtgacctcttaatgcagcaagttcatacaatacaggaatttgtcaccatgattgagaatcattcatcttcctagtgcagagaacatgaatgaacggcctcttatctgctataagtgccaccgtgtaaacacatttcatcacacacgctcggaggacactgtgtgacacaataggccaatggccagtttacacgctggaattgtttccatgacccatccggatccttatcttatccatgtgtcacctacttcctgtacacatggatcacgcgtcctgtccgcaccctggtcttgccgctcagataaggacgtagcccttccaaacagaaccggatctaacttagcgattcccaacagagccgaaaacaaccacgaaccaatttgcacgcccttccttagtcgacacatacctgcacgctcacaatctctgccatatcgactcac

SEQ ID NO: 557290 - DNA, 754 bp, Homo sapiens
agcgggtttagtggccagagtcgactcttccgacggaggtggcaggacaggcttggaacagctgccggagtgtgacggagcggcggccccgtcccggtgcgctggaggtcgaagaccttccaggataactggcccgtcagtagtcctgacccatggctcgtggacattcctgagccgcaagtctccctcacattcagtgcagtgattgagtgcggaagtgaatgtgacagggcagaagcatggagcaattgtctgctccatagccaatgatcggccaagggcgcgcaggggctggacgccatgagctacattacgcgatcagcgtgacctggaaagagaccgcctgagatgttgcatacgttgttgtcggaggaagcctgctggaaccatgtgcccatactgtgtacgacgacgctggactgagcagttggaagcatttgacctgcataacctttccgagctgtctcaacaggctgtgtgggcattatgcgggcaacatgacgtgctggagctgaacttagactggaagtcgccggagaaatctgtgcctcacgactaactagaagcgggctcaacaagaaactagagcgttcagacacgcctctcatagttggtcgacctgtggccttgcctagagtgaataggcgctagtccaagtggcctcgcaaggctttgacttacagtcaatcgggcgggacatccaagcggccagggacctcaggtgcccattgcccgaaaccctgcaggaatggtg

SEQ ID NO: 557291 - DNA, 120 bp, Homo sapiens
tgacttagcttaaaaaaagtaccgagagaactacgtttcttctttagttatctactaggagcacaaacggctggctgagattctggccagctgcttgcccactggtctgcgaggaacccc

SEQ ID NO: 557292 - DNA, 392 bp, Homo sapiens
acctgttaccacggtttaaagtatatctgctactttgacagccctccttccaaaaggtagagcccagttcctctcccctgaacgcgggctgtgcctccggacctgcctttagtgagtaggatatggtgggagtgatgctctgagactccccaggtgaggtcagaaaaggatggcttctgcctggtgcactctcttgtcattcactttgggggagcagctgccctgttgcagggcctgtaagcagcctgtgaggctcaccctgtggggaactgaagcctccccagccttgagagggggctaccgtcgacctacctctcgactgcaacctcacagcagaccccaaacaggctcagctgagcagcgccaaacccctgagccaaagaccttgagga

SEQ ID NO: 557293 - DNA, 175 bp, Homo sapiens
aagccaaaggggtcagctgctcactcagggtcgaaggccatggcaggcatttggatataatcatacacaccatgggaagccacaggggagttctgagcaatgaaatgacatgaccatgatctgaataaccttctgtgtatgtgtgtgtgctgaaaatataaatacatttacaatc

SEQ ID NO: 557294 - DNA, 679 bp, Homo sapiens
  misc_feature (678)..(678): n is a, c, g, or t
cctatgggaactgtagactcagatcctaataacgagctgatgcagctataatgctaggtggttcctaagcacacgggacacccgacacgaactgcctagaatggatgggatcattccaagcactggtactagccccctagtgctgaatccccctatgcccttgccttgcccttccaacaaaccctaggcccttgagaagctggtactgctacttgcgctcacagctgccttggccccacccactgggagatgtagcaaattgagtgagagtcctggagtctgagcctcaagctcaaatccaggccaagtgatcttgggcaagttaatctctgggaactttgggtgtcttatcctcaaaaaaggccatggaagggctgtagaagtgattaactggcaacgcaggatgaaggagatccggcgtttctccctcacaaccttgcggctcgagagggggcccagtacccaattcgacctatagtgagacgaatgacactgcactggccgacgatttacaacgtactgactgggagaaccctggctataccccacttaatcgccatgcagcacatcccgcctttcggcagatggcgtgatagcgaacaggccctgacatgacgcccttaccaacagttgtgcactcagtatggcgaattgcataatcgtacgccgttatcttgnt

SEQ ID NO: 557295 - DNA, 176 bp, Homo sapiens
  misc_feature (2)..(2): n is a, c, g, or t
gnccaacgcaactctttttcactaaaaacacaaaacataagccaggcacggctgtaatctcagctacttgggcggctgatgcaggagaattgcctgaacccgggaggcagaggttgcagtgagctgagatcactgcactgcactccaggctgggcaacagagcgggatcctgtctc

SEQ ID NO: 557296 - DNA, 122 bp, Homo sapiens
tgagactgatggtgatgatggaaagtgtcagtgatggtggtgatggtggtgatgatggaacctgtggctggtgcagaataggcacgagaatatttattaatgggaacagtattcgaggtgta

SEQ ID NO: 557297 - DNA, 922 bp, Homo sapiens
  misc_feature (3)..(3): n is a, c, g, or t
  misc_feature (915)..(915): n is a, c, g, or t
ggntggccagcttttattcccttttttggccccgcccacatcctgctgactggtccattttacagaccactgattggtccattttacagaacgctgattggtcaattttacagagtgctgatttacagagtgctgattggtgcatttacaatcctttagctagacactgagcattgattggtgcatttacaatcctttagctagacacaaaagttctccaagtccccacccaacccagaagctcagctggcttcacctctcaataatgctcaccaacttgttaaccataacaaacccactgcatgttactaataagtaacactgtcacaaaaagttattttacaaaacaaaaccagttggggagaaggatggcactgttttccacctttgctggattcccctatctgctctgcacagccttggtggaagtgagtggagattcagcctcccccaggtacgcggctggacgaaggagtatttgagcagcctttctgatcatcgtggtcttcctatttgaactacatgaacccaggctgggggtggtgagctagctacctggcggagtggacactcatgaaccagccttctgcgcctggctgcactgaagcccacgggcccacctctcactgtcaatggatcttcacccacctggcaatggttcaacatcagaacttggccgtgtgggaaaagctggctcaccaatagaagagatctgggcactgtcggcatgtcttcaggcagtatcacaaaactgcgctgctaacgccatctcacgtgaaaaacctctgaacacccatgtctcaaagttaagggaagctatgaaggtcttggtggtggtggcaagtgtccagaattctgctattcacttgaaaatgtaaatttcgccagcaacaaatagtgtcatatgttttcttnaagtggc

SEQ ID NO: 557298 - DNA, 978 bp, Homo sapiens
caatgggaggctgggcctggtggagttcaatcatcctgtggatccgcatccggaattacctgtccatcttccggaagtttgacctggacgagtcgggcagacatgagtgcctacgagatgcggatggcgcattgagtcggcaggcttcaaaggctcaagcgaagaatgctgtacagacgctcactcatcatccgcatactcggatcccgatctggcggtcgacttagacaaatttccgtttgctgcctggatgcggttagagaccagtgtgcccgatttttcaaaaacctctggacacagatctggatggagttgtgaccttgtgacttgtttaatgtggtggcagctgaccatgtttgcatgaggcagggactcggtcccccttgccgtggtcctcctccctcctcgtctgacaagtctctgcctcctaccacatcataccatggccacctccagcttgcatgtgctcttccttggagcagagaagggcagcgctcgtcctccgtgtcccctctcctcggcatttcaccatcgttcatctgtctccgggcagaactgtgtggcccctgactgtgccagccatgggctcgggcatggactccctgggcccccatccattgccaagtcaggagggctgctttgcgcttgtcccgtgcctcgggacgagtcccgggtttgcctcagcatcctgatgtggcccatctcctcattttgcaggaggcaaccactcaagagcagcggcttgggcttgctgtggatagaaaatattagcattaagtcgagccagcctgaagcaaggggtggggcggccccaggtcgggaaggcccgggctggaaacctgggttcagaaccagaaaaggcccttttggtctgggcggcgccaggtgccccggggggggggccccgcacaaaaaagggagagaccaccgcacagcgtgggagcaactggggcgcccccacaccccagagaaaaaccc

SEQ ID NO: 557299 - DNA, 424 bp, Homo sapiens
acattggatcatataacaataaaaatggtagatcattacgtcaatgtgaaatacagtccagggataaagaaaatactacattttctcatttatttgttggagctagaattgttgaccccacgaagtattgtagagtggaatgattgatttcagagactgggaagcggtgtatgagtggattgggggattaagatagaggctggttaattgtggtacaaacttactattagattgatggaattaatcctaacctttgatagaagagtatgagtgttagtagctatcaacagtgtactgtactttttaaatagctagaagagaggtacaccctctcttcagggtgatggataccctatacaccctgtattgattattgtacattctatgcttgttacataatttcagatgtatctcaaaaatatgt

SEQ ID NO: 557300 - DNA, 1591 bp, Homo sapiens
gtaagcacggctagccgtgctctcagagcgtgtgacgtgaagattaggagcccatcgctcctgtcaggaccatctagtgacagcgctgtaggcggtattactgactctgaaccgatctacagtctgatagcggctctttaacaatacttcgtgcatcatagcacaccgagcatatgcaggccaagattagctagacacgacaaggtctaatggctagaggatactcgcgccctttctgtatcgttctatgaagagcgagctagcaacgtggtgcctatcagtgccagtatgcgtccactacatattcgatggacctggccgtggtgtcaatgtcttgaatcgtggcgacatgtgtgtgcgcgcgcacgagaattagttggagtgcacttcggggcgtggatacgagcaaagaaacgatacaaataggtgcacgatgacacgctgaatcccatggaatcgcatagcagcctggaggaaacatctgcatgagcgttgagactattagcaactcttccttgtagcgaagagtacgctatggaggacctgtggcagtagcgccctagtcctccctagagaaggccttatgttgactatgtgtgtccagggctcaatcctctgaaagagaagtttctttgaccccaccattctgagcgtaagtgcgactgggtcgcctattgggggcccaaggggaactacatctttaagccaaatggccgtgtcatactcgcataccaggcataggacaaaccgtcagtaattgccccaaaggggacggcacaccagattgacgaaccttagacacccatctctgttacccatccgcgaagaaacgcgttaaattccttcaatggtagtaggatacctattgcttacactatagggaaagcctatagagtgttggcgtaatgcggctgtagacatatacccccggatcgcgatgggcaatcgtggtcgtgatactcgtctaaaggagaaatccccccaacttactttatagtgaggcagttatataaattccggaaaggggcaataaaacaacgtagaataaattcgtaaggggacccattgggattggcgctcctatgtaggtttggtagcgcccttagatccaacattgacatttcgtacatggcaactcaattttcccacagagaaagaaccatcaattgtgcaacagcataatcgcttggacaggacacccacaataggcagcagggaactgaacaccttccacctagtagtaagatacatggtggctaccctcgggcgcagctgagtcccgtagctaccagccacggtaacccgggagggtgtcacgcgcaatcaaacacactcggcattctcaaggagccaagaccaatacacatcgctccatcatagagaatatggaagtcacccgtcaagggtgtggcaacatgcaacacgtgcaacaccatggggagaacacccgaagaggcaaaagtaacccacactatggacacacgtggaacaccagaacgagacccacgcggcaagagccgaccacagggcgcgcacagaaagtacccgagatccggcacggcccccacaacggcaacaggcacatggcaat

SEQ ID NO: 557301 - DNA, 162 bp, Homo sapiens
accccggccccctccagggggcagtttttttaaagagtggccgggagcattttccccctgctggggaggcaaagaccctgcaatggccccctcttttaaagggcagctggacaggggtaggttttttcaataaagtttttgtattaaaggaggggctttgga

SEQ ID NO: 557302 - DNA, 357 bp, Homo sapiens
ggcccaccttaacggcacaccaggccgtctgctggaccatatgcagaataccccaggatattatgtataaaaaaactgcagtgtctggtaatatgatgaagctgatcgtatctatgagaatgtggggtattgaagaggaattaaagcaaattattaaacttttgccaacacgtaggacagactatgactcttttctgccacccaaactcgaaaagttagaagacctggcaaggatttctctgaacacacggagccattgtatgtatggcgtatgatgatgcattaagcgaaatccacagtggaatggtctttaacaggggatatgtaggatagtcccttctgaaaagaagattcctc

SEQ ID NO: 557303 - DNA, 338 bp, Homo sapiens
  misc_feature (279)..(279): n is a, c, g, or t
  misc_feature (303)..(303): n is a, c, g, or t
  misc_feature (316)..(316): n is a, c, g, or t
tcaataccctgtttctaaataaataaataaatagctaagtatgatggcatgtgccgtagtcccagctactcaggaggctgaggtgggaggatcgcctcagcccagaagattgaggctgcaatgagccaagattgtgccactgcactccagcctgggcaacagtgtaagactgtgtctaacaacaaccaaaaaaaatccttcttgtagggagatagcctaaaatatatatatatatattatattacactgtgtgcttacaacagttttctcggtgagggncacaggttaactctttgctactgnaagtatgggcctnttgggctttgttgttacttggt

SEQ ID NO: 557304 - DNA, 521 bp, Homo sapiens
ttcacaagtaaatgcaaatattaagttatctgtaagactgagctactgaatgtaattcagttactttggcaccataaaaggtgttgagggcaaaatttcctaaatggctatgatccaaacttttaaaacatcacataataatgtatttggagttgtttagattatttttagcaggaagttgcaagtccaagtttgtcctttcacttcaaggcaacatctttctagccacaaaattaatctcctctgtttgtgtacttgggcatgcacacacagggcagcaatctcaaaaagttcacagcaaatgcagaactgactgtgtacatgcacaggtgtgtgtttacacgtgcacatgagggtatggggtgggcgtgttttctaatggagtttgcaaacagattcggattaaccaaggctgaccatagttccatctggaaactatattttctaacatgagccacattctgaaaaacagattcagatgtctggaactggttcagaacagttgtaagaaacattcacta

SEQ ID NO: 557305 - DNA, 361 bp, Homo sapiens
  misc_feature (162)..(162): n is a, c, g, or t
  misc_feature (231)..(231): n is a, c, g, or t
gagacagagttttgctcgttgcccaggctggagtgcaatggcgtgatctcagctcaccacaacctccacctccggggttcaagccattctcctgcctccgactcccgagtagctgagattacaggcatgtgccaccacgcccagctaaggctttgtattttnagcagagatggggtttcaccatgttggcccggctggtctcaaactcctgacatcacatgatccccccgnctcagcctccccaagtgctgggattaccggtgtgagccactgccctgggctctccagtacatttttagggggacgatcaatgaggattctcttctctgagttactgcatgtgttacagtttataatcctt

SEQ ID NO: 557306 - DNA, 87 bp, Homo sapiens
cggcaccattgtgtggtggcaggcctgtggctgtggctgagggttctgcgtgtctgtccaccccacttaaagtgcagttccctccgg

SEQ ID NO: 557307 - DNA, 563 bp, Homo sapiens
  misc_feature (52)..(52): n is a, c, g, or t
  misc_feature (56)..(57): n is a, c, g, or t
  misc_feature (62)..(62): n is a, c, g, or t
  misc_feature (65)..(65): n is a, c, g, or t
  misc_feature (99)..(100): n is a, c, g, or t
  misc_feature (104)..(104): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (151)..(151): n is a, c, g, or t
  misc_feature (169)..(169): n is a, c, g, or t
  misc_feature (171)..(171): n is a, c, g, or t
  misc_feature (181)..(181): n is a, c, g, or t
  misc_feature (217)..(217): n is a, c, g, or t
  misc_feature (224)..(224): n is a, c, g, or t
  misc_feature (228)..(228): n is a, c, g, or t
  misc_feature (230)..(230): n is a, c, g, or t
  misc_feature (261)..(261): n is a, c, g, or t
  misc_feature (301)..(301): n is a, c, g, or t
  misc_feature (307)..(307): n is a, c, g, or t
  misc_feature (315)..(315): n is a, c, g, or t
  misc_feature (345)..(345): n is a, c, g, or t
  misc_feature (412)..(412): n is a, c, g, or t
  misc_feature (426)..(426): n is a, c, g, or t
gccgcgcggtgaggttgtcatagtacatctcggagccatgccgtccaagggnccgnntgcantcngtgcaggtcttcggacgcaagaagacagcgacanntgtngcgncantgnaaangcgncaatggtctcatcaaggtgaacgggcggnccctggagatgattgatncngcgcacgctnacagtacaagctgctggagccagttctgcttctcgngcaggancgantntgctggtgtagacatccgtgtccgtgtaaangggtggtggtcacgtggcccagatttatgctatccgtcantccatntccaaagncctggtggctattaccagaaatatgtggantgaggcttccaagaaggagatcaaagacatcctcatccagtatgaccggaccctgctggtagctgancctcgtcgctgcgnagtccaaaaagtttggaggccctggtgcccgcgctcgctaccagaaatcctaccgataagcccatcgtgactcaaaactcacttgtataataaacagtttttgagggattttaaagtttcaaacaaccaaaaaaaag

SEQ ID NO: 557308 - DNA, 136 bp, Homo sapiens
ggcacgagatttatttttaactagccaagtagttcttcaaatagttcttttaccaatttaccctctctccaacagacacatataagtagtgctcatccatgcactactaataatacatggcttattccaaaggttt

SEQ ID NO: 557309 - DNA, 382 bp, Homo sapiens
atagagtttcactctgttgcccatgctggagtgtagtggcgtgatctcagctcacggcaacctccacctcccaggttcaagcgattctcctgcctaagcctccggagtagctgggactacatgcgaacaccactacgcctggctaatttttgtatttttagtacagatggtattttgtcatgttggccaggctgctctggaactcctggcctcaagtgatctgccacctcagccgcccaaaatgctgggattacagatgaagagatacacttctaagtaatctatatgtcaagtaagacaaaatgaaattagaaaatatttttaagtcaatgatattaaaccatactacacatcaaaacttgtgggatgcacttaaagcagc

SEQ ID NO: 557310 - DNA, 308 bp, Homo sapiens
ccgtacggacgcactgttaatggcagaacgctctaccacacctgaccggcgcttgagctccaggcgccgcacgaactcctccagcaccaggccatacaggtcgtcctgcaagtaggcatcttcgatcccagcatccaggttggggttgtcgttgacctcgatcaccacaaccctgtcgcccgactgtttgaggtccacgccataaagcccatcgccgatcaggttggcggttttcaccgccagctccaccaccgccttgggtgcctcatggactgccagggtgcggcattcgccagcgtccgtagcgg

SEQ ID NO: 557311 - DNA, 171 bp, Homo sapiens
gtttcaatatttatttccagagtccggagcagcagacacgacctcttagtagggacttacttgggccgcgtcggggaggggcaggccggtatgggacacccaacactttttcccatttcttcaagaggaactcacgttttcacaactaattttaacaaacgccattaagag

SEQ ID NO: 557312 - DNA, 291 bp, Homo sapiens
gcgtcatgtcatctatatagtaaacaatgtaggttgcagccttctctgcatgtctgattatccccacaatagtcacctagacaagaagaaaaataagtttggttttcttagaaaccaaagcaacatgaatctatttttaaatgaagtaagttttatttcattcttcatatgattgagtgactcttccacaaattattttacatacctgtgaaatctcaacattcccaattttgaacacttcatcaaccagagtagcagaaagcagctgagatatggtacagggtacaatgt

SEQ ID NO: 557313 - DNA, 138 bp, Homo sapiens
ggtgactctagcaggatcttataaaggcgagccgggtagtaccccaagtagacagggtcttaacccccagttaaatctgtctcttcatacttctagatctagaaaggctaggaaacaactgtacccccctcccccaac

SEQ ID NO: 557314 - DNA, 839 bp, Homo sapiens
attgtgcttctgctggctgctagtggtgtgggacgctacaggtattcgtgggtctttgttactggtcgctcatgactatctggtccagttggtaccgtgccccttcgtggttacccccccagttggttgtacctcttatattgcgcgttgttgccgactgatgtcgcgggcgtggatgtcttggctaggaccgcccggaatcttggttgaaacgattacattgtacattgcgtgtcgagaaattcccgtgttctccctattttgctggcgcctcgtgttcacatattatgtcgcgcctggccatgcccgtgctgggaagcctcatcttggtgtagccgatatgtcgtcctttttgtcctgagggattattgttcctctcaataatgctgctttgttacgttgacatcgcagccgcgcgttatcccaatatgtcgcctatgccaaataattgtgtttccccctatggacaccgggggcgcaaccctttgtggtcaaataccacaaaaaaatggcgcgtgctagcggaagaaaacgctgaacctcactgcacgttgtaatgcttgtgtgcgcggagattttgctacgcaggccagggctctcgcaggcaaacagcgtgcgggagaccgacgtctgccctccgcgtcgtattttggcggcatgaccgccgcggtattgttggtgtcacagagagccgccgcagcactggtctacggtgttcgaccaaccgttgcttgcggcgacagccgggcagaaccccgcgcctgtgaatcgatatagcgtgggagtctttcagcccgtaccaatgggcccaccccctttccggggcccctccccaaata

SEQ ID NO: 557315 - DNA, 542 bp, Homo sapiens
tgggacatacctaattgaatgctgtgtgtcgctaaattcagtggcgatggggttgatatcctgagcgtaaacaatccgctttaccttgcactggccttactgatgacacgccgtactgtacctacatcagtgccaacgatccgaaaatttacagttccatccacatgtggttgaaaacgaatggacgctgccggaatattctgtttgggagggcctcaggttttacgcctcttgccaccaagaagtaggagaaagtcaggctattgactcgcatcgtaaaatatatacgcgtccgagaaaactaaaggagaaatatatatgggtgccgcattcaaagtacgccgatagcgttgaagaatgaaaagtcgacagccttatttattccctattccagccaggtcaccaaaattgttgtccaagctgttaaacggggactaacatcgcaaccattcggatgcaggttgcggtgcacgaaagcgcagacgtacaagaatataacctcgtggcacgatcagcttaattgggttatgagaaacatcgca

SEQ ID NO: 557316 - DNA, 483 bp, Homo sapiens
  misc_feature (22)..(22): n is a, c, g, or t
  misc_feature (32)..(32): n is a, c, g, or t
  misc_feature (49)..(49): n is a, c, g, or t
  misc_feature (86)..(86): n is a, c, g, or t
  misc_feature (121)..(121): n is a, c, g, or t
  misc_feature (128)..(128): n is a, c, g, or t
  misc_feature (142)..(142): n is a, c, g, or t
  misc_feature (204)..(204): n is a, c, g, or t
  misc_feature (216)..(216): n is a, c, g, or t
  misc_feature (221)..(221): n is a, c, g, or t
  misc_feature (261)..(261): n is a, c, g, or t
  misc_feature (413)..(413): n is a, c, g, or t
  misc_feature (438)..(438): n is a, c, g, or t
  misc_feature (465)..(465): n is a, c, g, or t
tttggcaggcccgtaaaaaaancccgcaaaanaaaagcaaattcccaancccggcaaaaaaacccctatctgcctaactgcagctntttagaggagttcccccccgaaggggccgaggaangggggancccctgggaaaaanacctcagtctgacccaacccatgcctgcagcataacccagtgtgcatactgtaaagaaacancgcattggaaanacaantgcccctagttaaaagagaaacaaaatggctctgagccanaggtttcaggcaaggatgaaggggccttgtttaatctagcagaagggttactggactgagggggaccggctcaggtgcccccaatgagcccatggtcaagatgacagtcaggagcaaggacattgagtttcctgtcaatacttatcctgaanattcaagtagtaaccaccccaagtnacccccttcctacctccaagaataaangaatctcaaccctgaaaa

SEQ ID NO: 557317 - DNA, 450 bp, Homo sapiens
  misc_feature (34)..(34): n is a, c, g, or t
  misc_feature (60)..(60): n is a, c, g, or t
aaccccataactcagctcccctgcacacagcagntgcctcagtaagtgtaccgaatcagnaacttatctttgtgaacatgagtgcccggcacacagtaggtgacccaatatgtgccttgaataaatggatagaagcatccttatttatctcaatattccccagagcctgggctgggcacagtggctcatgcctgtaaccctagcactttgggtggccaaggcgggcagatcacttgaggtcaggagttcgagaccagtctggccaacatggtgaaaccccgtctctactaaaaatacaaaaactagccagatgtgatggcacgcacctatagtcccagctacttgggaggccgagaaacaagaattgctggacgctgggaggcgcaggctgcagtgagccgtcacaccactgcactccagcctgggtgacagagacagactctactctta

SEQ ID NO: 557318 - DNA, 1818 bp, Homo sapiens
  misc_feature (455)..(455): n is a, c, g, or t
  misc_feature (769)..(769): n is a, c, g, or t
  misc_feature (1818)..(1818): n is a, c, g, or t
cactgcgtgtcttggaagagatgaccccgtaaatagccaatgagggatgtgagtacattcatgttcgatacactatagttctgatgcaactaaggcactactctagaattatctgtgtgtcaagctctcagccaacgtaacttagtaccagtacatagtaatcctccatatgattgctgagtcggtctattctgaacagagaagtaatccaattgaataagagagtcctgatgagatggacgtgctggctgtatgatgggcaaagaggctcacttcgaatgttcatcgccgtggtgttctttgagagtagagagctgtacaagacttgtacgtcggtagcaacagatgcgatactccactcgactatagaatactcttccattagtgtggaacaatttagaaggacacagtgcaagctaactaatagtcgagctcatcaattgggatcgctcccnctaggagaaacagcgaagaagatcttgattaatcaatacacaacacttgattatacatcgtggatcacatcttcatagtgcttgatcataagtagcttgctaacttggaatttagttatagctagcattgggttggtattctgtggacgcttttttgaggttggctagggataattctttcctatagtggcactttgtgtggctaaggaatctctcagaaagacggcattttgtccccctttcactagggcttttaagtaatcacccattagaggcgtttgattgagggatcacacccctagacttttgatccnggggtgttgagcctctaaaatattgtggactttcccaggcgatagaatagtctcatcccctaagcaagtttcgaaagaaaagggagggctttcattgggaaggttggcacaacattcggttgtctacacgcgagacaaccgtaccccagccgacctttttaaccacattttcaacggccaaacaatttgtgcgttaacgaaatggccgccgggaagcgaccacgcttcaagccattttctctgtggacccaacacttattctgtgggccgttcgcgacacatttgcgctggaacccactcttttgggctttggcgcaggccccagagttggctctaagcgaatgggcccctgaggggattcacaagcgggcgcgtggggcaacagatccaacaccgcggcgtaaagaggtatcggcacactaggggccccgtgtggtcaacccccccgctttggtctttgagagactcgctggcaacatgctgcatctcttgaaccaccaccaaaaatgttgtcccaagatggatcagacgaccgctgtgtctgtctaggtccccatcacactgatcggttgttacaccaacggcaatgctgtcgcgtgtcatgggggcatcatgatcatctagtgtgagcacccacgggagagttgacaacagagaacgagcctatcaaactaacagcgaggaggaggcgtctgcgtcatcgttgcatacagtctagcacacttcatattaccacgcgcggagacgcacagccgtgaagcagacgccaacctcatgctaacggaggaagctcatcctccggcgcagacggcgcgactcgcttcagaatcaacaatcactccgacgtcggcgctcctcctgtgcacgcgctgcacagcttctgatcacacgacatgagagcctcgtgcgcatctatagacaatcgttcaggcggcaggcagactagtcgatgcgactagcagtatggtgagtatagatagctgcagcctacgccatcaggctctagcgagtagctcatgagaataaacatgaaactgacatgtaggcan

SEQ ID NO: 557319 - DNA, 502 bp, Homo sapiens
gagaagagagagaactagtctcgagtttttttaatttctctttttcaggttgaggggaaatgctggcacaaactttgtcaaatggggtatggaaacttgtcatatacgtctaatgctgagggtgagtggtaggcagaacttttttccaataggacggtgtatagacgtgggccgatacccggaatcgggggtattcgctgtccgaattcatacaaaacccgggcgcgttacaaacttagggccttggtcgcacaaacctaatgtccgtgtaagcagttcacgggagagaattgcgactcacatatagtttaggtcccctccagagacacaacttttgctacttggctacaacggcgttgtttacatatatctaccctaccatgcactgcgggagatcttctccggccatacatcaaacacactacggcccagacagtgagtccatgacgcaacatttatccaatgagattaaacaccctaggacaccaatcaagggcacacc

SEQ ID NO: 557320 - DNA, 286 bp, Homo sapiens
  misc_feature (266)..(266): n is a, c, g, or t
gagacagggtcttactctaccacccaggcctgagtgcagtggtgcgatcacagctcattgcagccttgaccccccagactcaagccactcttccacctcagcctcccaagtagctggtaccacaggcacatgccgccaaacttggctaatttttgtattttttgtagagacagagttttgccaaattttcaggctggtctggaatttctggggctcaagtaatcctgccttggcctcccaacatgctgataccacaggacataagncacagtacccgggccagttt

SEQ ID NO: 557321 - DNA, 107 bp, Homo sapiens
catagaggataatatagcagtctaccagtatagcctaacataaccattcttaatttaactatttatattatcctaactactaccgcatacctacttgggtaactgtg

SEQ ID NO: 557322 - DNA, 113 bp, Homo sapiens
agtatactcagcgtcagtgaccagtgataacctaagtcgacatgacatgcgtgcgcctggatcaatgagatctctgcagttgaatctgacaaagatcgaacagttgtgctcag

SEQ ID NO: 557323 - DNA, 1287 bp, Homo sapiens
acgtctctaaggtcgcccgggtccaccgccgcaccgatgcctcggggaagccagcgagcggggctctcccggccagccagacgcccagtcgcgcctcgggcaactgaagatctaggagtcgccagagagttgcgccccagccgttagcccgatgtactttgaaactttatgactatgttctgatcaagtaaactttctggatacacggaagtagccctatggttctgctgtgaaaacaagatagtgggagttggagcctcccccgtgcgtttggtctgtcgttgggaacttgtacgcctactgttttagcacctcccggctacttattttatgtatctgcaagtatttactggtactgttcctattcgaacttcagatattgtttggatggaaagcatacttgtgattcctctcgtttgtattactatgccgattgtaagacccaagcagaacttcacggcggtagatttttggtgtcgctaactatggaatcggttgtccatggagtgatttctataaaggaggagctgtaatctctgctgatatctgattgggtggcccttgaccaaccataaaccgtttattctgataactctttttggtaatatggcgtttcatttaccagaaatcgcgtggctaaaaattttcccattcggactcgtgaacctttgtgtgtgggggaacgtgcgattaacccttgaacgcgggtttgtcccgaattgattgccgaaattcctttcaaattgaaaacccctgaaataagttgacatttacaatggaatttaataccttaatgttttactaatttccaaacttgggaatatttcttggttgaacattttaactgaattgaacgggtcttgtttaattcttcgaaattggacctgtgttgtttgagatgaaaaacttgtggtgtcaattttgataaataaggtaacctgaattttatttttactaaaaacattggggaatgttgaataatattattcggaccgaccattaatgtgattttgaatattgatacgtctatacaacgtgaaggacaaatggttgaaatcattcgctttgaaactattcgctcgaaaagtctttggatcggagtggtggcgaaaacttctggtttgtgcggcaaccttaatctttactggttggtgtgaaagacacgtgtttttattttatattctctctcttatacacatgtgtttttttagttggaacgattttttttttggtggtgtattgtttggttgataatgagtgtggcggtgcaatagtgttgtgtggtgg

SEQ ID NO: 557324 - DNA, 313 bp, Homo sapiens
ttccctttacccgccctcaaacccaggggccctttaaacagttttcggggggtaaagtccacgtgacagtccccccaccccccccaaaaaactgggggcctgggggcaaatgttgggcccttttcccaactgggggtttccctaaaagcaagggatttctctctttgggccctcgtgatccatgttgaacaaaacatgtaggttttttttccccccaatgtaaaacccttatattctgtccgttggaaagcctttcccttttttaaaaccctgaatgttcccccccccccaataaacatatttttttttttta

SEQ ID NO: 557325 - DNA, 212 bp, Homo sapiens
atagtccaaatggaatggacggcaatcccggcaatgccagaagatgaagttaaatccgaacagcaggtatttgatgcacttgtgtgcctcctttgacctggcatggtgatgggctaactatagccgtgggcctgaacgttgtgctgggacgtgggtgggctgcgctgctggcatggtgacgttgcagcaccagtgctgtagtggtgatccga

SEQ ID NO: 557326 - DNA, 155 bp, Homo sapiens
  misc_feature (154)..(154): n is a, c, g, or t
ggtaatggggtttcccccccccccccctcccgggcaggggtggagctggacaaaaaccagtgcctttaagtcatttgggtcaaaaccctttggggtccggaagcgtggggggggggtcctcctggccaaaaaaccactacccgggttttccccna

SEQ ID NO: 557327 - DNA, 318 bp, Homo sapiens
ataaatgcggaaagactgttcttttccttccggattaagttcttcaccaccttttgtagatttgggcatagctgccaaagctatgcacccagctggccttagaaaaccacaatgtttacagccctgtcttagggccgctgattctcttatcttccaccaccttacttgcttgctgcgttatcttctcacagggctggaatgcaaatttcagaggcttcttttgaagattccccaagtcaagcaggcaagatgcctagatcttctgttatctttgacatgtaacatcctttttagaggctcagaacacctccttggctg

SEQ ID NO: 557328 - DNA, 159 bp, Homo sapiens
gaggagctgcagaatctcataatggggtcaaccaagccagcaaggaggcaaccagctgctgaatggcaaccatcaaagcggatcttccagccatcaaggaggggcacaaccacgccgttagcctctggggcctcggtcaacacgcctttcatcaacctt

SEQ ID NO: 557329 - DNA, 204 bp, Homo sapiens
ctagggcaggatacggcccataatgctggacgaggtcagtgcacgggaaccgaggcctacactggccgactgcaagtacctgggctggctagaagagcaactgcaggcacgagcagagacgctggtgtggctctgcaccaatgaaaccaggagcacccacaccctggacctctaccaggcagctctcggaggccctaggccaga

SEQ ID NO: 557330 - DNA, 302 bp, Homo sapiens
ttctagaaccatatccggtttggcagcgcgggcccagtatgctagagttcaacaatgctcactagctcgtttcctcagagaggatcctgggtcatgactagatgcgttggattctcactcaatttaacaaatgcctcgtgagcgcgataacctgtagcgctactcgaatctacaatcacacgtactggtagtctctcgagcgtacaatttacctgcgactctagtctaaactacgcgtaggttccacaagctggagctgcgtagtactcaagaagttaactccctcggttgcttgtataccg

SEQ ID NO: 557331 - DNA, 660 bp, Homo sapiens
  misc_feature (110)..(110): n is a, c, g, or t
  misc_feature (142)..(142): n is a, c, g, or t
  misc_feature (199)..(199): n is a, c, g, or t
taagaaaaataggctaagtaagcccgggtgatcggccgaggcctcccacctggtgtaagcagcctttcgctcatactctaccacctatgaagagaggaatatcaccgganccaggtgaaggtgcccgtggggcaggaggtgnaggggatgaacatcctgggcttggtagtgttgccatcgtctttggtgtggcgctgcngagaagctaggggcctagaaggggagctagctatatccgcttcttcaactcctttcaatgaggccaccatggattctggtctcctggatcatgtggtacgccccgtgtgggcatcatgttccttggtggctggcaatcgagtccgtgagagactgagaggactcgtgggctttacctcttgtgtcccgcacgttgagccaatgtacactctcatgatgcatgccttgccttgggtcacagtcgcagtccagtgtgagctccctggatactgacaccgctcactcatacgtatccatctttccacccgacaagaaaacccccccatacgcggcgttcccatggtggggagacaattcggatgaactggcccggacttgggttccaacatatgaccataattgggagaaccgtccatttcacaggtttcccggactaacgatcttgacccgaacatgactgat

SEQ ID NO: 557332 - DNA, 804 bp, Homo sapiens
  misc_feature (569)..(569): n is a, c, g, or t
ccctgcaccaacatggtgaaaccctgtctctattaaaaatacaacattagccaggcgtggtgacacatgcctgtagtcccagctacttgggaggctgagtgagtagaatgcttgaacccgggaggcggaggttgcagtgagccgagatcacactcatgcaccccgagcctgggcaacaagagcagaaaactccagtcgtaagaaaagacagaccagaataagcagaggtgaggcaaactgagagtcgtgaagcgcttaatgtttcgtccccttattaatgcggggactttagcgagtacgtggtcaggcatactctgtattaccggacaagattcaaggagcagactatgggatagcagcgttggcttgagggctgtttaccctttagaagccaactgagcacaaaatacgcaggggcgagttctcgagggacgggtccgcttagaggggtttactgctattaacccagttgttcacaggtccttaagatgtccctaggggagaaagcaatttaagaaagccaagggcatcaagtaagaaagatagtgcttgcacattccacaagaggngtcccaagcacgacgtgggtacttcgcggaggcccggggaaggagaaacacataatcgggggagcattccgaagtggcgtaggcagagccaagaagttcacccaggtttaggaacaaagtccccaggggttcagaaaacgcgaccttcccaaaattccggggaattccagggcgttaaggccaacgtgatcgtcggcccctcttaaagccatttggtttgattgtttaagtccct

SEQ ID NO: 557333 - DNA, 198 bp, Homo sapiens
ccaccagaggcaacagagtgaaccaaaaattttgctgggcatagtggcgcatgcctgtggtcccagctactcgggaggctgaggcatgagaatcatttgaacgcaagaggcagaggttgcactgagccgatatcctgccactgaaccccaccctaggcaacagagtgaaacaaaaaatttggctgggcatagtggcgc

SEQ ID NO: 557334 - DNA, 177 bp, Homo sapiens
agcagcatagatattaccgcaaggggaaagatgaaaattataccaagcataatatagcaaggactaacccctataccttctgcataatgaattaactagaaataactttgcaaggagagccaaagctaagacccccgtaaacctgaggatgtacgtaagaacagctataagagtcac

SEQ ID NO: 557335 - DNA, 820 bp, Homo sapiens
gcagttcagtggcattaaatacattcacgttactgtgcaattatcaccaccatctgtttgcagaaatttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcattcatgttgtagcatatgtcaacatgactttccttttaaggttgaataatattccattgtatgtatatgtcacaattttgtttctccatttatccatcacttgacatttgggttgcttttacctatcggctgtcttgaatcatgtgctatagctgtacaagtatctatttgagttcctgctatcaattctttaagtatatgcccagaagtggaattgctggatcatatggtaattccgtgtctggttttcttcgaggaagtgccatgtggtttttccacaacagtctgtaccatgtgtaatattccccccagaaatgtaccgagggctctgatttccttcacatcttgctaaccacttaggtatttttttgtgataagaattagccatccttatggtgcacttttacaagtactgttaaccttcatttcatcactttcacacttcttggcaacgaggaccactaataggtggccccagggggtcatagacaccgggtcaaacagagctctgtgttacctcccaaatttcgtttatgggtggcaccag

SEQ ID NO: 557336 - DNA, 339 bp, Homo sapiens
  misc_feature (9)..(9): n is a, c, g, or t
  misc_feature (208)..(208): n is a, c, g, or t
  misc_feature (281)..(281): n is a, c, g, or t
agacgggtngatcacctgaggtcaggctttcaagaccagcctggccaacatggtgaaaccctgtctctactaaaaatacaaaaattaccttgacgtggcatcctgtctgtaatcccagctacttgggaggctgaagcagaatcgcttgaacctgggaggcagaggttgcagtgagccgagatcacgccacggcactccagcctgggtnccagagcgagacatcatctcaaacaaacaaacaaacaaaaaagttgtcacagtataaataccaatcttaggangattctgacaattattttggaaaatgataggggaaatatcttgggtttgctcttcttt

SEQ ID NO: 557337 - DNA, 215 bp, Homo sapiens
gaaactggtgaatatcctctttgggcctacccgctcgatgtggcgggccgccgggccgttgggatcacgcagcagcgcactgatgatgttggtgtccagcagataaccgctcacaggacgtcctccggcttgagcggcgcgtcggcgatgtccggaaattggtcttccggcccaagcggttcgtcttgtcgccattggaccaacaattccacggt

SEQ ID NO: 557338 - DNA, 380 bp, Homo sapiens
atgagataaagtgtgcaaatcacttagcagtgcctggcatatgaaaggtccacagctaaacgcagttattgtcatttttacggctgttggtgtttaccagttcataggctgagcattgtttatcatttactttctgtaagaattttatcattgcacaaaaaacatgactaccatcaagatacaagcctggtttttgaagaaaaggaattactgtaggggttggaaagggtcagtgtgcccagatgaaaaactgtcctcctttagaagaggctaacacggtctgaagcagctacagaacagcgtacgttatctgtcaatccaaaccagcatgatgaaaattattcacccccattaattaaaaaatctcacataaaaaaaaa

SEQ ID NO: 557339 - DNA, 914 bp, Homo sapiens
  misc_feature (73)..(75): n is a, c, g, or t
  misc_feature (293)..(293): n is a, c, g, or t
  misc_feature (357)..(357): n is a, c, g, or t
  misc_feature (412)..(412): n is a, c, g, or t
  misc_feature (445)..(445): n is a, c, g, or t
  misc_feature (451)..(451): n is a, c, g, or t
  misc_feature (525)..(525): n is a, c, g, or t
catgaaaacttgtctaatttcttactctattgtacgtttacagtcgcagcactaaaaatggatgacatcaaannnttttaacaaatgatgtacaaactaaggactatttatgataatgtttgctactcttgtcagacaatggctataaactgaattaggcagtcttaaaaaaaaaaaaaaacgggaaaagaaaaaaaagaacgtggcaaatttggtgtaaaatggcgcaaaaagggacagtttaattttggtgacagattatggcttacctcaggtttctttagtggtggctngaatggcccttctttccatataacacttatcttcttcttaattcgggcaatgggaatatctttnaagttttaaaaaacactgggaataattatatctatctttttggcgcgttatattnaggggttttggtggataaaatcaagtttgggtnggtggnctggctggaattaaatatttatgagtgggggcattttcaggtatagtggaacaagacaccatattaagtacagnggataaagcatctatattctgtaaaaaaaacaaaaatttggcctatgcttgtttttaaacgaaaaaaaatggggtgtatcgggcttgtttgggacctgggtaaggggctaggggtcggaccatatagtgggaagttggttgtattcgggggggaacttattattcttcaaaagggtaaaggccttgacagttgtggtagtccaaaacaatggttttgaaaacttctaagggttggcctttgtttacacaggacttgtggttcccacggcttagtatattttataatccagcgagattaggtaccaaattatcggtggttggaccttggccccttaagggcctgggtcaataaaaggatgcgggaataaaaaagaattggcgaggagtac

SEQ ID NO: 557340 - DNA, 370 bp, Homo sapiens
gcgcttagagtgaggcagcgggcagggctattgggaggccggcgcgggcggcgcgttctggtggcgcgaggtactggctgggcgggacgccagtggtctctctctgtagcctttcctggtagtcaatttgttgtcccgaggattcatctttttcttccgcatgctattctgttttttttgctgtatacattggtcttgcctgagctcttccccaaagcttggaggaacgggggaggccgggaatgtcctgtctgcagacctgggactctgccatgtgcttttgctgtggaatggagacgcgaccctggatagtggtctatgactctcgagggacaggccacgcgtgtgggagaacatctccttccggggc

SEQ ID NO: 557341 - DNA, 128 bp, Homo sapiens
gtgcccagccgggaaccacaggtttttggatggtctctgaatgtcatgtaactcttttatttttatcaaaaaaaatttttttgacacaatatcttgctgtgttgcccagaacggggagtgcacgtggc

SEQ ID NO: 557342 - DNA, 847 bp, Homo sapiens
  misc_feature (6)..(6): n is a, c, g, or t
  misc_feature (93)..(93): n is a, c, g, or t
  misc_feature (131)..(131): n is a, c, g, or t
  misc_feature (139)..(139): n is a, c, g, or t
  misc_feature (143)..(143): n is a, c, g, or t
  misc_feature (153)..(153): n is a, c, g, or t
  misc_feature (184)..(184): n is a, c, g, or t
  misc_feature (188)..(189): n is a, c, g, or t
  misc_feature (195)..(195): n is a, c, g, or t
  misc_feature (213)..(213): n is a, c, g, or t
  misc_feature (244)..(244): n is a, c, g, or t
  misc_feature (250)..(250): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (278)..(280): n is a, c, g, or t
  misc_feature (282)..(283): n is a, c, g, or t
  misc_feature (289)..(289): n is a, c, g, or t
  misc_feature (299)..(299): n is a, c, g, or t
  misc_feature (304)..(305): n is a, c, g, or t
  misc_feature (309)..(309): n is a, c, g, or t
  misc_feature (313)..(313): n is a, c, g, or t
  misc_feature (318)..(318): n is a, c, g, or t
  misc_feature (321)..(321): n is a, c, g, or t
  misc_feature (326)..(326): n is a, c, g, or t
  misc_feature (329)..(329): n is a, c, g, or t
  misc_feature (344)..(345): n is a, c, g, or t
  misc_feature (347)..(347): n is a, c, g, or t
  misc_feature (358)..(358): n is a, c, g, or t
  misc_feature (363)..(363): n is a, c, g, or t
  misc_feature (368)..(368): n is a, c, g, or t
  misc_feature (372)..(373): n is a, c, g, or t
  misc_feature (380)..(380): n is a, c, g, or t
  misc_feature (435)..(435): n is a, c, g, or t
  misc_feature (488)..(488): n is a, c, g, or t
  misc_feature (602)..(602): n is a, c, g, or t
  misc_feature (631)..(631): n is a, c, g, or t
  misc_feature (808)..(808): n is a, c, g, or t
aaatanaaaaccatggtgagttattaaaacccattttctaataataacaaataactaaaaattcccaaagtggaatatcatccaatgtgaganaacatcatagcacggtccatatgtacacggcacacagngctctgcntgcnctcatctgtnaattgctcattacatgtcactgataaaaaanatcnnccaggnaacttctactcttcagtnctcctcttcctgaagcattgtcacatatttnaaaggnactttagggatatgaaganaanggnttnnngnnggtttnggcgaagggntctgnntgtnttgntttgnttnattangcnttacatcttgagaannantttttttactnatttncagcnaagnnagcaganaactctaggtttttgccaatttattttttcctagtcactcattggaacacaagtncaacaacaacagctcaggaaccaaatcatgtttttatattggtaagttcattntaaaatgccactcaattttaagaagccactaaaaggacactttctgcagcaaaaaaagggctaagttcaagtttttgttgtttgacaaagacacaataatataacccatatgtnacagatcacaacagccttaagtgaaacgnattagatttagggaaaaacgactatgcgactgcttgtttctcctgtctccttgccaaacaataaggagagcctctggtctgttttatctattttatgtctttttgttttgaaacctccctttgtattctgaaagctgatcaaactatttgtgttcaaaatgtgtcaaggcacttctnaagcctcagtggcatcccaggtcagccaagctcctctgt

SEQ ID NO: 557343 - DNA, 394 bp, Homo sapiens
  misc_feature (16)..(16): n is a, c, g, or t
  misc_feature (29)..(29): n is a, c, g, or t
  misc_feature (138)..(138): n is a, c, g, or t
  misc_feature (151)..(151): n is a, c, g, or t
  misc_feature (174)..(174): n is a, c, g, or t
  misc_feature (176)..(176): n is a, c, g, or t
  misc_feature (198)..(198): n is a, c, g, or t
  misc_feature (206)..(206): n is a, c, g, or t
  misc_feature (246)..(246): n is a, c, g, or t
  misc_feature (290)..(290): n is a, c, g, or t
  misc_feature (293)..(293): n is a, c, g, or t
  misc_feature (303)..(303): n is a, c, g, or t
  misc_feature (305)..(305): n is a, c, g, or t
  misc_feature (330)..(330): n is a, c, g, or t
  misc_feature (333)..(333): n is a, c, g, or t
  misc_feature (338)..(338): n is a, c, g, or t
  misc_feature (343)..(343): n is a, c, g, or t
  misc_feature (359)..(359): n is a, c, g, or t
  misc_feature (374)..(374): n is a, c, g, or t
  misc_feature (379)..(380): n is a, c, g, or t
  misc_feature (389)..(389): n is a, c, g, or t
cagatacggaagaccncttatgctcagcnccaacaggtcccccaaatccggaagaagatgatggaaatcatgacccgagaggtgcagacaaatgacttgaaagaagtggtcaataaattgattccagacagcattggnaagggcatagaangggcttgccaatctatttatccncnccatgatgtctccgttagaaangtaaaagngctgaagaagcccaagtttgaattgggaaagctcatggancttcatggtgaaggcagtagttctggaaaagccactggggacgnggnaggtgctaangntgaacgagctgatggatatgaaccnccngtccnagaanctgtttaaagttcagncttcaaatagtggcnaattnnaggtgctanttgtg

SEQ ID NO: 557344 - DNA, 257 bp, Homo sapiens
tactaacatgatcatatccaccagcccccaacctttttggccctcaagggctggtttcgtggaagacaatttttccatgggcatggttgggggtagtttcatcaggcattagattctcataaggagcataaaacctagatccctggcatgcgcagttcacaatacacttgactcttctatgatactagtgccaccactgatctgacagaaggcagagctcaagcagtaatgctgtcttgcccgccactcacctcctg

SEQ ID NO: 557345 - DNA, 225 bp, Homo sapiens
gttgacatgatcagcccggaggaagaggagcgcgccgagtaaggccgagcggaacaagctgctgcggcaagtgtaggaactggaggaaggaactgactgacttcctgcaggcggagactgataaactggaagatgagaaatcagggctgcagcgagagatcgaggagctgcagaagcagaaggagcgcctggagctggtgctggaagcccacttgacaacggcct

SEQ ID NO: 557346 - DNA, 438 bp, Homo sapiens
  misc_feature (257)..(257): n is a, c, g, or t
atccccggtaagacgcggtctttactaccaccatctgcataaactgcacccagaaccttggaaataaccccccaccccccagtctccacgtcctctcctcacgaataaatgtttgtttgtacagagttggggtcatgctgatataaagtttgtggggttttttttggttggtttgtttgttttggtctttttagggccgcacccgcggcatatggaggttcccaggctaggggtccaatcagagctgtagccactgntcgtacaccacagccacagcaacacaggatccgagccgcgtctgtgacctacaccacaggtcatggcaacgctggatccttaacccactgaccgaggccagggatcaaatctgcatcctcatggatcctagtcacgttcattaacctctgagccccaacaggaactcagaccgctcttacg

SEQ ID NO: 557347 - DNA, 682 bp, Homo sapiens
gcgtatgtatgaggtcgtactcggtttattagtacgtggcatgtgtgaaactgatacatgagatgacgctggctgtagactctggatgtctcccagtctgctaaagccctaagtgccatcaccatgtgacttccagcatcgccccggtgtggcaagacctggtgagcggtgggctgtggcctcctcctccagagagcaacctgtgacctgcatgtggagctgcctccgtgcagctggccctggagaccatctgacatcaacaaggacccgtacttcatgaagaaccacctgggctcctatgaatgcaaactctgcctgacacttcacaacaatgagggtgagctacctggcacatacgcagggtgaagaagcaccagaccaacctgtgccctgtgctgatgtcatgcctaatgtgatgtgccaatggatgtgccccttgcccatgccctgctagcctgatgaatgtgtcaatggtgtgagtgtgaagaagtttgtgaatgatctggccgcccgggctacaaagtgaccaagcagagagactcggagatgggccagcagagcctcctcttccagatttgactaccctgagatcgccgagggcatcatgccacgtcaccgcttcatgtctgcgtacgagcagaggatcgagcctccggaccggcgctggcagtacctgctcatg

SEQ ID NO: 557348 - DNA, 490 bp, Homo sapiens
tttacaatttgagaagtatcagaaaatcataaggctgactctagatattacccaagtggtcagagaactgctttctagagccaatatgcaggaactgacgtgataaattatatcttcttttctatttaggcttgcggaggggaccacgaattgttcacaatttcaagtccatttgttttccttattagtaaaaaagccctctaatttttaactagggatgtgaatttccactagtgactacattctaggattctgctactgtctgaatgttttagtctctccaaaattcatttgttgaaaccatccccgatctgaggataattaggaggtgcggcctttggaaggtgatttggtctcatgatggtagaatcctcatgaatgggattcgttctcttataaaagaggtcccagaaagctgccttgtctctttctaacatgtgagggcccaacaaggagatgccttctatgagccaggaaataagccctcaat

SEQ ID NO: 557349 - DNA, 187 bp, Homo sapiens
  misc_feature (19)..(19): n is a, c, g, or t
  misc_feature (174)..(174): n is a, c, g, or t
cccattttgaacaaggttnccattgactcaagtttaaacccaaaaagtgtgactgaaccatttttacagagtctagcccaccaatgctgatgtgaccggttgtgtatgcgagtgccagaaaatgtgtattctggccggcctgaagctttactggcccaaggatgtgtgagagtncagagatatattt

SEQ ID NO: 557350 - DNA, 134 bp, Homo sapiens
ggtccggataagctaagtatacgtttaaagtaagtctcatgttatctgcccctctgcccacctccaatttgatatatagttgggtcagcttgtcctcccctcccctatctccccaatttctgtgcccatttcaa

SEQ ID NO: 557351 - DNA, 754 bp, Homo sapiens
cactagatcagaccttctgacgcacagacagtaatttgttcttatttgtatacatacaacaatgtggcgagttccttccatttcttgtcgacacacgatagatctctacaaactctatcgacacgatgtaggaaactacataacgcttcattggtggtgtgtcgatttcacgatgtgctaatcaacattattaattttctttccttcaacgggattctaaaaatagaaggttgtgcttgatagcagctgttttttctacattagaagtgggatacctcgcaaggaactacattccagatttaaagaaaagcttggataccattagtgcgaataacagcacattgatcatacttgtactgcatgctatgtcattgagagtataaggacacaccctttacaagacagtgaatggcaagcactatcttatagcttatgatatgctctgagacaatatcgaaggtaacgatcgcacttaggatgctacttgatgtgagcaatatctacacctgttgtagacttcatacggttcatagtttacagagaagttattgatgagtgtggaaactcatactactgttatacgaaattgacagccttcacatatagaaccaagcaacaccatgctcatggctgttgatggaagcggccagtcttgtaccatgggaggagttccaccagcctgcctttgatggagactcctttagaccctgaggaagcgtatcactcttttattgtctactcttgcacatctccg

SEQ ID NO: 557352 - DNA, 250 bp, Homo sapiens
tcaccgcggggatgggatagcgcaaactgccctgcaagggaaacctctattgtacatacctgaaccacaaggatggcatatcttgttcatggaatggtgaattaagtgtgacaggaatgttttgtagacacagtacttagcttgtttggaattttgcctgctaatcctattggcggattcatgattatctagatgtgcatcatccatcactgtccttttcacttagttcgcagtacgtatagtgaaccca

SEQ ID NO: 557353 - DNA, 1277 bp, Homo sapiens
atttttgaaccagcttgtttggccctggtcattcacgggcagcattatgtgaccatcactaaaagctaagtggtatatctgtgtagtttccgtctggaactgctttcccattcccgggaacccatagccgggacagccagggatcccagaacacagagcccaaagttatattaaaccccgactcataaccgtccagcaggcatctctatttaatactgcagcttagttcctgctgggctaaggcattccagaggtaaccagggccctctgggcacaccccatcaaaagccagctacttcgaggcgtgacgtactcctatgtaaactactagtgagtcgaacgtcttgatatattccactctatcttatgatgatactcactgtgtgatcccaacacacctagcaatctcatggactgctaatgtgcccatgcaccagattcctggacatgccaagagcccatgggcatcagcgtgccacaaacatgaacctcatcttcaatacacctacccataaggggaaaccccctctcggcacacgcggacagacggatcgcgcgtgcctgaacgcggacagagatgaccaccaaaaagccaagacaacactctcggaatgctgattaccagaccagaagagaatgaactggccagcaatgcttaccaggcacaacccaggcacggcgcacaaccaaattagcactcaaacaaccccactgcactgctcaaccagcactcacccttgacaacgtcagcctacgtagccccctttcaacacaatcatccccatgcccctgagaacggcaacttggataccaaacatgccccaaattccaaacggaatcaacctatcgacagagacaacaacaagtgaaactatcgaaacaatgaacttcctcgccaatctaggaagtgattaatctaggactttgtgaaatgtcttcacaacacatggagaatcactatagaagaattgataacatatatgcgcccatgtatatacaccactcacaaaacattcaacatcaattacaaacacacaaagtctctccatcagatcacacatatcaaaacataacaaacaacacagacatctaatcaacaaatctaaccatatcaccaacatacacccacacacacaaacaacatccaacctcacaaatccaataaacaaaaaaccatcacaaccacccccccagctccacctaccaaatactacaccaaacttaatcaacaccccttacccatttaattctccttaaaccacctaccactcaaacca

SEQ ID NO: 557354 - DNA, 164 bp, Homo sapiens
gatatggcacctccgtcagtctttgccgaggttccgcaggcccagcctgtccctggccttcaaggttaattgcgacttcagggaggatccggaccccgaaggcaaccttgggagtgggagcaatcgaacggatgatgccatccctggggttttgccagtagtga

SEQ ID NO: 557355 - DNA, 345 bp, Homo sapiens
tgccatcttcctgaccttgtaaaattgagagaataacgccacggcagtactgcgctgacgccctgtcattcgtaggcacgtttgcggatggctgatggtgtggcagattcacaagtgtcagtgagattcgaagaccatgtctgcgtcgatcatgcgtgaaactcttggtctctatctaataaaatacagaaattatgcctgggtcattggatggcagccatgccctgctaatccccaggtatactcagtgatcgctgcaggcctggagcacatcgccttgatagcctgcggaatggtggagcattcgcgcgctgtacgacttgacgtatttgctgccactttcgt

SEQ ID NO: 557356 - DNA, 466 bp, Homo sapiens
ccagctggctggcttcctggacttcacatatcaagagttccggatccagctttttgtcttcgaagacaagatgaataacctcgtgtggaccagcggtactctcagccctggatggttgaatttcagtcagcctcagaggttgccttctacattgatcaggacatgatccagatcgcggacaccaaggtcgctaggtgtaatggcgatgtcgttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcggccatcagcctgtcaactcagttaacaagttaaggaccgaagtgtttcaagtggatctcagtaaaggatctttggagctaaaaaaaaaaggtccgggaggg

SEQ ID NO: 557357 - DNA, 277 bp, Homo sapiens
cccaggcagacctactcatgacagtgacatcactatctgcaaagtgtcaacacatggaaaatgctgaatatgtcttgattaaagtcaagcagcacagatttctccctgtctccgctaaaaaatacggaaattagctgggcatggtggtacgtgcctgtagtcttagctactcgggaggccgaggcatgagaatcgtttgaacccaggaggcggaggtcgcggtgggccaagattgccccactgcactccagcctgggtgacagacaagactccattt

SEQ ID NO: 557358 - DNA, 107 bp, Homo sapiens
ctggagcctggttactctccacttactttctctctctctctctttctttcttttccgcggagtctctctctgtcgcccaggctggagtgccgtggtgtgctcttggt

SEQ ID NO: 557359 - DNA, 531 bp, Homo sapiens
ttatcaatctttatctgtcacgcgtgaaatgtgtgattttatattggattgcgtgacttctcgaccttgtcccatatccgagtttgcaggggaatcatttcaaacacttttcctgatactaagccgttcacataatagttatattgtcttgttattaacttgtcctcatgtccgtcattgctttctcctgaggatggttttgctgcaatttttgatggaatgttgaagtcagggcatacacctagacgaagtcagacaaagtatgtcttatgtatacagattcaatttaaacaaatgcattattgggcccaccctggccgtctttattcaccctgcttgttgatgtacctatctgtgcttcataacatgtttggatgttcctatccattaccaacaaatgtatgcactgaaaatatcattttgatccagttatatgtagggtgactattttaataactgtaaagcattacttattaaactgcattagttcttttaatcttaattattattatttggtagtgtaaagaagta

SEQ ID NO: 557360 - DNA, 339 bp, Homo sapiens
agtcccttcaggccaacgtgcagcgggttaagggggcccgctccaaatttttcctttttcccaggaagccctcggccccccaaaagggggacagttttttttaaaaatttaaactggcccccccgctggccgggccggttttgcccgtccgggacgttttttaaaaggggaaagcccgggtcttcccttaggaagagaagaattttaaagcctttgcttgtttccgtttgggccgggcccccgcccggttttttggcattcgggcaaaaaaagcccagggagcccccgacccgggtttttaaaaaaaaaaattaagccctcctgggggcttgggttcca

SEQ ID NO: 557361 - DNA, 513 bp, Homo sapiens
tcccctccaatcttgtcagtttttctggtcaaaaacctgaacttgactctctcacacctgcatcatgagccacctttgccctagcttcagagtataaccagaatctcagcccttctctccacctccactgctaccatgtttgtccaagccaccatcacctgtcacctgtcacctggggtactgtggtaaccacccgcagaactccctgtgtctctaaccttgcctctctgcagccatttctcagtaccacagcagaatgctccttcaaaattttgggtcaggccatggtactccaatgtccaaaccctaccttggctctccatttcacttgagtaaaagtcgcatctttctattggccttgaaggccctgtgtggtctggcccctccgttcctctctgactctgtcatcttcaccctcctaccttccaccctctgtgccagcctcactggcttgctcatgttccttgagcacgctatacactgttccctgctgtttcttagccagctccctct

SEQ ID NO: 557362 - DNA, 120 bp, Homo sapiens
gttggcatgagtgtgaagttacaagcctgagaaagagaagggtaagaattggattgcatcttctgtgtgtgagacgtgtggactgtgccaacctctgagtgtgcttagcaccttgtattg

SEQ ID NO: 557363 - DNA, 484 bp, Homo sapiens
accatatctcaattctccattttgtggtatgttgtagggaccctccccttcctttccctttcctttttccaggtggttggctcttacatagtcaagtctgataattcttaaattctattctgtaaccagttaggattttatgttcggttattgattgattccgctgcttaactcactgtgtttatatttccttttgggatcagctttttgtttttacggaagttcctagttgcctttttttttaccttgtactggtcgctttccacacactcacagtgattctcaaatcctccatttaatctactctgctgaatccactcctttcctctctgtatatcctgctttcagcctcccgctctagcctgtttttgatgacctttctgcctatatcctgttgttacactgggactcacctggttctgaatcctgggctttccttttcttaattcactcaatcatttaattttagtcctgtcctcttccc

SEQ ID NO: 557364 - DNA, 532 bp, Homo sapiens
ggccaagctgagtggtccatatctcctgtgcgaactttacccaggtaagcgtgtacaaatatggatatagtaacacctgcatcatgagccacctttgccctagcttcagagtataaccagaatctcagcccttctctccacctccactgctaccatgtttgtccaagccaccatcacctgtcacctgtcacctggggtactgtggtaaccacccgcagaactccctgtgtctctaaccttgcctctctgcagccatttctcagtaccacagcagaatgctccttcaaaattttgggtcaggccatggtactccaatgtccaaaccctaccttggctctccatttcacttgagtaaaagtcgcatctttctattggccttgaaggccctgtgtggtctggcccctccgttcctctctgactctgtcatcttcaccctcctaccttccaccctctgtgccagcctcactggcttgctcatgttccttgagcacgctatacactgttccctgctgtttcttagccagctccctct

SEQ ID NO: 557365 - DNA, 147 bp, Homo sapiens
ccaatctgcttgacacactccggtgacagactgcggcacgagtgatggtgatggcccactgcggtggagttgggcagcagatttcctggtcatgctgaagtctccagtctccgcaaggagagtcatgaccattccgtaccagcccat

SEQ ID NO: 557366 - DNA, 870 bp, Homo sapiens
agcgggtttgggcgtgcggtctttgtctctcgtctggcgctggcacaggaacttgtggatccgtctcctcttctcgcctcctccactttgaggagcccctgggttactactgttcagcagctccctgttgccctgatgatctgtaggtccttggggacgcacaggtttcagatgacaggacataccatggaatgcatgcggaaagtggcatcatatgctggagtaatacggattcatcgaagacccatggctgtgccctacatatgtttcctcctcctgacatcagttcactcagtcaactcaatgccatgtagagcagtgggacggctcttgtgattcccttaattcattcgttgggggcacgtcttaactccaaagtaatcgcaaacaggccacggcacgtgtccttgttgcaaagcgatgcaactcgcagcagcacccgtggctccactcatactttattgacgcagtgcgtaaagcgaagcaggtgtgagacgtgtttgcaaggagtcgacgcgcaagtgcaggcgagggcagttcacaagaccgtgcgaccttgcatcaccatttttgttctgatcgtcgaagcacgaattctcggagggactacgttgttggcgagcgtgtactggacagcgtgaaccttgagacaatgagtgtgggcctttcgatgtgacatcacgtttgacgaatctattcctgggcgaggcatggaattcagatgctccagaactctggggctggtgtctttgagcgtcagtacgttgccgtactttgtatccaagtccatttgttcactaaccgttgggaagcgtgccagattctaaatggcttccgagatcatctactctgattcgcgtcgggagactg

SEQ ID NO: 557367 - DNA, 151 bp, Homo sapiens
ggcacggcacgtgagaggtggagtggctcgggtgcagctggacttgcatgcccactcccaactgggaaagggctggccaccaggaaaacacaagacctggaaagtggaacagaacagaggtggagtggcttgtcccacggactccctgctg

SEQ ID NO: 557368 - DNA, 890 bp, Homo sapiens
atactgacgccaaaatacgtgctgaaaatggaacatgtgtccacgtccctcgtgtggtcctaggtggctgcagcgctccggcactattgcctggcgaagcagaagcctgactgtctgctggccatgatggctctgtcttccttcctgcagatggtgaccatccatctgtccttgggctgggttgttgtacgtggcctggcctgacgttgtgaatgtgtcatgcaaacgagattgtctcaatcaatggcccacgactcgaaagttgatccgttgaagtgacctgaagatattgaggcttgcctaggttgtttgcaagaggaatcatgcctgtggatgctggcttgagtcaatgtgaaccactgttgccgatgtccgctggtgttgtgtttgccttgtgtggcactgtttgccgaccccctgacgcgctccagtccatcgtgtgtgattgcttttgcgatgtgtttgtcaatgttgattgcctgtgctcgtctccgtgggccctcgttttgttcttgaattgcctgcccttggcgattgtggcattttgccgttgggaatttgcatgggttgtttgctccactacgctgtgagtcttccggtcttccttggtgtgggtggttcggcctttgctgagctccctgtgggaacttacctttgaattgtgggaccccttcagttagccttgggtattctcgaatcaatcccaaaagtccacaggacggattggaatgggaccccgggtgacaggctcccgtggaacgcttatttggtccgcctgggaacgagggcctggtctggaacaccggtgaaaggcttttgccttgattggtcccgagtgcgaccacatggtgggggcgtctaacgttcaaaacaactgtgatgctcccagg

SEQ ID NO: 557369 - DNA, 89 bp, Homo sapiens
cacgctgacctcttccacgactatgaaccttagtgcattggtggagttttatgattgactaattttattaaatggattgtttttttttt

SEQ ID NO: 557370 - DNA, 331 bp, Homo sapiens
tgcgcggtgactctagcaggatcccgcaacacttcgtccactccgatatccaccaacagtcaatgtctaggtgactcggcgtgtgcatgcacacgccgaatcaccataccatatcgggtagcaacaacctagggtcagttttgcaggtggtaaagccatttaccaagatagttgtaggtaaagaagggcagatttattagtagaacttgtgaaaatatgttgcagtgggcagctcagcagataaggggctacctgcaaagaggcaagggctggaggaaagttttatagggtcctgctgaagggtgctacgtctggggtttcggcgtgtgca

SEQ ID NO: 557371 - DNA, 80 bp, Homo sapiens
caagcctcctgctccgggggcagaccagactctgactctcctctggggctgctgccattaaaacgctactactaagactc

SEQ ID NO: 557372 - DNA, 618 bp, Homo sapiens
agcggaggcgctcggtactgtcgacccgattgcttcccgccgagggctggtggtgggatgctggatgtgggtcgtggcggggccgagtccgggccgtgggccgtgtgggggaccgggtcggctggcctggtgccgtgcggactggcggcgatggtgctgctaccagtgtatgcgccgagggacgaatggcgagcgtgccagatgcgctctaacgatgatctgacaaggaacctgcggggaaggaccggagatgaaaggcaggcgctgggagggtgagagttgcatgcttgttgggtgcttggggagtcagggaaaggagcaccgatcgtgcatgctggatcgaaggatcatccacgtaggatggcgtactccgaggacggaagtgtccaggctgctaccgtggcggtctgtctacaggatacatccatccatggtagcatcatggtccattgtcaaagcccatgggtcgacctgccagattcgactttggccgactcacctccagaggcggagcgacatccatgggcagctattggcgctgtgctgcaccgaccgaggagcaaggcgtgctcgctgatgaccgtgtccggggtcatccagaggctctgggctgaccat

SEQ ID NO: 557373 - DNA, 477 bp, Homo sapiens
ctagatggtgattccatccctccctccatcaggtgtgtctgtgtattcacgcctcgccgggccgctctgctcagatggtgattccatccctcggaagaagtcttcccacgccttttcatgactccgttgttccgctcaccttgagaggaagggctctagtcctgagcctctccctacccctggggtgttatgtgatgcagacgcagggcggtggggaccgggatgactaggccaacgtgggacagaggaacaggcggaacgtgtccctgaggtttcgtgttgggggacagctcgctctggattaagcaaggcaagaggcccctaggtctcagcgcagggacaggggtttttcagggaaattttgaagacagcctccccgagacagaagaggcaggggaagataggggcttttgagaagtgtcaagccaagaactggatcattctgaaactccttgggggccagctgtgaggggtacc

SEQ ID NO: 557374 - DNA, 999 bp, Homo sapiens
cacgctaggtgcgggccgcgtgtgaatcggccgaggggcaggtgtcctctgggacaagcttccagaggaaggatcaggcagcaatattgctgttctgtagcctctgctggtgatacccaggcaaacagggtctgcagtggacctccagcaaactccaacagacctgcagctgagggacgtgaccattagaaggaaaactagtagacagaaaggaatagcttcaacatcaacaaaaaggacatccacaccaaaaccccattgtaggttaccaacatcaaagaccaaaggtagataaaaccacaaagatggggagaaaccagagcagaaaagctgaaaattctaaaaatcagagcacctcatctcctccaaaggatcgcagctccttgccagcaacggaacaaagctggacagagaatgactttgacgagttgacagaagtaggcttcagaaggtcggcaataacaaacttctccgagctaaaggagcatgttctaacccgtcgcaaagaagctaaaaaccttgaaaaaaggttagatgaatggcttactagaataaacagtgtagagaagaccttaaatgacctgatggagctgaaaaccatggcacaagaacttcgtgatgcacgcacaagcttcaatagctgattcaatcaagtggacaaaaggatatcagtaattgaagatcaaatgatgaaataaaatctgtgattgcgtcctactttaatgacaagactggacaacagcacttaccagagtgcccacctattctttccaaggccatcacaggacgacaggaagttagcggtgtgacacttttagaactggttaaggtcacttcttctggtatgggcctaggaacatcattacgggaggcaaagccctaaggatggatacgggggcgccaacggctcgcgtaagagactccccacataatggcacagctgaaaacccggggatcacctgagacagggcgtggcctcagacaaggggactcacggta

SEQ ID NO: 557375 - DNA, 365 bp, Homo sapiens
gaattcccccccccccccccccccccttttttggagagagagtttggctcttgttgcccagactggattgaaatagggtaatcttgaccaactgaaaccttcacctccgagtgattctcctgcctcagcctcctgagtagctgggattaaaggaacctgaaccactcccagttaatttttgggtttttcagtagaaagggggtttcaccatgttggccaggctggtttggaactcctgtcctcaagtgttctgcctgccttggcttcccaaagtgctgggattacatgaatgagccaccatgccccggcctgccttacttttttaatgaggtttgtgggttttaacttgtaaaacttgtttaagt

SEQ ID NO: 557376 - DNA, 589 bp, Homo sapiens
gatccaattgagctggaccccgcgccctagcctatgagggtacacttgaattctcctttttcgttcccaagacatgtgcaggtcatcatctggccattttcttcctgacggggccacttctcttcaatcttggagttcacaccattggcatggcaccatctaaatgaatcacatctgaaatgaccacttcccaagcctaagctctggcccgacactttaaagcctggtttgaaccttcgttcccactcatttacaacgggataatgggaaactgagtatgggtcaaagcacgaatcattcgtacgttggttcaagccttcgttgacagacttagccaccgtaacaaacctctctccgaaccttatgcctctgctggtctttcagtgcctccactatgatgatgtaggtggcacctctggtgaggcctgtcagagtggcactggtagaagatccaggaaccctgaactgcaagggtgcttcatcagtgccaacaggatgacatgaaatgatgtactcagaagtgttctgcaatggtgcccatgagatggttgtctgagagagagcttcttgtcctgtagaggcatttgga

SEQ ID NO: 557377 - DNA, 297 bp, Homo sapiens
aggatcccttaacaggcgagcccgggtacatggtgaaacgccatctctactaaacaaacaaaaattagccgggcatggtggtgcacacactgtaatcccaggtactcaggaggctgaggcaggagaatcacttgaacccgggagacggaggttgcagtgagtcgagatcataccactgcactacagcctgggcgacagagcaagattccatctcaaaaaaaatgataatcctcctctaatgtccgctgcccagaaggaaataagcaaagaaatctccaaaggatcacaaacgccccc

SEQ ID NO: 557378 - DNA, 834 bp, Homo sapiens
  misc_feature (22)..(22): n is a, c, g, or t
  misc_feature (63)..(63): n is a, c, g, or t
  misc_feature (80)..(80): n is a, c, g, or t
  misc_feature (83)..(83): n is a, c, g, or t
  misc_feature (111)..(111): n is a, c, g, or t
  misc_feature (115)..(115): n is a, c, g, or t
  misc_feature (121)..(121): n is a, c, g, or t
  misc_feature (129)..(129): n is a, c, g, or t
  misc_feature (141)..(141): n is a, c, g, or t
  misc_feature (144)..(144): n is a, c, g, or t
cttccgtcggctgaattgcggncgtatgcgcggctctgtggagtgcacctggggttgggggcnctgtgcccccagtcccntgntcctttggactctacttctgtttgcagncccntttggnctgctggngagagaagaccngcnaggtgtctctaggaggtcatcccctaattggctgggccccctgctagaacctgcttcatatacggcgcagtgcgtcacctaagttccacactgcactattgtgtcggagcagccttggggcctctggcagtggctaatggtgggcaccagtgatccaccacacagcaacccttaagcgtcaacctggaagcctcctgctaatccccttgagcccgatgagggagccatgcatggtagctcctctaaggggacatgcacttcaagatttttcttcatgcctcgtctgttgtgtgtaaccgatggcttcgccattagcagctcttgacaagctacctaaccgttgtccggcattacggtgcgagccataagcgcttttgcgggcaacgaccgatcatctcatctcgatacgtcgcgttgggtgccgattgtcctctctgggagacaagcagtcacgtgacttcattgtggagtcactgcacactcgcttgaggtgccatggattgtcaagtgacaccctgcatgacacgacccgtacctatggacctgtttgccaagtggcaagccttggccattcgagggtccagtgccattttcgcaggtcgcagcctgatacaggccaatcccctctgcctacctgcacacaggagacacctgtcagctatgaggtggccctggttggagcctctccca

SEQ ID NO: 557379 - DNA, 679 bp, Homo sapiens
gggggatccaggcatgagccacgaccggacgagatatctttgcctcctcaatatctatgtgctcctccctcaacccttgggggcttcagtgtaggtggtcagattccccaccatttatgcctatgatgacaagagtggaaactggtaataactggatggtgtcactaaactacgaaatactttcagatgcgtgccagggtccctgaagagggaagacacgcggacacaggcttgcacccagacacagaaccatgcatctcctcgagcatggtcgtcctgcatcctggcacccgtgaaatgcctctacagcctgggagggggcctgcgtctggatcccctgtgagcctacagagccctagatggtgacctggaaagcttcatcctgttccacaagtcctgagtataacaagaacacctcgaagcttcgatgggacaagactctatgaaacgcgacaaaggatgggacggttccttctgagcagaaccagggtgcaaactttcctgggagacaagaatacgaactgcactactgagtatccacccggtgcacctcaattagaccgttggtcaaccttgggggctgaggcatggagtccaaggactgcagaaaatggttgggacggaattgcacctttcaatgtcatctggacaggcttacccacctcgatatccagtacca

SEQ ID NO: 557380 - DNA, 662 bp, Homo sapiens
catacggaacgtgtaagtccattaaacctctttctttgtaaatgcccagtctgggtatgtctttatcagcagcatgaaaatggactaatacagtaaatggtaccaggagtggggcgttgctgaaaagatacccgaaaatgtggaagctactttggaactgggtaacaggcagaggttggaacagtttggagggctcagaagaagacaggaaaatgtgggaaatttagaacttcctagagacttgttgaatggctttgactaaaatgctgatagtgatatgaacaataaggtccaggctgatgtgttctcaaatggagatgaggaacttgttgagaactgaagtaaaggtgactctgttatgttaaagagactggcggcattttgccctgccttagagatttgtgaaactttgaacttgagagagatgatttagggtatctggtggaagaaatttctaagcagcaaagcattcaacaggtgacttgggtgctgttaaaggcattcagtttcacaagggaacactataacaaaatttgaggggtgccttaaagttcggaaatttgcagctgcaatgccatagaagagaaatcccattttctgaggtgactgggtgctgctaacgcctcagttcccacggacactggtgccaattggggggctca

SEQ ID NO: 557381 - DNA, 232 bp, Homo sapiens
tgctgaggtcgactagagttcctctgaaggagagagactttgcttatgttaaagatggtaacagatctgatcaagacttggactctcttggaggaccttagtcaaactcctagtctccacctgagacctggagagaagttgaagcacaactcccttaaggtctccaaaccagacggtgacgcctgcgggaccatctggggcacctgcttccacccgtctctctgcccaccat

SEQ ID NO: 557382 - DNA, 343 bp, Homo sapiens
caggtagtatgaactatactgtcccaggctacaggaatctctggtaattcatgactgtgcttgcgcagagacgggttgcaccagagaaggtggaatcccaaatgttgatggtgcggccaaagtgctgtggtctgagtggacaggtgcctcattagcctactattgccatccccctatatcttggactcctcctccatatttcaatagagagtatggtggtagacatgaccaagcggcttcaatctggaagcacacgggcaaacagaacaatgcacagcagcatcagcagccatcacagggccctcatttggcccatagctatccttttccagtcttccggtct

SEQ ID NO: 557383 - DNA, 195 bp, Homo sapiens
tgacagcagcaagacaccagtctcgatggatcacgctcgtgtgctactcaccaccagctgagctttcttgttctccaccaagggtggtgacggtgttaactcctgctcgaaggacagtgtgtctcttcgttggcacgtccccctttgccagcatgccttcttctcggccccggtgccaacagatctctgacttct

SEQ ID NO: 557384 - DNA, 104 bp, Homo sapiens
gtatacaaatactatgcagcgcatacacatacatgcacgacacacaactcacacatgtacatgcacaccaatacatgcacacatacaacacagtacacatacgt

SEQ ID NO: 557385 - DNA, 162 bp, Homo sapiens
tgtcggccggttcgacggactggggctctccctactgctgctcccagcctggctgtgcatgttggcactttctgctcctcctgcctgctcccctccccatcgacgagaatggacaaggagaggagagaagagagctgagtgtgtgcactgctgtgcgttggg

SEQ ID NO: 557386 - DNA, 152 bp, Homo sapiens
  misc_feature (68)..(68): n is a, c, g, or t
aatattgcgggatttgatccctttatgaaccttgtgatagatgaatgtgttggagatggcgatagtgnacacagaacaatattggaatggtggtaatacgaggcaaatagtatcatcatttagaagccttggaatagatgctgtagttgcta

SEQ ID NO: 557387 - DNA, 207 bp, Homo sapiens
cttaattataaataggctcacaaatataaaatagaagtgattattcttttctttcatatgtaatagatgtactgtggtaaaaaggcccactccagcaagtgtaagtccaggcgtattctggaacacagtccatccaagtagcgcgatcgccatcggatgtagtcttgctggatctattctcttttttcttttctttatttttttttt

SEQ ID NO: 557388 - DNA, 193 bp, Homo sapiens
cccgtgtataacatcttaatataactctatattatccataactactaccgcatcctactactcaacattaaactccagacaccacagacccatactactatctcgcacccgcaaaaaagctaacatgacataacacccttaattccatccaccctcactctcccataggaggacctgacacccgactacacag

SEQ ID NO: 557389 - DNA, 686 bp, Homo sapiens
gaaaccccgtctctactaaaaatacaaaattagcaggtgtggtggcacacgcctgcaatcccagctacttgggaggctgaggcaggagaatcgcttgaacacaggaggcggaggttgcagtgagccaagatcgcgccactgcactgtagcctgggcaacaagagtgaaactctgtctcaaaacaaaacaaaacaaaaaacacccctctaaaccacagttttcatacctgtaaaatgagaactacttcatacagttataaggattaaatgaaactgaagggacatcttcaggtacttaacacagtgactgccacagaggttgtgttccgtgatgtgtattaagtgtatctctagaattttatttattcattcgaaaaatatcagatgctttggaaattataatattagtgaaacaaatctctaatctcaaggagctcataacttaaaaggaagaatcaagtacaaagtaactaaaatgtgagatcattggtgatgcatatcatctgaagtgtgaaaagaaagtgttcagaagttcagacctgagagcccactgggtaggcagtgagcaggggaggacacatgaacagggtattgtttggtgcgggtctccagggacccataatattccaataatggtaaaggaaggagcatgagaagaaaagagtccaggaaaaccactgtgtaagg

SEQ ID NO: 557390 - DNA, 121 bp, Homo sapiens
  misc_feature (104)..(105): n is a, c, g, or t
taatgcaaatgtatatgcatatatgtggtgtctgagaaacttcaactagttttttgtctcccaaattatattttctgtgtcagccagtgaggtggctgggaaanncagggagagagttctg

SEQ ID NO: 557391 - DNA, 199 bp, Homo sapiens
atccccccggctatttacaactatctcgccatttacaactatctcaatataagctttgcctttaagcagcttagcaataggtgagatcagtcaaggtacatatgcaagttacaaaacagcatatgtgttagatgtacttttctcaagatctaacgactggcttaaccgcatggacacactcggttgcgtcacttcttgt

SEQ ID NO: 557392 - DNA, 336 bp, Homo sapiens
gcgaggtgatctagaggatcccagcggggaacaatcacttggacaatcacttggaacaatcacttggaacaatcacttggaacaatcactgggaacaatcactgggaacaatcactgggaacaatcacttggaacaatcactgggaacaatcactgggaacaatcactgggaacaatcacttggaacaatcacttggaacaatcacttggaacaatcacttggaacaatcactgggaacaatcactgggaacaatcactgggaacaatcactgggaacaatcactgggaacaatcactgggaacaatcacttcccgctaagtgatggttccccgcg

SEQ ID NO: 557393 - DNA, 301 bp, Homo sapiens
gtgagctgctgtctggagccctgagccggagccctgagcccgaatgaggagtcggtcccggcctcgcgcgctgcccgggatctccgggccctgggtcctggttcggtgatgctccccgggagcaagaggtaggatgattgagccagggatgtgtgtctagtggtttactcgctggtggtgacgtgctgctccatttgatggtaaccctggatcgtggtaaatgcgtatcaaagctcgagtcagggagatggaggaagaagctgagtaagctaaaggagcatacagaacgaggtagagaatg

SEQ ID NO: 557394 - DNA, 161 bp, Homo sapiens
ggggggggggggggccccccccccccccgtttgggggggcttcctggtggggccctgcccggtttccccccccgggtttgggggggccccttgggggggggggccccttagcccgggccccccccgccctccctttttggttttcccttttttttttccca

SEQ ID NO: 557395 - DNA, 567 bp, Homo sapiens
  misc_feature (54)..(54): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (70)..(70): n is a, c, g, or t
  misc_feature (74)..(74): n is a, c, g, or t
  misc_feature (76)..(76): n is a, c, g, or t
  misc_feature (78)..(79): n is a, c, g, or t
  misc_feature (409)..(409): n is a, c, g, or t
ccttccccttgggcggtgccctaagaatttatgcccttcagaaataagcaaaangcggncncanccttanccancncnnagaaacatccaagcaataaagtggaagactaaccaagatttggacattggaatgtttctgttattctttaagaacagctacaaaaagaaaatgtcaacaaatttttccagcaagctgagaacctgggaattcctgcacggaagacaagagagtagcctctccagtttcagcaaccgctaggtttttattttttttcctggtttttactgtttgggaaatatatattgaaacaagtaatattaataccgcatggggagaaccccaaccaaagaaatctgaaatatatagtaaatgcttttttttccgtttttgttcattttggatgctggngctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttca

SEQ ID NO: 557396 - DNA, 415 bp, Homo sapiens
tgaaaacctatgcataatacataaaaaactcgaatgcagataataattggtcattgatgagtcgagtgacagtagcgaatacgaaagggaatgaacagtgatgagacatcaagagggacagagaagctatggacagggaagagactgagaaacttctagagtaaacagagtaccaggaaaggttctgtgtctcacgtgggcgagatctgggcatgcttacaagatgtcgggtaggagactatatacagtgctcagagtccaggaaaaagagggaacaatcacttctttattgcctgctgtcacctgaacacacagtggtgaacaagacaaagtcctgctctcatatagcttaccttctactaaagacacaccaaaagaccagagacatcaagcaaggaaatcagacaagcgaggt

SEQ ID NO: 557397 - DNA, 601 bp, Homo sapiens
  misc_feature (54)..(54): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (70)..(70): n is a, c, g, or t
  misc_feature (74)..(74): n is a, c, g, or t
  misc_feature (76)..(76): n is a, c, g, or t
  misc_feature (78)..(79): n is a, c, g, or t
  misc_feature (409)..(409): n is a, c, g, or t
  misc_feature (568)..(568): n is a, c, g, or t
ccttccccttgggcggtgccctaagaatttatgcccttcagaaataagcaaaangcggncncanccttanccancncnnagaaacatccaagcaataaagtggaagactaaccaagatttggacattggaatgtttctgttattctttaagaacagctacaaaaagaaaatgtcaacaaatttttccagcaagctgagaacctgggaattcctgcacggaagacaagagagtagcctctccagtttcagcaaccgctaggtttttattttttttcctggtttttactgtttgggaaatatatattgaaacaagtaatattaataccgcatggggagaaccccaaccaaagaaatctgaaatatatagtaaatgcttttttttccgtttttgttcattttggatgctggngctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcanaggaaaaaaaagaataaaattccccaacttaaa

SEQ ID NO: 557398 - DNA, 435 bp, Homo sapiens
atcctactgtgtgagacggggcctcactgggcgctctctcacggctcgatctggtggaacgactgtgtgtgtgtgcgtgtgtgtgtgtgtgtgtgtgtgtgtgtcagagacagagcaagcccgagagagccagagcgagccacgagacgaagcgacgggaaagggtatctctctatcacccaggctggagatgcagaggcatgcatcacgactcagtgcagcctcaaactcgtgcgctcagacaagcctcccacctcggtctccaaagtgataggacttccctgtgcttgcccatgagcccaagacagaatgatattcttacaccagagtatctatgtcacacccccaagcagtgacaaacagaacaaaccggacagtcaatgtcaacgttacacactatacactaatctcccctttctctactcatatacggct

SEQ ID NO: 557399 - DNA, 820 bp, Homo sapiens
ggtagttctcacttctgtcatctatcgatgggtcaatacacctgatgaagacatggaggactgggacccatgaacatcctttggtatcagacccgaagcgcaccattgcatcaggattatggggtcttaaaggctgatgaaggcatctcgttcaggggccttctttatcacttgatgatagaagggatattcgttcgtgcgagtatctactgtaatatgacctcccttgttggccgcgtctgtggatgacgacgtttgagactagttcgaggccttcctatgtttcacatgactaaacatgggtgaagtgtgcccagcgtggcgtaggaaaccttggcatgcctgataacccagtctaacggcgcttgtatggttccagataacgcagacatagagcatacttatttgttccaaagtgcagtagagtgagcgctggagcttgattataagttggtccacggactgtcggctgggcatgccgactgaggaaacgaagagatcctacttgcttgtcatttttttgttggatccatgtgagctcaaagataccatccacatcacttcctgattcgttgcccgcatatttcgtcgtttggatcctctgcaaggggtcgatgggcccttttccgtgagcatgtgcggggctgtgaggacgacctaggctcttttacttcgcttctgtgttcagggatatagggcctgagtcttggcggttttgtagtgcgcaggcggttacttggtctggtgtgtggctcgctactttaagggaccacggctagagccgattcatgtcttcttagtcgggtcagggtcctttgca

SEQ ID NO: 557400 - DNA, 591 bp, Homo sapiens
  misc_feature (221)..(221): n is a, c, g, or t
  misc_feature (268)..(268): n is a, c, g, or t
  misc_feature (427)..(427): n is a, c, g, or t
  misc_feature (470)..(470): n is a, c, g, or t
  misc_feature (536)..(536): n is a, c, g, or t
acaagctttagtggcatcaattggtaaaataaagctttggagaaaatttatttatcattggattaatatgtaaaggttgtagagataggtgtgtgagtcattcagatgctagcctttctcgcttttctccactgtttaaaaatataacctttctttagtattttgtaagcttatggaagacagtatctagtatttttaatgaaataaggccctcatctttnacagccagcagtagataaatctggtgaagggcggctgggtttcttanagtggacttccctccccactttgcccgtggccttttcaggcactggaagaaggtcatgtcagtcaacttggtccatgttgctatgatgctctgctccttgtttgctcctatctctactcagaacttcccaaaaaccaagattatattttattcatttcngcatccccagcacagtgcatagaaccaacgcattcgtaccccntgactaaccattcacccaatacatcagtgaatggggttccacgcgtccgccattgttcccctgtgngacctgatggttttaaaactaaataccgtcccccacttcacaccaaaacacacaa

SEQ ID NO: 557401 - DNA, 1031 bp, Homo sapiens
  misc_feature (1026)..(1026): n is a, c, g, or t
attccgatcaggctgcaagccataaccactctccggctgtttatgcctgcacttgaactcatggtcgcttatgggaggatatctccaagctattggacattttgtggagtacagtgggagataccctatcatcgtcatcttcctccaggccttctagtgtcagcttcaccctaaatctagatttttttaattttttcttggttattgacacaggaggtttttcagaataatgcaaacgtaatcttatttcagtctgacatgtcagccatccagaatccagagtttcaacaccattgtggattccaaattgtccatcgtcaataataatttcgctttctagaatttaaggaaaatagaaaatttagttaaaactcttgatgcatacccagtgaacaactgagaaattacccaccttaaagatcgtttataatattaaatctacagcttaaaagcagcccaaggtgaataagcatatttattgtagccctcaataaagaattccctttaaaggaggctagcaaacagtaatggttcttacatactcgttgattggccattatgttaaaaagaagaaaaagaaaactcttcagaaagggctctagaggcactgggaataacttctacactaaccaatgtaccaggactccagggtgctgggccaacgataactcccttcttggaatttcaaacccaaacgtcttggcaccaattaaaatggctaattcctaatgtagtgcaaaatctgaacttggctcaaaagggaattcccccccatatcccaactattcactactggccaggtaaaaagctttaccgaccaggggggacttacctggtatttacagacctgggagggactaacccaagaataacgctaccacaacccttctctaaaaaaatttcacccaaggggaaaaagccggagaaacccacccctttaggtaaaaaacaaccaatcttccgggcaaatttctttcccggttacttaaacggtaatcggaaaccttggacacgggaggggcaagntccct

SEQ ID NO: 557402 - DNA, 100 bp, Homo sapiens
tcaagcatagggacttccgcacaacctctgtgttaggattgacaataatagtggggccatttccattttagtcttttctaagagtcaaccacaggcattt

SEQ ID NO: 557403 - DNA, 81 bp, Homo sapiens
agaaatagaacgaaaatataaagtaaaaagataaaaaagaaaagataaaaataatgtaaaagtaaaaaaagtaaaaaagca

SEQ ID NO: 557404 - DNA, 129 bp, Homo sapiens
agtctctgcaggatccccatacttcgattcgcggagaatggggactatacaaataatagacattaatatatgtagcttctaaatgttctatcaactacccagctggaatcagtgacataggcatgagct

SEQ ID NO: 557405 - DNA, 270 bp, Homo sapiens
tcacactagactatccacgctcatccctccttgagattccttatttattaacaggaagtctgatttttttttttggccgtctttgaggctatattttggggggctgagggggagagattagattattttgacatgggatcccttccataacaggcactttgaaggcaagacatatgttttgaagaagcacacccagcctttgaaatcatagctctccaggggcttttaaagaaagctggtcctcagcactaacaaaatcactacaatagc

SEQ ID NO: 557406 - DNA, 732 bp, Homo sapiens
  misc_feature (23)..(23): n is a, c, g, or t
  misc_feature (139)..(139): n is a, c, g, or t
gaacaaaacagagtatgatacancaatgtagatgaattccagaaacatggtatgcagaagagccaggacacaagagtatacataagttatgtgaaggcgaaactattctatcgtgataaaaatcagaatgctggtgttnatgggagatagaaattaactggaagggggcacaaaggaactttctatgtctctgttatggtggtaaatatatacatttttatatatacatatttatacataggtgtataacctctatcaaaatcaaaactcattctgtgtgcccttttgagaatctccagagaaattgcgcctgtactatatcaatacctatcctcacttcataaaaaattgcactgtcgagcctaatcaactctcacctgaagtgcttcatctattttcctaatggctagcctggtccctgtcctaattaaccttcaaagctgttttaaaactttgctcttctggctatgctctgattccaagagatgtggtagacacgtacattgtcaagattctggcactcctcggagaacgttcaacggttcacacgacacgacactatctaatataaggaagcgccagatacaagcttgtgcacagctcgaaccgcctacgggcaacgttgtccacctgagacgtgcttcacttatcactctcatggtgaactgcatcacctcgctctctcacatcactcatttattgtcttagaagccgcacgggagaacaggagga

SEQ ID NO: 557407 - DNA, 735 bp, Homo sapiens
tggaggaccagtcagaccagcgcgtcatcatcaagctgaacataccatgtgggaaacatttccctggtggacccagatcttgagtgggacatgtcagtagaaggagaactcaccagagaagtttgccctgaagctgtgctcggagctgggcttggcgctggtggacgtttgtcaccaccatacgcatacagcatctcggggacatgctgtagctcggcactcagaagaccttactgccattactagcgagagacgcctctggtcccactagtggcagtttgccatccgtgcaacacgggcgatgcggaccagtggctgcccacttgctggagactcatgacagacagctgagatggagaagaagatccagcagagccaaggactaggaacacgtaggcgtgatgaggcgtctaagcctaacactggccccaggccatggctaaccagccctatcgagcaaaacggcgtcccacggagcatctcaagaagattgggccgcatttcctccatcttctggcaaggacagaggcgaggggacagcccagcgccagtcctgatggatcgggtgaggtgtggagtgggggcttccaggtggcccttacccggcacacattcacatttgttgagccaccagtcctgccccccaccccaccctccatacccctccccagtctctggggtcaggaagaaacctttttaggttgtgttttgttaactgtatatgagccccaggca

SEQ ID NO: 557408 - DNA, 694 bp, Homo sapiens
gctgacgcgggtgtggaggcggcggcgcgtatgggtgccctatggggcctcgtgcacgattctgtcgtgggtcagcaagagggccccgctgaccaggtggctgcagatgtggaaatctggcaactatacaggttacgagttgtggaagggccttgggtcctctctagagaatccagaaccccgaactcgggcacgtaggaatccagctttgtctacaggtgctactccacttgtcgcaccttgctccatggagaaaggatggtactggcgtgtcactaactaggactgtcgttccttggattgctgggcccagtggtagacctgcttcgtgttctatgagaaccggcgtggaaggaccatcgtcttgtgactcgccatctgtcctgcggggcttgaccggccttagcctgtgtgtggcctgccccagggctggctgttaactgtggcttataaagccatcttccagggaagctgcatgttacagtccctgccacgggtggaccgacacttgcagttctacaatatcatcaccgaattctatgcggaacccgggaagaagagctagaacgagcttaggagcctgacttcagccttaagggtcatccaggtgatggatggcgacgcaggctgccccgtatcttctggaggcctaccgcctcgaccagacctgattaccgcgcactatatccggaac

SEQ ID NO: 557409 - DNA, 306 bp, Homo sapiens
gaggtgatctagaggatccccgccgtaccagttgcggagacttgctttcattcagccacatgagcattagtgaggttgggcactgatgttgggcgattaggtctggcttgcagtcgacgttccataggtgtttgatagggttgaggtcagagctctgtgcaggccagtcaagttcttccacaccgatctcaacaaaccatttatgtatggacctcgctttgtgcacaggggcattgtcacgctggaacaggaaaaggccttcccgcaactggtacggcggggagatcctctagatcacccagcaca

SEQ ID NO: 557410 - DNA, 390 bp, Homo sapiens
cttcccaggcctgacctggcagggtcttcctctggatggagaagctgttgacagtctcatttctcaaaatatgcgagatatgctctaagaaacggataggccaggcgcggtcgtcacgcctgtaatcccagcactttgggaagccaaggtgggcagatcacttgaggtcaggagtttgagaccagcctgaccaacacggtgaaaccccatctctactaaaaatacaaaaatcagccaggcgtagtggcccacacctgtaatcccagctactcaggagtctctgagacacgagaatcgcttgaacccgggaggcggaggttgcagtgagctgaggtcatgccactgcactttagcctgggtgacagagcaagactccatctcaaaataaat

SEQ ID NO: 557411 - DNA, 168 bp, Homo sapiens
  misc_feature (41)..(41): n is a, c, g, or t
  misc_feature (52)..(52): n is a, c, g, or t
  misc_feature (113)..(113): n is a, c, g, or t
  misc_feature (146)..(146): n is a, c, g, or t
gagcggaggttcagtaagccgagatcacgccactacactcngcttacactgncatgatgaggaggaggaggatgatggtggtgattatgatagaaatggtgatggtgatgatnacaatggtgatagtagggatggtcttgctctgngcaacaataatgatcataacac

SEQ ID NO: 557412 - DNA, 140 bp, Homo sapiens
gaagttgaggcagagatggagacacctcagccccacctctctggaacaggaaagatgattggggagggaccacaggtcaccgttttaagagggtcttggtgcgccttgggggtggggtggcttcttctcttccttccttc

SEQ ID NO: 557413 - DNA, 850 bp, Homo sapiens
cgggaaatttaagtgtgctgccaccaatactgcccccctgtcgagttttactagcatggtgaccccatcccctgtgccgatgtttcaccccggagatattggtcacacacagctgccccttggtgccccaaaccactcctgtgcctcaagtggggtacaccctgtcgctttcaatgtagctggcgttggtgtccccgcccccccacatcatgtcttgtggcgcaccatcctattaatggaagggggaacgtactcagtggcagtggccgccactaacaatatcattgttggcgccacaacactgtgggtagctagtggtgagctcctactccgatggcggccccccacaaatttgcgaggccgaaccagggtgtacctatgttgccgccccagccagtggatggtgatgaggcccacacctcgtttcacaccatgttgggtgctgcaaacaaaggtggggccacacgcaaactcgttctctctttggcgagcagggatgacaacaaggggagagtgatcatgatcgttggcaccccactggacaaaattggccgcgtctccttatgtcctataaataactctggcgccacacgtctatgacgccgataggcaacacaccactcggcagtctcctcttctctggggagacaactagatagtcgcctccttgtccctcgtactcttgaaatattaccctgtgttcgcatgcagcaccccatcgactgtcttttcatatcagaaacgcatcccgcgcaaaatgcccactgtagtcccacatgtactcccttgaccagaaaactagtttatacttcacatataataaagcacatcccccccaacccacataaca

SEQ ID NO: 557414 - DNA, 167 bp, Homo sapiens
  misc_feature (2)..(2): n is a, c, g, or t
  misc_feature (19)..(19): n is a, c, g, or t
  misc_feature (25)..(25): n is a, c, g, or t
  misc_feature (72)..(72): n is a, c, g, or t
  misc_feature (84)..(84): n is a, c, g, or t
  misc_feature (90)..(91): n is a, c, g, or t
  misc_feature (102)..(102): n is a, c, g, or t
  misc_feature (114)..(114): n is a, c, g, or t
  misc_feature (126)..(126): n is a, c, g, or t
  misc_feature (129)..(129): n is a, c, g, or t
  misc_feature (138)..(138): n is a, c, g, or t
  misc_feature (141)..(141): n is a, c, g, or t
  misc_feature (147)..(147): n is a, c, g, or t
  misc_feature (155)..(155): n is a, c, g, or t
  misc_feature (158)..(158): n is a, c, g, or t
  misc_feature (166)..(166): n is a, c, g, or t
cnttgggttccacactcgngagcantcagcttctcgttacaggaaatgttagagggatcaccagtctgactnataactctagcngctaanntagggactaantttcaaagcatncaccaaagcagntgncactgggcngcngctttnttccagtntcnggcccttna

SEQ ID NO: 557415 - DNA, 600 bp, Homo sapiens
cagcaatccctacactgatcactgtctctaacgtcgactaatttacatatttaaaagtttctttggtattgccgctgtgtttttaaataacttgtctatctgtcttgacttcttagctatggattttgagaactgacttcccgccccggttgaggattcagctttcttactgtgccttcctcatgcacatgtgcctccctcccctcatcctctgggtgttttctatcaccttgtaaagaaatcagtagtctgtgtgtacatttttatgactatgtaaatattattcatggatgacctatctggtgtactatgattgcatttcctttggttttctctgtagttaataatcatctcttttttccatgggcttacttctctatattcctattaccaatttgtggccagaattataaatctcctttcagtacattccaacacactgtgtattctgtgggttgggaacctcctgcaccttctgttcttaatttcaagttggtcctggttaatcattgaaactgctgcacactgtcatcctatggcctccatttactgtcatctggtaggtttcatttgtcattttcctgtgttgggcgataacat

SEQ ID NO: 557416 - DNA, 153 bp, Homo sapiens
  misc_feature (119)..(119): n is a, c, g, or t
  misc_feature (135)..(135): n is a, c, g, or t
tactgcccaagatattctaacaaggaagcacttgtcccatataaggactttaaaaaagcatctttggagctggaagtggtggctccaaagctgggtgtaatcccagctactctgcaggngggcaggcaggagacnatcccttgaacccaggag

SEQ ID NO: 557417 - DNA, 561 bp, Homo sapiens
gaagaaacaaaatttaaagccaaaggaaatgcatcttatagcagagagctggctacctgccaaaccaaacaatccctgagactgcggcagggctgggaagcaagctgagctgccacgctgctaacttgtcaaacatacataccggctttgcttaacaacaatgcgacacgtgcctgctagaagcctaaggaaccaacatcagaagacagatgagctataaatacttagaaagagtacaatccctcgatcaaccaaccaccccaaactttcttcatcctgttcttgaagaagtgcttctttactgggagcgtgacacattcagacctaaggagtcactgagaaatgcagcaaataaagcatagagagcacatttgaataaaaggaccagagaaccaggaaggaacatcaagacatgagatctacagaatcaaagagaaagccctcacattatatcatgagattccaatggcagaaggccactgcagtgcaaagaactaggttctgaaattagtctgcatattttaataaacttatttgcttaattaacacaaaaaaaaaaaa

SEQ ID NO: 557418 - DNA, 98 bp, Homo sapiens
cctagtacggcgcagatgctggacttcggcttagggcggttcagaaagtggctcttctgagcagaaatggctaataaacttagtagctgatctggaac

SEQ ID NO: 557419 - DNA, 414 bp, Homo sapiens
taaatatcacgggcttaagagtttggagtcacaggatgggtgtccgccaagagcctagggacagaacgttgtcagcccctgtgcccggaccctgtggactgtgagaagagcagagtcccacccccaggccttcttagacccaccccgggttttcccagcatccttcctgcaggaccggacccctggctgaaagtacagaaaccctagagtctgcagcccatgtggctgggccgccatgtttccagaatcctctggtctaaggatccagacctcttacggagcccaacagctcaagggacagttagcatgttcatgtgtactgggaggagcaggagccaacagaggtcatgaagatccacaggggctccggttccgaggcccttgggttttatcacccaatgtttcccacccacg

SEQ ID NO: 557420 - DNA, 286 bp, Homo sapiens
tgcgtagggcggtcagtagtagctgcggacatacgtggcctcgtgtgcattggggggcaccacatagtagtagtcttggtacgggctgtagacgcgcacccagatccgcctctcaactttacagaggctccacgagcggatcacacacctgaccttggagcaaacccggcggctcatgggagggacggtggctccagctggggccggggtggagtttgcctccagcagtactgtgtgccatgctagggcatcatccttggtctccgcacagaggtgcaggcggccg

SEQ ID NO: 557421 - DNA, 149 bp, Homo sapiens
cacgaggattattttttttttatggcttcttgctcttggaatgagattctctgttgaatacaaatcctgcacttgcttaagagctcttgcagagttggcattagagcatgggtttaactgtttgggagtgcgtactgacaggagcaaag

SEQ ID NO: 557422 - DNA, 119 bp, Homo sapiens
aggatcccggcgaccgggatcacaaaaaaaaagtatcctatgttacgagctgaaagaagacgactgaggagacgggagactaagggcagtgtgagatgttaagattcaaattttgttat

SEQ ID NO: 557423 - DNA, 899 bp, Homo sapiens
  misc_feature (1)..(1): n is a, c, g, or t
  misc_feature (62)..(62): n is a, c, g, or t
  misc_feature (72)..(72): n is a, c, g, or t
  misc_feature (100)..(100): n is a, c, g, or t
  misc_feature (125)..(125): n is a, c, g, or t
  misc_feature (161)..(161): n is a, c, g, or t
  misc_feature (180)..(180): n is a, c, g, or t
  misc_feature (236)..(236): n is a, c, g, or t
  misc_feature (256)..(256): n is a, c, g, or t
  misc_feature (515)..(515): n is a, c, g, or t
  misc_feature (542)..(542): n is a, c, g, or t
  misc_feature (604)..(604): n is a, c, g, or t
  misc_feature (647)..(647): n is a, c, g, or t
  misc_feature (652)..(652): n is a, c, g, or t
  misc_feature (690)..(690): n is a, c, g, or t
  misc_feature (759)..(759): n is a, c, g, or t
  misc_feature (767)..(767): n is a, c, g, or t
  misc_feature (776)..(776): n is a, c, g, or t
  misc_feature (815)..(815): n is a, c, g, or t
  misc_feature (833)..(833): n is a, c, g, or t
  misc_feature (891)..(891): n is a, c, g, or t
ncccctctttcctttttttttgtctgtttttatttttcctggggtgggttcctcccggctgnttgctttccntcctgggggccccctgggggctcgggcntctgcctcccccctcgtggcgtgcnggggggggccggggtgccccctttcccggtcccggngtgtttcccttccccgggngggggcgggggggggctggggggggcccctgttcgggcggtggggggggcggggcngctcgggggtcctggggggngggggcggctggggggggccggcccgtgggccgtgggggggggtgtgcccgccccgccgcccggtggtggcgggggccccttgggtgttgtgtggtgggtcccggcgccgcgtgtgtgtggcgctcctgccgccggccctggggtgggctgggcggcgggcggcggcggtgctgccggggtgcggtgctgggggtgggggggctctgggctctcccggtggcctcccctgcccccgcgcgcccgtttgcccggctcccntcccggttggggcagagatggcaaagnaaagacagcagatggtgggggcaccgagttctgttccccgtccccgccaggctggctggggngtggctggggggggggggaggtgccaccctggtcctgtggagnccccnccatgtctgccccccgtcagggggcgagacagacagcntttcggggaccctttcgggccacccctacttcttctcccccaaaccacagcctctctgcccaaatgggntggcaaancagcgcccnaaggcccctggcatgtggggggtctgcccgagctggggnagagcagcgtgtgcccangaaggggtgcagctgggttttggcgaatacagtggggggcggggtggtggggaggggntccgaagc

SEQ ID NO: 557424 - DNA, 83 bp, Homo sapiens
tgatgagcttgtacctcatgcattgcccttacccagccatgttggactccagacagctgtggcatgtataaactgtctggagt
